United States Patent 6,812,339 (POLYMORPHISMS IN KNOWN GENES ASSOCIATED WITH HUMAN DISEASE, METHODS OF DETECTION AND USES THEREOF) - sequence listing, part 39

SEQ ID NO: 13928 - DNA, 45862 bp, Human
  misc_feature (1)...(45862): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatatattttgaaatttattctaccatgagatagctgtaacaactctctgtgtttagaggcagtattaactgactcataccaggaaggagttcatgataataacttcatgattaaatcatgctgtagccaactgagcaaccttaataccctgaatggtcttaagacatttattttttaatgtgaaaatttctgtctgcttttaaagcatgtagcttaaaattaatgagcccaacattgtgggttttaagcttaattacactagaattttaagaagcactctgctgtcagaactccgaaagctttattgtagtcacagtgttggaatgtataaaaattatagctctgttgcattagaacttagttgaccagcttttgagaagtaaaagcttgactgctggtttatatttctggcttgtgtaggaattaaagggtgctaagttaaggttggttctacaggtagctgactcagggaagagagagaatggggtgatattacaaggtaaattaacatcataaagttgagaggactaatacttaagctctgctcaactgctcctgttagtattgacaaggatgcatttcatggctgatgagcacagttttgacttgtgtatccagtggaggtgttccctttggcaaatggtcctcctttttaactaatttttatgttttaattgtctgtattggtattgtgggagtaaaagattgaaagacttatgattgtcctttctatagttgagaaaccaaggcagtatcatgagcaggaagaaacacctgagatgatggcagcccgcattgacagagatgtggtaagtacaggagtcgcctttagatcactggcttttcttttaagaggaaaaagaaaacttcataagaaaatgaagctgatttaaatagagatattttatggaaaccatgttttctgttacctgtgatggctatgccctttgaatttgccctttgaattattttctcgttaaacatttttgcctttatgccaatatttagttagtagacttgggctatgatagaagaatcagcttattaactagtttacattggaacttaggctgaattattagatttcaggaatggtacaatttttattttattatcgtttgtaattcataattgaaatatctttttaatatgtcttcttggcatttattaacaatgtattttagaatacctaagagataaaagttaagtggcatttttaaaggatagatttgtaaatcgtaaagcttttataaaagataatgctacatttgttttctttatagtgatttacagaatgagaatgctgtaaatgctttattatagcattttcattctttaaatgagatctagaatatgatgttaatacattactttttataccatatacatgttaccagcttattgagaaacaaatactgaaaggaatttgaaatttctaattcaatttttacagcacactattacatgttatacttaaaagtttaaccccaatttgtagtcttaaattagaagaatgtcaagtttcacacatactggagaaaggcaactaagactatagtatataagataatcaaattcattccagtgatctctgaaagcatggtgcattattctattttgtcatgtggaaactcttattaatgcttagtatcctagactagctattaggttatcacaacaatctgtatacctttaattccatgaagtaatattgtcagtgctttattgggacatttatcagtaaagcaaaaatgtcagtgctcttctaacaaaacctattttagaattttcctcctaactgtgtgggagaacactgagaaaattagagtaattgaaaataataatctgagcagatattgtgaatgcttccttgatgacattgaaaatagagcaaaagtaagctaaagaaaaatgtaaatgtcagaatatggctataggtatatttagtttgattcttgtaattagtaataaacttgcaattggcatgtgggctgcttccttttctaaaaaaacctttctattatttactaacagagtacagctaaggtaaaaatagttttgttttatatctttattctataatttctaatttcagcaaatcttaaaccacattttggatgacattgaattttttatcacaaaactccaaaaagcagcagaagcattttctgagctttctaaaaggaagaaaaacaagaaaggtaaaaggaaaggaccaggaggtaagttggattttcttaatcttctaatgcctggttagatctccagtactggctgggcgcagtggctcacacctgtaatcccagcactttgggaggccgaggcgggtgtatcatctaaggtcaggagttcgagactagcctgaccaatgtgatgaaaccccgtctctactaaaaatacaaaaattagccgggcatggtggcatgtgcctgtaatcccagctacttgggaggctgagacaggagaattgcttgaacctagcaggcggaggttgcagtgagctaagatcacaccattgcactccagcctggaaactccatgtcaaaaaaaaaaaaaaagaactctggtactaggcagagttttgaccctcatgaactgcttagcaaaacttcattgactgtggactagggttcctcttctagttttggggtagcacttgagatttaggcaaagagtaagatgaactcagggaagagtccattttggttataagtcagctatagtgaagaaagatcctggaatgttttacctaaatcacagagactgagattcaggcagtgaccatctatctgtagttttcattagttattgtaaaattaagtatctgttaaagaaagacatagctctgttcttgtagttggatttattctgttgtaaactagaaccatattatttgttaaataaaagggttgacttactaaaatatttaaaagtttcaacaggatttgaattttttatcacaaaactttaaacggtacattcaggtcacatacaaagtcacatacagacaattttgaagtatgctgcagttcagctatttaaaatggcctcagctatataaaattaaaattatggaagtaatgtttatacttcctctgacaaaatggtagagattgaaagatacaaaatagtaaataaatatccctttcattacagataacttccaaatctttctgtagcacatatttgtataataagcatatgacctttggctttatcttctgcatgtgaatacatggatgtgcttcctctccacatattctgaaattaagtactattgcttcctggtatcttaaaccacttattccttttgaaattctctatgaaaggtatactatcctcttgatcacccagattcaaaaccacagattcttctgtgacttcattctcttgcttatagccaacatcaattttattttctcaacatctcctgtatccagttttttcccttttcattttcatatctagttcaagctactatcattttttttaaccctgctttcgaagcagtctttaagcctctactttttcatgctgtgagaacaatcttcttaaagctctcagtcacttcattcttctgctataaagcacgccagttccatgttctattgatttaagtacaactgttcgccctggaaatcaaggttatccacaatctaaccttgatctacccttccattctcatgtttctctccttttgtttgttgtttcgtatacatgcaattccccctttccttgtttttgcttatgctgtttttatccaaccatgatgtttttcccaccacatcaccctggaccaaactttttcaaatcccatcttataagctactttctccatctaataccttttaagtatccatttccttatctcccaaccaggtaagtctcttctcataacgattggtacttctcttgttatttatctgattcatgtattttattagcttttaaggcccttagagcagggcttgtcagttactcacttgcacaatgtctgccatagagaaaggctacaatgtatgtttatggaattaaatgagtaatttgtagtgcctaaggatagagcaatccattttgaaatttgtatcttctcagtttgttacagtcagactatgagatgtagcacggtaactaggtagcatgtctgatgagatcttcaaactttacagacataaatgtggtttttgtttttccatttaataaatttccttggattttgctctgatcctctcctctcgcttatttcattagagggtgttttaacgctgcgggcaaaacctccacctcctgatgaatttcttgactgtttccaaaagtttaaacacggatttaaccttctggtaagtgaaatttatgtatatagaattagaagaaataaatggaaaaggtgaaaatctagtcaggatgtttctgattaaattaagaaataaaattgtttttatagattttgtgggggtgtgtatgttttgatttgccttcagttaaaacagcaaattttaaaacatatatatctaagagacttgattgaaaaacaatgacttctattctcactctatccatgctaaagaatatattaaaactgaatctggtggtaaagaccgtcccctctgtgtctatgttggacctttctgagtgtctgtcttgcttgatagtaatctgttttctgttttcttcatgttgcaggccaaactgaagtctcatattcagaatcctagtgctgcagatttggttcactttttgtttactccattaaatatggtgagattttattagtttaagaaagaatcgttcttagtatattttttaaccccaagtgtctgtctggattatctagactgcttttcttcattaccttgcgtgggtactatttctttgccatttgtgtaaacatcaagaatgtaaaatttgagaatttaaaagaaccctgtaaatcatctagtttaagcaccttattttatagttgaggaaactggtatctctgacagtgctagggatatgaaaagaaataaagatttattggataccagtatttcaacgtatactagtatataatatccagtgccttgaataacgtagatgtttttctcattctcacaaaataatcatgagaagtctagttcttgatggatggtttgctccatgaagtcattcagagacccatgttctttttatcgaggtgttccttcatctcttgaactgtctctgacttgtttattcatttatgcactggttctacaaatacaaattgagagccttctatgtgcttggctttatagtagcccatcaggaacaaaacagacaaaaattcttaccttcttagaacttatattgtaacatagtggggtagccaataacctaaataaatgtctgcataatacagtagtctaaaaatcacgtgctatgcagaaaaatagaggagtgaaggaaaactgggagttccccagggggatgcacgcatgtgttctatgtgtgtgggaaacggagtgttgcactttttgagtagggttggttaaaggaagcctcactgagaagatgtcattggagtaaaggaagtaaggaatgggtcatgtggatccctgaaagaagagaattccagacgaagaatagttaacgtataaatgttctgaggtgataacatgcaaagcatgttcttggaataagtagagctgtgacttcaacagaatgaagaaaagattagaaagagatgatatcagcagggtaacaggaagacacatcctgttggtctttataagggattgggagacctttgacaactgaagagttttcagcagaaaaggattgccctggctataatgtttagaaattttggggaagaaaaagctagggtcattattaaaataatccagatgggggattatggtgcttggacctggtagcattggaggtgatgagaagtctgatttggttataaatttgctgctagattggatatactgtgcaagagccaaggatagctcccagatttttggcctaagactaacaggatggagtgatgattaactaagatggggaagactgggtagagcaggtttttggaggttggtgaaaaattcagttttaaacatatcaaaattgagttgaatccaaatggggaaatttgaattgatcgttgagtatatgaatttggagttcaatggagaaatcaagccaaggactgcttgagccctgggcattcgatgttaggagaatgggaagaaccagcaagtaagattgacaagaggcagtaagggaggataaatctcatccttctttccccagggataagtagacaagacctgaattagaatatgaaatgagtattgctttacaaacataggaaagtaagtaacattatcaacatgaatgtcagaagctaagcaataagggactagaagatgaaagtccaagagtacatcaataacttatgaatgctcctatatgttgttgctgtatatggagcatcagatttctacttgcctaattatttctgaataattcttgctctataaatgcttttaaaaaattaggtggagatcaaggacatacatatgcaaagaaactgatactagttcattaacaaaatttgtattccttagtttttaaatttttgatgctatcttagagtatttggaagtattatttataaagaagtttttgctgcctcctcttatttatttcacacactttcagagatcatatgtagatatctagtcattacacaggaatagagctgtaacataacaaggctggtttccctgacatatacaaattggtctttgtgatcaggttatgtacctgaaaacattggtttacttgccaatgtttagtatctctgcttttctcaaaaattacaccttattaatggtctctccaatcataatattttgctggtccatttaatgttctccctacagggccccggacattttacttggacgagggagatggggaggaacatctattcagggcctgctactggccagcatgatgtagtggctttacacctgcgagttgctctcctcttccctcagcatggacatgtacacacaagtgtagccacagcacatgtgcctgcgcacgttcttgagagggaaccatggctcttaacctttcatttatactttctttcattttatttcctcttccttctgttaaatcaggtatttttatattcctctactcattttcttttagttttacttttccctcttattgctacatatttattggaaatgcgttcgaggttggaagttaaaaattactgtgctagataggcagggtaggttttgttctcaaataagagttagctttcctccgttatctgccatcttttttcattcattccagtaccactgtatcatctgcagttgaaagtcagataagtcttagtccaactcctcaaggaggggaaactgaaaagccataaattacagtgtaatagtgtaatgtgttacgaatatgcataaattacagtgtaatagtgtagggtgttactaatatgcataaattacagtgtaatagtgtaatgtgttactaatatgcataaattgtttagaggacgcagggtggggagtggtacatcggagttacactgtggggttaacacaggctttcacaagagttgggacctgagtagagttctgaataatgggggaatggccttctggggaactgggaacagcatgtacaaatacacagaggcctagaacagtatagcatgctgagaacacctggatgattggagccattcaaaaaatctcctatcttcttgtgccgcatctctgagaaggtaagattttataaagagactctggtttctgctctaggagataactaccattttttttttagccagaaaatagctcataagaagtaaatttagagcagtttttgaacatctacttatcctcattttgcttatcagagaattgcacctgtttgtttctgctgtcattaaattatccatattaaatcaggggaattttctaaaaataattctggggaaaagtaccatagattcagagtaccagttctcattcctgttttgccttccttcctggatccttttattttttgtatgtgtgtataggcacagccatagtactgttaactctcgatagtattgtttctcttgatagtactcatttcggaaaccgcatttttcaagtttggcataatagatttgccagtagagaaacacatatttaaaacaacaacaacaaaacaggggtagtaaaatcacctgatctagaattctctgcatagcctttggtatcttccagagaaactatagtcatatgcagcccataggcagatgctgtgaaagttgttaaattgttaactttcatttaggttttaaagcactgctgggctgggcaagttgatttgacaagcttttcttcattcggtagcacattgcacagcatcaaaagttaatatgactattaaaaagtagtgcttgtttttgccatgggtttttgtccacacattttgaaaatacacaaagaatagtaatcttcttgctaaaaaatggtttattatcttaggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccaggtaagcatttaccacctataatgccttaagtaccattctttgttaattacatggatctaatgagacatttatttaaccttctacatacgaaggactaagcgtcataggatgaaaaaacctaaacccttaaaggctagaagtctagtggaagagatagaagtgtatgtaatataaggcatgatataccttaggagtgagtcataaacaaaatgctgttggttggcaagggggaccagtcaggaagaggatttagacaggagggtagttagctttcaaagaagagctgtcatttaaaatcgacaggtacacatagggttcacacacacatacacatgcgcgcgcgcgcgcacagtgcttgctagtccatgcactttacagaactactcttattatccctattttgcagatgaggaaagtaaggcacagagaggataagtaatttgcccaaggccacacaacttgtaagtgacagagcagggatgtgaactcgtgccatgtagctcctggagtcagtgttcatcattggtttgctaaactgccttttagcaggttgggtaggatttccacagttccatagtagggcaagggcctgtccaggtagagagagaagcagaagtgaaggcataaggtagtcaagagaagaaaggatgaagatgtgtttctctggaatatggacttcggggtagcagatcattgtggaagggcgggaggcggatggtattaaaatgagcatatagagatgagcatatagagatgagggctggattatgcaggctttcagtgccatgctaaagagttagagtgtggttctgtaggctgtggagaaccaataactttgtgaatagaggtgtgacataattacatctatgttttagaaaggtcagtctggtagttgaggctagaaaggacaaggacaaaagtaactggaggcagaggccttttgagatgctaatatcgtaggagaggctccttataaatcagttttcttcaggactagagagtcacagtggaactgaaaaggaagagtgggtaattttaagaaatgtgcatttgtcaataaagtgattatggaagacagattattaacaattgtagtactaatgcttgctgagcaaggcaaggtaagaaaatatttctaatttcatgattgtaaataaatcatttttgctttgcttatttatctaaatctttttctttatttcaccacttagaataaatcacttagtatggccacttagacatttgtcttcctaatgcttttgaatgggctagcttaagagtcatgggccaattcataattttttttctccatttttctcctattgaaacatatacaaacttttccacttattttctggactttgacagtggcttgtgttggaatatagttaagcagaaaattctttgaaagcattgcagttgttgcttttaaattgaaaatatttacatttatttatattatttatgtactagtatagcatagtgtatgctgtataatagtgttcttgttatactgtataaaaactggttaaatagatctttttatttttataattttaattgatacattattaatagttgtacatattttcagggtacatatgatagtttgatacattcgtataatgtacaaaggtgaaatcagggtaattaggatatccatcaccttaaatatcttaaatatttatgctaggaacatttgaatttttctcttctagctattttgaaatgtacaatagattagtgttaactatagtcactctactgatctatctaacactgggtcttagttcttctagtcaatgtacgtttgtatccattaatcaacttctctccatccccctgcaaccctgcctcatccttgtcagccactagtaaacaccagtctactctctaccttcatgaaatccagttttttagcttccacatatgagtgagcttatttcgcttaatggaataacctccagttccatccatgttgctgcaaatgacaagatttctttcatttttatggctgaataatattccattgtagatcacttaaatctattagatttatataggttatgattttatgataagcctcggtggcatcctttaatttcatgaagtttattaaattgatcaggtctcacattacaaatatagctcaggctctttaatttctttgtttagggttctatcttaaaataagaaaattaattaacattcaaaaaactacatcaaaacgaaatatattgttagctgttaacacacggaaagggtcattttagatcctgattgttaagnnnnnnnnnnnnnnnnnnnnnnnnnnnnnnnnnnnnnnnnaaatggctgatttccatcatagtagaactataacatgaagaattaaatatgaaagatgaagcaacatattctagcaaaaatgaagccctcgtttttgtcctagttatttttgtggttcatgaatgattaggatgcttacagaaataagtttcactcagtgtcattaaatgatgaacccatatgattgtgattacagattagtttactgattaaaacagagctgatacatttaatttataaaactggccatctgtttcagtttaggggacttcataaatttaaaaatcgtaatcttaacttgctgggctgtttctcttttgaaagatatatctaataccaggaggtttcaataatgatgggaggggagtgaagggaaagttgagaatctgaaactactttaaatgttagagaagtttgtgctctaaatacttatcacactcctagctccataatcccttcttacacaaatttttaaaaacctatatccatgttacaaagttgagtttaatggagaaatgaggcaatgttgggaaaacagatcatgcaacagaattcaatctttctttcattttattaaggtgtgaaatactggcataaacatgtttgctttttctttttgggtggatggaagacagattaggtctatgtgctgtttttgttgtttgttatttatgtgtgtgtgcgtgtgtatgtctagccttactgaagataactgtgagcgtggatacattcctagattttattgtttatatgccttcattccctcctgcagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagaggtagttttttttttaacattgccctctgtagacagtgtaattatctgtgtattctcttgtaattctgattgcaagttctcattttattcaactgaaaattgttctagaatcaaagtctgaatgttaccctgtcctgaattacctctctctcttgcctctgtcattttttgtgacagttgctctgttcctccgtgaagcccaaccccaacccaaattgctctcctatagcctgtcagcccccacccctccccttgttgccactgttttcctggctctggcgatcctaagtcagcttttttaggatgactttctctccttgtcagggaattgcactactgccctttggcttatttctttatgttttcctctcccattatcaggccctcaagacagttccctgaacctagatcctctaacctgtcttaagcagctgtttcctgaattcccccagttaattaatttctctccttctcttcacgttgctttgcctctcttctcctctgtttgttttctttcttcccttttgcctagttctaaaactctggagtcctatcagccttgctagagggcccaagttcttctgcactctagtccttaggctcaaatgatcatttataaaactacaccttgaggagatcttaacattcattttatcttttaagtatttaataatatttagagtataacctatttgggaatcaagttgagggaatgaaattgagtatgctgttttgtcacattccctaaaagtgatgtttctatgactcttcttgtttgttggaaaagaacattgaacattgattaaagctggaccaaacacaaataggatgatcagaacccgaagagttaggtgaatgagatctagtttgaagaagaaacagtaaatgatgactagatcttcccgaaatcctattatttttatttaattccttagattaattttctcagactatcataggtatttataatgtggcaaatatgttatgagggaatgaattgtcaaaccatggtgtattatatcctgtgactgcttttaaggggaaatgtttatctaaattaaattttaaaaattgttccctttgtggactattctttggacaataaaaataatattatagaagtttggttgaattcctgaaactttaaaaataaagcaaacatattactttgaaattattttttcctaatgcaatttttttttccctctggctgtattataagggaagaggtggattccatgcctgtctttccctctaaatgaataattaagatgacctcactgctcggttggcaagcatatacccctgcctgtatttcatagttcaggcctcatcactgtgaattttctttccatttaaagggtagtttttctagaggaaagaaaatataatcaaacatgaaattatgatacacttgctgttgctatagttacagctgactatttttacatcataaaaatttctagcttatagccttcataccttaaataagaaaatatactcactttataatgtatgcctcagaaattcacttttgtgatttcgttctcaatttgtgtatttaagaagagagtaatgtgttctgggctcccaggatataagtttgtctactttcactgaataattaattttaaaagaggaattattgagaatccttacttgtaatgagttattattttcctgttataaactatatttcattttatggctgaagtagttattcagaggtttaaaaaaatgaaaaacacattctagcagttccagggaattttatgccttgagattttgttggaaaagaggccaagtaattgtgacttaaaaagcaaaaaaacgtaatcatccctaaaagagatactttattatactttattgctactataataaatgcatttacaacaagacttgggtaattcaggatctgatgatttttgtttaggattgaaagacataggtgactttgagtgacaaatatgggtggcagtactcagcttccttacttcctctgaaccctaagcaaactttggtagtcatcacagttagtcttttgtcatcatttctcttctccctttcagtattcgcagttgctctcaggacccagtgatttcatactgctgacttcactgttatgttcagagctgggcaaaaggtgtgggtgcttccaacagttagagcactcccctctttagaacagcctttaattaaagattacctaatctaatgtagtgcctctactctttcccagggaaatgataaactgaattaattgagctcagatttttttaatttaaatggctgaaacttgtttatttttatttatgtattaattacagtatcctgataatgtcacctgctttgtccatggataaactcagccctcctcctgatcactttgtcattagaattaactgtggtaaccatatgtccaagaattttctgaaacattcccagtttcaatattttgccccaatgaatccataaacaaatatacaaaatccataatgaaaacagccaaggaattccagtgcttcagtgtctatcatgctttctccatacctcattttcatataaagaaacaaagtaaaggctttggggagtttttatttgttttctcccaatctgagcatgtattctctatagcaggggtccccagttcctgggtcgtggaccagtactagtgcgtggcctgttggaaactgtgcctcactgcaggaggtgagcagcaggcctgcgagcattactgcctgagctccatctcctgtcagatgagctgcgcctttagattctattaggaggaagaatgctcttgtgaactgcacatgcaagggatctaggttgcacgcttcttatgagaatctaatgcctgatgatctgaggaggaacagtttcatcccaaaaccatccccatcatccccggccctggggtccatggaaaaattgccttccatgaaaccagtcctgctgccaaaaaggttggggattgctgctctatagctttaaaactgtggtcctcagtgggacctatgaacctcaactgtcactcttggtagctcccagtagtctcctgtctgaattatcttaactgcaaaagagaagtgactctagcattctcttatcctggactcttgactgtcaagatcagtttagttgtgcctttctgtgtttcccttaacagtaaatatgataatagtgctgctattttaaaaatattgaaaatactataatgttctgtgtataattttgaaattgagaaaaatgagaagccggtataattttaatgcatagggttcagttgattttcatgtgacaatatttactttgctagagtggtgaaagtttcttgaacagagagagcaagattaccctttgcactaatgacttttcttattataagtaagtatttgacaaaaatgtgtcactcccatttgataatgtgttaacataatggtcagtcacttgaaaatgaaaacttatcacaatatagttgagagatcttgttgactgacctgagtgctgattcaaatagtatttggtgattctttaatctgccccactttgtctttcagcattccagtgtatcagagtatcatccagccgatggctatgcgttcagtagcaacatttacacaagaggatcccacctggaccaaggggaagctgctgttgcttttaagccaacttctaatcgccatatagataggtaacatttaatgggcaccctttggagagctgtggataaatgtctctgatctagtgctaacagaggtgacagtgtctgtattgtctactgcttctttaaactttccatctgttaattagttgataaagtttcagttgttcctttagagaactggttttgatcaacaaaagatgtctggaccttcagtctgtaattcccatttagtgcaaatgcctttggatgactttccattttttaaaagatacttctgacaaaatgtgtacattaagaagaaagaattgtcttgaaaccctccattagtttgtaccagatggtctctgaggatccttccagttcctgtagcttttaaagaaaacagtttccatctttatcttcacccaatgaaaacaaataaaccttcctttagacagatatatttaaactgaatataaactaaatatttaaacagggtcaatgctttattagtcattcttgccatttcatcctttttatcttgactttccagttttacatttcatttatttttctatatcttcactcttaaaaaatttaatataggcagagatggagaattgggatgagaagaaataaaggaactggaataagttctttttttttaatttccaatcttgtttttagtaaatgagatctacatagagccaagccatgtagaaaagagaaaaggaggtaaaatcttggtaacacggttataggagaagggtcattcagtgaactgggaatagagaactcggcctagtactttcctgcctcaaaagcctctcttaccacaagagttatatgccctttacttcttttctgtatactcttttcttaatataatctgaagaaagtgggatttaaaatttttattctttgtcaggggtggtgacaggtaatgcttaagtaattgctgtagaaattacacaggtataactccaagggcaccagtgacattaaattgagtacaaagaaaagtcagcaatgaataatatattttttaaatgccaacatatgagaatgttttaattacataattaattttcagtagatacagttgaaaatcagttttgaagcttaaacattatttcattgaaatccttaactaagtattcatcttaatattttcttttttctttctgtctgtcttagatgtcaatattttagaaatcatttcagattaataggtttctttttgttttatcactccagtaattcagatgattttccacagctaagtagctagaaaaccacttgagtacatatgtagagtacatattgacactagaaaacttttatcaggttccatttgaagaccacatttagcatactgtggtcactcagtaagtgtagatttatttgattgatggattggatgaataagtgcatgagagtatatctagtatttcagagtcactacttccctgtccttcacctgcatatctataagggatagtattactgatggaataacctctgccatttattttgggcaccttaccacagagtcttttaaaagcttaccttgatttttatgatctttatagaatatcagggcagtatacctttcatttattgatttagttatatctttgtaccccttctgcttccaaaatagattcagttagctcacttaaattatatgtagttaaagtggtattattattgaaagtgaaataatgaaataaaatataaaattaagaagagggaagatgagaatttttataaaatataaaagttgacactattattgaatttcagatttgtctttcagatttttggctgtcagcaacaaaaagagaaacataatcattggctgacattaggaaaaggaataagtatcagttcatcgggataaaaaatgcttttcttactcctaaattctcaataatatttgtttcatgaaacttaatgtaggatgggataggtgatgtcagggacatttatttttaacaattttttttcctcaccacagagaaggctgtggtgaattttataaggtttctttttgtaacctttgataaatagaaatttaaataaaatataaaaatagaaattccatgaagggataatagtctagagtggtcagaatttcaccatagaaagaatttttttgaataccttgagtggtgggtagattttatatctcagttgttcttatggattctgtctcagctggacttaataggagctaggatagttgataaatacatgaatcattgatgttctatgttgctaagaacatttgtcatcattttgaaaaactgtctgaaaattgtggtctgatataaaatacacagaggtttggaatttgtttttataaataattattgttgaccttaaactctattacataccaggaatgcagtagatactgttaaaagaaaaacttcacacaaattaaatttaacagttttttttttttttttgagacagagtcttgctctgtcgcccaggctggagtgcagtggcgcgatcttggctcactgcaagctcggcctcccgggttcacgccattctcctgcctcaacctcctgagtagctgggactacaggtgcccgccaccatgcccggctaattttttgtatgtttttttagtagagatggggtttcaccgtgttagccaggatggtctcgatctcctgacctcgtgatctgcccgcttcggcctcccaaagtgctgggattacaggcgtgagccaccacgcctggcaaatttaacagtttaattgaacaaggggaaaaaaaagtggcacatgaattgggcagcccccagaatcacagcagattcagagagactccagagatgcctcatggtcagagcaaatttatagacaaaaaaaggaaagtgacgtacagaaaacggacgtgaggtatagaaacagctggattggttacagcttggcatttgcacacaacttgaacagtcagcagcctgtgagtgcttgaagtatggctgctgggattggctgagactcagctattgttacagaagcatactcctaaattgggttttcaatgtgtctacctactaaattaggttatgattcgtccacaggactcaagtatggaagtatagagggtttctcagaacatatttagcttaacaatgccatacgaagtatattcactgttctgtgaaattgctatgccattaggtagaacatttgttgaatttagagcccacgccttcgagttttatagcttactgctgtcagatgcaattagtattttagagaagttctcaaattactgctgtctctatgtctgctctctatcaagtggcgtatctattattcctaatcagaaactgagcccatacgttttgttacattccatagctgttaagaaactttggtacctctttttttttttttttttttccgagacagagttttgctcttgtcgcccaggctggagtgcaacggcacgatatcggcctactgcatcctctgcctccctgtttcaagcgattctgccacctcagcctcctgagtagctgggattacaggcatgtgccaccgtgcccagctaattttgtatttttagtagagatggggtttcacgatattggacaggctggtctcaaactcctgacctcaggtgatccgccctcctcggcctcccaaagtgctaggattacgggcatgaaccaccacgcctggccaagaaagtctggcatctctgaaaaattacaaattgtgattgtctgtttgataactatggtcagtgtcatatccatgcttaacatatagagggcaaaaaactgtgagccataaagatttgtaaattctgaagcacttcaggtaaacacttctgagacctgcaagataacaaaaactttgttatagacccttaactctccattattaatagtgattatcttgcagatcataggagaaaggaaaataggggaagagaggaagataaaacactaaaattactgttttcctaatgtttggggtagttgaatctcttttatctgccaaatgaaatcttagtagattaaatgtgaatatataaagtaaatgaaagcagagctattccagtagggatagggatgggaaatccatggaacacagttttaaaattattattattaataacataattacttcaccataatttcaccttttccaccaattttctttttaatgtgctaaaaatagccaataagctgttcgtacatgcttatctgtaaggtgttctatactggtcatctttttgctttgtccctgtctccctcctccaatggagttactacctaagaggtaacaaaaacctatgacaggatacattatgtctacaactgtcctgcaggccctggtataacattccagagaacttggtagacagcaaaaagaatggcaactttacaggggtaggatgacctaacatctttagtctctacctgctatttcccttgtagagatgtgtaaataaatgtgggaatgtaaatggaggagaagactagggagtaaaattaataaagggttaaagtaattttattattgaaatatatgaagaaaatacaaatatttaatgcatcaagtgtattatgttacatataaaagtaatctttagttaagttgttaaatctattagtactcatttaatgattagaagaggtatttggttttttaaggaagttttattttaaaaaaatgaggcccatacactttttaaaagtttatagtgaattaaattatttacttacttatttgcaagtgttactagtctcatacttaatgcatatctcttttttttgcaatttagataactgggcaaagtgtttctaaaaactaatgcctagttataaattttaaatttatatatttggttactgaattgcagacattgcttgaattagtgaaatcaacatataactaaaattaccactatggaaattatcttcagtctcctttaactttatgaaaaatactaacatttatctttatctagttcttttatggtagagatggtaattaacataatatccagtatgtgtatttagtagacaaagaattcatagacttggattctggatttggctaagtaccacctggccttgtgattttgcattatttgtttttatccctggccataatttgttcattttaaaagcaagaactttaaagtaacttttatttatcataatgtaaaatataataaaatgaaactgctgtaatttttcagaaagttttctggtaggatttggcttgtctcagtgttttccatttttatcctttaggaagagctagcagaataataatcttttttctttctttttatagaaattatgaaccactcaaaacacaacccaagaaatatgccaaatccaagtatgactttgtagcaaggaacaacagtgagctctcggttctaaaggatgatattttagaggtaatataattttttcttttttatactcttaataaagtagttttattgtattactcttttggtatataactaaactttccttcaaaagtattatattactaannnnnnnnnnnnnnnnnnnntgggtttttttttaacttcctttgctctcttccttgccctctttcttcttctgatatttattcattttggagtcaagactagttaacaattcagatgtggatgcacataatagttcaataagagacaacattttctttttttaatcctatatccttgcacagatatactcagcagtcattgagctaataatgttagggataatccaccacaacaccaacttctctttgttagattctaattgacagttcatcttcttgaatatataaggtgaattatcacaataaattttgtaaggaaaaaaagtaatttttatatactttttctttctatcaccaaaatggagacaatggggctttccaaaagagtcattttagtccttaagtcctttaagtactttagtccttaagtacttcaaataatgcaggctgttctttggaggtaaaatggaccttgggtagattcaccataatgataccttacctactgtatactcataaatgtcttcttagtgtaattcctgagaatcattcaatcaacactatgttgatgctgagttaattatcagaagtagaaaaattttctttgttgaagtctagggaacttctttcgtagaatggcttttatatggaaattatacctttattttcttgtacatgacagatacttgatgatcggaagcaatggtggaaagttcgaaatgcaagtggagactctggatttgtgccaaataacattttggatattgtgagacctccagaatctggattggggcgtgctgatccaccttatactcatactatacaggtgagcatgatttcttagtaaaatgtagtatgtacacatttacgaagttatcactcttaagtaggatttaaacacctttgtgtattgatcattttgagatgtagttggttatatattttttctagagtaattggtgggggagtggcaatggtgagagacacagggaagaattacacatatgttttctgatttacttctagaaattgttcaagatgtttagcagtaggtacctgattctctgaatgctttttttccccaatctgtagtatttctgacatttgaagaaatggtatttctgtctttttacccacagctctgctatccaccaggggcttcctcttgatagaggatggcactgatatcacggcatggtgtccagcagttcaccttcaccagcccttgctttcagtctcttaaatgttctgccactgaccagccttgaacttgcactcatctcaccttacactaatacatgagtacctgttcacctggattacaatatttttcctctcttgattttaagattaaaaggtacttaggatatagattagataggtcaggctctctcttcttgttcattgaaggcccatgaaggtccattcttatggcccatgccacattttcaggatttcagtgaccctggtcagctcattcaccctaacatctgaattaacttgctcttaaactccggaattttagacctgtgccaggctctctagagttaggtctgtaaacaaagacagaatggatggactctctcaggtacagccagtgaacctggggtggcttctcattcccccagaaagaactcttttaattttcaaagtctcgagaaaaagatcacatctgacctcataataatgtcatgaatttgagtagaagctgcgtagaatatgcagtgaaatagttaatttttatgccagatctaggcttaaaaaaatacagattgtccaaagctggaattgtggtcatacttctgctgccgtgacaatttatttcagtacttttggctcctcatgacattcatgcctggtgtcagtcctgtgcttatccagagggacttggccttactagaatccatgaatcaagcaaacattcaaaataaagaatttgtgtatagtttctctatctcggtaacttaaagtgatggcaatggaaattatttgctgtgttatgttttggctggcctcatgtgcatatatatattatgtacttattttatgttcatcatttgtcattagctgttgatgccaaagaaggagtttgagttattcaaggtatggtctcctccatttcccatgggtttttgaagtgaattttcttagtttttatacctttttcttttcttagttcctacttttctgagtttaatatctgtttacctaatataatatatgcttctgtctggttcatgaataccagttcttcattttctttcccatagaggtagtatatgcttgaaacctatacttaaaataatggtagagtacatacctttgggctatatcaactaattttaatatgcaggtcatggtaagctatgagaagcactattcataaaggatatccctgatccccatatgtgagcaaaaggcaagagtttatattttaagttttgaaaacaattatccaaatttgttttatttgtgtgtgtggttgctaggaataagcaaactgcgataaaataaaaaacatgcaaatagtatgaattctataataggaattttctcctgcctgatattcctgaaaagtttaatatctcttaccttttgctgtttactgttcagtcttgtctttttctttaattctgattcttggcttgagccataagttgacttttctgtttaaaaggttgcttctgtctaaaactgaaccaaaactattaatatatatcatacgcagggaaagtattttcagagaatgtcaaacctattcctcctttcttaaacagaacctcatcttttatttttgtcaactttggcacaacccaagaaatgtttttaagagttcacaagtttcaggagtttgttttgctactttatgtaaatagaaacttgtggttcttatagggattgcctatttggctatttcgttttaaacttttcaacactatcctactctcttcttaaaaattcgggttgcaactacaaatgtagtggtgtgtgtagaaatgtgtacagaagctttctgtgtgtatgcagaagcgtatgctgttcaggttgagggccctactttgaaaatgtattaaaaacaatctgctttttaacacctcctgaaaattttgggctgagctcaacaaaaccactaagaccttgtaaaattttaataagcaagcttcacagtctgctttgctatctgctatctggcataaatcctactctaaaaggattcctattctcaaaacatttataatatattctttaaaaaaagaatagagtaaaatggaaaagaaaacatccttggaaatatgtgccagtcatttttctatctctacaacagtagatacccatatctactgtttcatatctctacaacagtagatacccatatctactgttttatatctctacaacaccagatacccatatctaaaatatctaaggaagaatcctgcaacttatttcagaatgataattaagataccacccatatttatgtagattccactgatcctaataccctaaccttataaaactcaactggattacaattttatgtcttactcatctttttattcactcattccacaaatacatattgagtactggcatctcacacacttggtaaaaagaacaatagaaagcctagcgccgagcagatccttcccgaaagcctgcatgagtccacaggtcatctgccatggctttgctccttcctgcatgcttgctgtatcaagagcagcgtgaccctctttctcctcctcagatatggcccacacatttgttttctcttccatctgtctctttcatccagtgatatcaaaactttgaagaaatataaagaaactttaacaaaaatattttagattcctgcaccatgctgccaaaaggaagcaatgattcattacttaaatttgcttcacattcacagaaaacaacattcacagatactcctctctagagaagatatgcccgtggccagtgctcatgctgtgccaggcattgtttgagcacttcgcaaatccaaattcatttgattcccacaacaaccttgtgaaggaggcacattttttttgtaggaaactaaggtgtaggagaaataatttgcccagatttatacagctgtatgaagccaggattgggccccagcactctggatccagagcctgtgctgtgttgcattctgctgttctagagaatagtgattataaaaggttctcatttcgggtgggcacaatggctcacgcctgtaatcccagaactttgggaggccgaggcaggcagatcacttgaggtgaggagtttgagaccagcctggccaacatggcaaaaccctgtctctactaaaagtacaaaaattacccaggcatgatggcacacacctgtaatcccagctactcaggagactgaggcaggagaatcgcttgaacccaggaggcaggggatgcggtgagccgagattgtgccactgcactccagcctggcgacagagcgagactccgtctcaaaacaagaagaaaaagaagaaaaaacaaagattgtcatctctttttgtataaacccatagtttttctctgtattaatgtttaaagtgatattttctcagaatagctttactttgcattatactgtgataaaagttgatctgatcagtcacaatccttggaatttgatttttgctttatgtatccattcactggatttcatggtattgttcattattttataatttaggaaaataacccaaattatatgatttacttagaataggacatttttgtaagtggtggaaataagggaattagatgtaaactatttccatgcaacatctgtgagtcaccaaatacttaaaaaaagggacagtcatgactcttatttttatacccttacatttcctataaagacatatatataaataatggtagtttctgggtgaagggcacaagtgcagctcttgcctattgttcacacactttttatcagagattctgttctgatgacagggatgctcataccaggcagtgaataggtgttgaattgccacctggtgtccctgagagtctaggctatttaatatcctcacatttgaagtgatttttaacagctctgtaaagacaaccattcccacctaatgtatttcccccatggcttcagcaaagttttaaacataaaagagaaagtaataaaaatttacaaaagatattgacacaaaagattgaataaaccacagagaaaaggaagtaaatgctgaggagagattatggagagataacatgtcttgataaaaatgttgtagagcattccaaggctttgtagtattttagctgggcagcagatggacatccagggtgctttctccccacctggaagctacttgccacataaagtttcctgatctttattttgacttgattctctgacctctagccctgtgactgctcgtctgctagaattacccttttgcccatttaaatttgcaaggtatatgccaagagcagaaaccacctcctcccgtgatgttatttattatatatccaatggactgactaaagaagtctttcatatattcttaattattatctatgcgtttattattgttataggtattcttactctaccaagatgcaagtaattatgaatgtccagtctctgtggtcacgtgaattcaacaaaacgtttcccatattctttattgtctagcaagagatactgtaatatgatactgtgtgaaaagccccaatctaggtattggtaggtgagggttctagtccttaaagagagcattttatttttctgtgttccaatttgcttggtcatgaaatagaaggagtcagttatgtgatctctacaatccagtctaggtataaaatcttctcattcattatatacatgtttaaatcaccctaaaataaaagtggaaatgttttgtacaggtgactactaaaccgctaacactactaatttcagcctatgttattagtgctctgttttttaagctcagtacagacatttagctactgctggatagagtgacgattttaccaaagatggcttatattcttccagccaggccaacctcctgataatattcagttcttcaaaagtgttttttaaaaattaatatcagaagactctgctcattaattataggcatggtttttagacaaagatgtttactttttattctgtcacatgtattgacattttcccagagacttcttaatgataatttgaataatacccactataaatatatatatgtgtttttatacatatataaagtattgataattactgtctgacatgcacatgtacataattttattaaatgttctatgttcaggctgcttagaaagtttgaaactaaagctcattacaatcacacgataatgcatgcagtattaccttctgtaaaatcagctaattaaacaagaataactcttacatgtaatgcattctaattgtattctttatgagcaataggaataaaataaacctatatcttagtattttacttgaatatacaaatagttactgttgaagtactttacacggtttctactatagtagaatctatatgattagttttccatggctagatagtgatgggaattaattatagatttacaggctccttcactggttgattgtgggcatgtaattttactgtcaggctaatttactctttctgatatttgatgtgaattataattgatattattttaattccatttcctgtattaattttctcatttgatgtgatttgctccattttcctaatagcaattacttggcgagctgtcagaggtaacccacattcgttccctcatggcacttctttttaatataattttttggattcagtctctcaacttaacaccctccaaatgttccagctgtgcttagttttcactgcagagttcccaaataaccaaatttagaggaaaaatgtgtaatttagagtaggttaaatatttaagaacagttcaattttaatggctttgttgcgcttacttgcataatttcccctctgaagcagcatcttgtatgaatcaggatcttatctctcaatagcattctttaattctttagaatttctactcagcttaagttgctaaagaaaagtgactcattccaacttaattatcaataggaaagtaaatttcctatgaggtctattaattctgccttctttcagagaaagagagacaaaaagatagattttgcttttaacagaactttgtgtttgtgggctatcacaggcaagagtaaggaagtgacagttgggtgcaaaagtaggtccacaccaggctgaccaaccctcccagttcccagctggggagtctgaggggtttgtgaagatgtggaactttcagtgctaattactgggaaagtctcaggccaaccaagaacagttagtcagaatttcttttttggatttggagcttcagtacgttggttcaggagaaaaaagttcagagtgcacttctgttctccaagacattacgtaaactgagatacgttggaatcattaactctgtagcttcaacaaaaaatagccaaaagacagacataaggaaaggaagaacagtagttgggtgttaggtaaagaggagtagagaagctagggagggagacagaaaagtgacgttaggagtcagtgctgattctttttcttccacatgaagaatttcaaaccagtttccatggaagagctgtctaggttgccattcagaaccagttgtcacgattcaaggaaggtactttgccccttttaatgtcagaggttggaaacatggggcaggaggagaggactaaggaaagaggaaaatatgcaagtaaatataatttatggcatacattttcatatgggtttctttaatcaaatatgtattttaaacctattattttggtaggtcatactgataaagttgcattatgtaacaatggcatgaatgaaataaagcacagaacatttggtgagtttgttttcaggcttgattgtgacagtaacacagtttattcactttctcacaatagtatttgatgaatagcaaaagcaaaaattatgaatcatatggaaagcagggctcatggcatttttgtttgtttaggctttaaaaacaataattgaaactatgatgcttttgaaacactaatgtgagaattcatttgcccttcatgaaattacgtgcagaggacattcttgtcaagggaacattgcatatacattaatcagatgactttggtgtgtgctaagtattacattctggtgatgtttgctgtattttgactgctttaagtattttattggcccaaatataggaagattgtttgtggggaataataataacaattcattctttcattctaatacagtattgaatacattaaaaatatttctaagccttgaatgctaaggggattagcaactcagtttctgtcccacctaactccttctcttactctgagaatcttaccctttactccctccttccctcctgtcctgcctctctcctccttgccctccttcttccctcagcatctaccagcattataaacactcctttcagatatacttccatcctttcataatacgcttcccacttccttgaccccatcccactggtcagtgagtagtagagcgagctgaaaagaatgagggctccttcccacaccggtttccacaggtgttagtcatttgccgtgaaggggactgatgaaggttgatgtgttgtttttgagtaatagtttaattaaaaagtgatgtgtctgtgtgtggtgtgtatttttgtttttgatctctgtggaaattgggaggactctgttaaaatcaatactacctgatatttgggccattttagaatttaaaagtaaatactgttctaatcaaaggaccagattaccaaaaggtctttttgcatgtaatatgctaatcctaaattagaataattaaaattgtgccagtgcagtatctaaactttgccttaattacaaataattgtcctgtatctttgattctaaaaagaaaatgtgccttttgagaatttggagactctcacaatgcattatctattaaaattattttacttagatttaaagtgttaactattatgtgtgttttaaatagggaatatgcacaaatgctgttttataagtatgcctaacaatcatgattttaaaattattaaaaagcattttgtcacacctaccttttttaatacaaatggccacaggtccctttctagtattcgtttgtgagttgcaatcataaacatttaaagaccataccattaccctcacaaccatccaccccgtgacatttccattttaacaagggaaatttctaattttaataaattagcattaagatgatggcagaaaaagttatgccttgaacaaaataataccaatattttaaaattatttattggaaacaaaattaaaaatctttgaatatagcgtacatttaaaatgagtaagtgatgctttatgctgttgacatttagacttccagtgcaattggaaattattattagcataaattaaaaaataattataaatctttctgcctcccctcatcttgtgtgattccaagcccaaattctgttttcttgacatttattactataatactactatttgctattgacgtagccttgtgactccttaactaatgttttgactttgaacaaattatgtagaatgtttaaaatatgatttttaatggtcattataccatataggattacagataaatgagtaatgggtttgcaagtaagtttaaaaatagccaacaatgtcctatcaaagtataatttgttttcctagcctaggtttatattttttaaattttaagttaattatttgtctttttatagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgtaagtttcccagggaggcaaaaaatgtcttctgcaaattaaaagcactactaagtaaaatattgtttactgctgattctacttgtattaaagtcctttatacttgcatggtacttaatagattgcaaagattttcacctggtttctcatcagctacgtagttctgagaaacaggaagtattctctccactctctaatgcatgcctttctactccttttccaatctgttatgataattgaatgcagactctggagccagacatcctggaatttgtataccaaaacaacacttgccagcttcctgaccttcaatgatttaattatcctctcagcacttcaatatctaaaaagtggagaaaaataatagtatctgcttcataggataagtgtgaggatttaatgagataatgcatagaaagcatctactccagtgcttctcagccaggagcgattttgtcttcttctccatccttctgaggacatttgatattgcctgaagacatttttggttgtcaaaactggggggatgctactgatgtctaatgggtagagaccagggacacttagcaacaattacaatgcacaggacagtccccagcaacagagttatctggcccaaaatatcaatggtgctgaggttgaaaacccctgactgattttgacccctgtatgacacgtaatatgcagtcactaactacatcctgctgtcgccatcatcatcatcatcataaccttcctacttctcttcctcttgtttgctattcacagtagctgcacaatcacactatgttaatataatcacctgccaatagtagtctcagatttagcctccaaattcaaatttcatgtgacttacacttcagtgccatattttcataacttgaaatttgatgtttcatataaatggtttctatgaaaaccatatttaagtaaactaaaaagacactatgaccaactttggattatccttatttgtattattggtgaatagcagtgtagatattttgaaaactgaaggtagttttaagataaattttgtttaaccttgtagtatatggcatgtcaatttaatctccaaatttggtgttttaaacgtattataaagttacttggctttacctatacttgatgtgtaaaaactcttggaaaaccagagctatgaagatatttcatatttccccaatatgacaaaagtatatgaagtgtgtgtgtgtatgtgtgtgtgtgtgtgtgtgtgtgtgagtgagagagagatagagagacagagagagagagatggatatctatctttccctcaatgtgggcctctcttagggttctgccttcgttttccacataaacatacttttactgtagttcattctatttccatttctttcaatactatttatattgttgggaaaagaatgattcccaaattagtcatcgtattaaaactcatctctgacatccagataccagtatggaactattaactttatagctgagattggatgctttctatttatgttcaaaactaaatggctgaatctttcactcccattttcatcctactgtttttctcacgtcagtaagttattgccacatctgttcagttgtggacattcttgataaaataaaaaataaaaaagacactaaaactattactatttaacaattctaaaaattctggttaaatgcaataagcataagcctacttttactcattaatttttctcccacggtatgtccaatttaaatgactgtcatatctatcttgccaggaaactaaaggaaaaatgaagttttggaaaagtgattagctctttctgtacagcaaaaacaactgtgtgcgtgagtgtgtagaaccataataaaatagaatatgctactaagtttttaaaattatgtggagtttttaaaaagagttttctttttcaaatacactaaagacatagttttaagatgagaaatttctataaatatttttattgagttccctaaggagaaaacttcctcttagaaatgactgttctcttctttattcttcccacaagtttatagcatttccctccgtagagacgtcagcacagtcatctttgacacggtgggactctttatccaggcctagctaggatcaaagttcatcggcctccagtccccatttggagcagtgtgtgggttaggacagtctgttctttgttcacgctgagaaaccaagaataacctagtgggaaagaggcatagtttgcatacttttaaagatagagaactctcctgataattgtgactcatcatgttgaagtctgtttttcataagtaaaagggtggcattggtgtataaaatataaacatctctcccaaaattaacacacatacttgtttccttagaatattaaaaatcttacaatatatttgcaacttatgtaagttcctttttaaaatatctcaaaaatacagtttggcattaaataaatatatttctttttataaaacaaatatttcttgataactttattgcagaacagtttttctctgaatgaatgttggggcttaatgttcttttagaaccagacagtagcacatatttcagtgtgtgtttattgatagccaaatttctctcaaaatatgcctactcatctacccacattctctgcttactgcctaaacttctggtaaaaataaaatgaaaggaactaggaagtaaatactcatagaaatctatcaagtagcagctatgaacaggggaaaaaagccaacatgcctgtttttacaacgtagcaagtggcaagagtgaagcccttttgtggaagtctgtgtgttgcctattcaaaataactgtgaagccttgtgtcatagaagctattcaggctgttttatcgcaggatcccaaaaggttctccttttatcgcttttaagatgccaaactttagttgctttgtatttctcccatttcctttgaaatggtagtccttttattcgaatttaatcttttgtaatcagagtgttactttagaaaggtgtaaagttattctggtttgctgttgtgtgttagaacattggaaatggaaagcaaaagcccaggaacatgttaggtggaggtttttttgtccttcctggaagaaaactatgctgtggactggtgatgattgatatactggctaagtcagcagatgagaaaccaaatcttttagtgtggtgatacattttattttttattcttttgagatgcactcatatgctgtttgacagtttgttgtagtgattttttaaaaggtagctaatgaaatgcacataatgtatacttaaatgtaacaatcaatagtattctctcttactctctctagcacccccttactcctccctccctccctccctccccttttccccttttttgattacttcaaaagatttcctagatacttgaggcattaaaaaaaattagactgaaataacactaactattcacactttcccttatttcccaggggcaccaaacactttctaaaaccctttccctaggggggaaaaatcatagaacattggtcacaaaaagctccctaagtgaccaggttattgtcacttgccaacttaattagattgttcttatttcttgaaagtgaaaacaaacaacgaacataatgtacctatgtatatatacacacatattttaaaatacacagacacatgattccccttcctgtacttttatgcctttcctatttttgtcatgacagtatgttcatatacacacacatcttttccattagcataaatggctaggaaaaaggagtagctagggaagttaatcaaaggtgattttaatgactttggctataaaacagccctctgctgaaagtcagaagatccagttctagctaaattattctactaattgaaatgtgactttgacagatcatttctctgtttttggccttcattttcttatctggttatgtaaggggtttgtacatgatgattctcaaagtctcggtgaaaaagtcagcagaatgcctcattcattcatttattcaacaagtatttattgaattaaagcaccgttccacgtattaggatatagatgcaagcaaaaaagggaagcatcctttttctcctcaggcttatattttaatgaaaggaggtaggttaaaaaacgattaagttggctgggcgcggtggctcatgcctgtaatcccagcactttgggaggccaaggtgggtggatcacgaggtcaggagattgagaccatcctggccaacagggtgaaaccccatctctactaaaaatacaaaaattagttgggcatgggcacggtggcacacgcctatagtcccagctactccataggctgaggcaggagaatcgcttgaacccgggaggcggaggttgcagtgagccaagattgtgccactgcactccagtatggcaacagagtgagactctttctcaaaaaaaaaaagatgatagacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggaggagtaagctatgtggagatgcgggggaaagcattccagacagagcagactagagtggcctttaaatttgaagagcaccaagggagccattgggagcaagagtgaagggctccagaagagttgtggagtggctttagagtggtggaggtcttgtagggccttttactgggagtaattaggatcacttgggaatgttttgagcagaggggctgcaacatctgacttgcattttttttttttttttttttttgagacggagtcttgctctgttgccaggctggaatacagtggcgctatcttggcacactgcaacctccgcctcctgggttcaagcgattctcctgcctcagcctcccgagtagctggggccacaggcacatgccaccacgcccagctaatttttgtatttttagtagagactgggtttcaccatgttggccaggatggtctcgatttcttgaccttgtgatccgcctgcctcagcctcccaaagtgcttggattacaggcatgagccacctagcctgacttacattttaaaagaatcacttagttgttatactgagaagagaatgaagagaaatgggtagggtggtagggagtggaagcagagagatctgttaataggctggtaactcagaccaagctggcaacagaaaaaatacagtgaaatcattggattttggatacattatgaggtcagactaacaggatctgctgatggattggatgtagtataggacaggaatcaagtgcagctccgtggtattttgccagaactggaaagatagaattgtcattaagtgagttgagaagtctaaaaagcaagtctaagagttcataaaagcaagcttcaggaagaagatcgggaattcaggtttgggcatgctatatttgacatgcatttgagctatttaacaaatacccaaatgaatatatcaagtagacagcatatatgcacccaagttccgagtaagaggactggaaaaataatttggtaaccatcatcttttaaatggccatgaacctaagcacagtggtcattgatggaggtagtgctggcagagatgagtctcaggagtgtcccctagagcaccttaatattacttagttggagagatgagaatattcagaagaggatccagagaaggggagtccagaaacatgggaggaaaatgaggagactgtggtatcctggaggccacagggagaaaatgtttcaaggaggaatcttctgcttcaaatgtgtgctgataggttaaataagatagtagctgggaaagaattggctggagtttagcaaagtgtagtagagagatggggggaaaagcaaaattgaatttcggcgacattaagagaaaataggagaatgggaattggagtccactagtacaggcaacttttcgtgaactttgctgtaaaaggagcagaaaaatgggcagtagctgggaaaggacatggtaaaaaggacttgtttaaaggtaacagaaatcataaaataatagcatgtttgcaggctgatgaactgattcagtgaagaaggaaaattaataacaggataaataagggagaaatgactcagtatttgaataggcagagaacttgaggcctagtgcatacatggatagttagccttgggagcagggaaacagctcttatataacataataggaaggcaggcagaacatatggggaaagtgctgttaggaagaactactagaggaacttacggaggttttcttctaactattttattcataaattaggaaatgagatcagctcaaggtgaggattggggaatagggttagaagtttgtagagagaaagtagaatatattcaatacttgtctaagacagtgggcagttacatgaccttaggcaggacttcttggcctttgaggctgggttattctctgctgtaggagaggctgacattatagaatgttgtgtgcatcccaggcttctacccactgtgtgacagcagcagcctttcccctttttctccctcaattgtgacgaccaaaagtgtctccagatattcccaaatgtcctctggggccaaaactgtccccagttgagagccaccagtctaaggaaatgtagtataattgtcaggaagcattaacagccaagttaaggttcataatcatgaatttaacatgagatcattcagcattgttgtgttatattcagctgtgcaggtgcaggcacagaatacgcagaaagttaggtttaaccaggattggggttttgccaaaggagtacaatgaagagactagagaagagccagggagttattttaataattgatcatggcatttataccgggcgaggataaaagtgaggaaagatggtaggaacactagactgtaggtcctactggggtcaaggattatagagattggggttctagagagggtgatgtaatattagggattttcaaaaagaacctactccctgttggtgtctaggaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgtgagtctctctgtgaatactttgcaattctgtgtgtacaacatgcattgttttcaatttgcttagttagatgtcacagataactgttataaaacataagggcacagactgcatactttgtgccatactcaagaactcactatagctgttcatagctgaaaaagaactaaaataagcataaataattattctgatgccaccccattttcgaattggtagtatctgttcattattagttctttaagcaaactattggcagctttgaggcccagtagcttcttttctccatcagattactgtgatgtaacctaggtaggaccatggtcttagctgaacttcctagaccacataggacatagagcataagctttcctcctgctgcaggatatagtgtctctggcaaataaaaaatagtgttacctagcatcaattataatcttaatagaacttttcctttaataaacccatagtaaaggttctatttatctatctaaaagtctataaacatttcatatgtatttggcacaatgaactattagaataatacatattcaagggaccttgacatattataaactcacctacccagcatgattgaaaaatgagatacaatggttagtcaattgccaggttactagaaagttatctattccttctataaaacaccaaatcccaagaattggtattaaacaatgaccctaaaccgaattggctcatttttgatactttgtaattaataatctgtatagcctcagggtcatcatcatgaaagaaacttgtcattgccctaactataaagactgtagtggcatttaataagggttccagggtatggaacgcttagaaaagagaagttactagcaggaacagataattttctcctttgtttgtaggcaatatttttaatgctcagtttctttttcctttttttttttttaggactgtcaatagtcttggagtattaaatggtgcacaacttttctctctcaataaggatgaactgaggacagtctgccctgaaggggcgagagtctatagccaaatcactgtacaaaaagctgcattggaggtatgacttgtcaacctaaggtggtgtttttctgcaaattgaaagctctggaaacaactatttatgtccatattggccaatttccctttcttaacagagctgaattaaatttaactctgcttttgtaaatttgtcactgagatcatcaatgacagtttccagaaggttaatttgttataaatgctcatatgatgtgaagcttgagcacatacttttggaaacttgacaaaaagcataatgttctcattttatatgtattgactaattctataggaaatttaattttgacataacaatggaaattatcttctgagtgagtaagagccttaagaggccagaatccttgcctattcttaatatttttttttttttggannnnnnnnnnnnnnnnnnnntattcttaatatttttttttttttggagattctaataacgtataggttataagattgtaaaaccctggctgtgtgtgttaggtctagtaatacatctcaataatcgggaaagatacattaggtagagatcactgaaaatagagagcctggaaaagtatttaatcacaatggtctgtatgaaagcaggagagtcatgttttctagattgctttatacttaagcttccaatatcctattttagacttaaaatgtgctatatacgggtagtagtttccaactgttacatctcacagctcttaatagtttcatgaaaattatacttggactcaaatgaaagaatgtaggctttggcatgaaattgatccataatcatctctagcaggtatattctataaattcaacagttaaataattcagggtaaaatcacttcatgcgtatcaccccgtagccattctgaatcaagagaaaccatatttcccttggaggttttccctacaacattgatcttgaaggctccatattaaagtttgatttgattgctttccatatgttgaatattaataaggattatatatttttctcaagcagttttattaccactatatttaattttgttgagagtatataattacttcttcaaggtatgttagaaaatgccatattcctaaaattctgaattccttcatcccacacctgcctatcattattgtcatttgctgtcaccacccacttcaggatggtctcttgcttcttgttctcttcctattctctgcatgggaactgaggcagaggctgactacctgaggttcttcatgttcctcagccaccttctaccacctcaccctttccttggatctagttaatcttttagattatttgcctgtgttgccagagacttctgttgatgggaaaggagaaaagccagcatggtcggagggtcagaactatatggaggggaaactgggtgaattctgagcccactctggcctgagttaaaatcttctaaaggcagatcagtatcttgtttgagcccaaaagagtcctttgataatttaccatgttattatgcttattgtacacatttcctctttctctcagcaaacctagagtactatacatacattattgatttatctttatcatgttcaaatgaaaggcctggtgagtgaattgccttaacagactttacaaaatgaaaaattattaatgtgatatattagtgaagtgcagaagcttcacttaaaaagtagagctgttagctttcctaaagagatactagaagaaaaccacagtagaattttatcctgagccatttcatgatatgacctgcagcctgcacaagtcagtaactatcttgtctgaactgtttatctttcaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaatggtttctgtctcattagcaaaaaggatctgtgctagatcggctgaggattcgagttgaatgcaatgggaaaaagtagagatccacattttaaaaaaactatatattattctatttctgagtgggtagagaaactctagaatacttttttcggttgtttttcttcttttcgcctcttgtttcatcatcttttccttctaccatctagtcatatttggtaatggtaatggaactaatttacactgcgcttacgattgctaaatgcttccatataaatgctttcctggatatttacaacaactctatatgaattattacagatgaggagatttagcttcctagaagctaattttccccagatcctgaaggatgtgggagtttctcatcttctatctctcggtctctctataacactgccctttggataaagtggaacaaacatgagcatgataaaggtgaattagtttagatcttttacatttcataaggactgatacatatgtataatttagcctttattgaaagggataagatgaaagaaaataagatccaaaagttaagataacctgcgtgtaaaatagcagacggatatgaaaagaattggtgtaatttacatctttatgctataagatgccaaaggaatgtatcacagaggtagtaattgcagaaagcagtcacatcagctaaggatgtggggacaaagagaagaggttcctggaatttagaatcttgagggagcagcaccacagaatttggatccagacatctgaggggtttggtcactggtatctgaggatttgaggaaagaccccacaaagctaacagggggacacagcctaatcagtgtttttgcctcaggtattcagaaaagatttcaggaattgaacaacaggtcagaaaatccatggctctgggacttagactttggagaagagcatggcaggtagctggtccttgaatctctaagagggcacaatgaggatgcctctgggagcctagggaatagaaaactggtaaattgagccaactactgctgctgggaatcatttgctacttactgagtgaagaaccactactggggttgtgttggtagcaacagaaagtaaaacaggagggagaagccccttgttccctctctagccttctatctccctgtagcacatgctttcggcacagtctattgagcatgcacctgacaaagccccaaatctcaaagatgagaattaagggatggatttgaaactgagagaataactcataacccattccaatctctagtacttagcctctacacttgctcttctgtacatatctgaaatttcatacaacaataattttttaaatgtgggccaggagcagtggctcatgcctataatcccagtactttgggaggccaagatgggagaattgcttgagcccaggagttcaagaccagcctgggcaacaaagtgacacctcatctctacaaaaaaaagtagccaggtgtggtggcattcacacacagtctgtgttactttggagtccaaggtgaaagtgtcgcttgagccaggagttcaaggttgcagtgagccatgagtgcaccactgaacaccagcctgggtgatggagtgagatcctatctctaaaaaaattgattaaaaaaatttaaaagatagaaaaagcttatgattttacctaacaaggtgcaatcatctttctctgttattttagtagtatttaatgtagagtacttaatgtaaagaattgttaaacaggcaaaaagagaacacttaagacatcacagaggtggttataataggaagcagctcctatctagggctacagagcaaagggaagggattaggtttatcagcatttagaagcttggaaggagagtcctagaaagcttggactgggacccatgaagaggaggcacggtctagtgttggtcctggtgcttcagtagcacagaggagagcgccctgtagagctgggacagagacctctgaggaggag

SEQ ID NO: 13929 - DNA, 14875 bp, Human
tctgtagtttcaatcccacaacaaccttgtgtggtaaaaattactattatccctattttatttatctttctttctttttcttttttttattttgagatggagtctcagtctgtcacccaggctggagtgtggtggcacaatctcggctcactgcaacctcccagattcaagtgattctcctccctcagcctcccgagtagctgggattacagacccgcatcactatgcctggctaacttttgtatttttagtagagacggggtttcaccatgttggccaggctggtctcgaactcctgacctcaagtgatccacccgcctaggcctcccaaagtgctgggattacaggcgtgagccaccgtgcccgttctatttatttttcaacacaccattgctggctcaactattcttattttaaagatagggaaacaaagattcagagacgttaagtaacttgctcaatcaagatcacataggtaataagaggtttaggatttgaacccaaaatctgagcccagagtctgaacgctaaatcaacatgctgagttgaaattgactacagcagttgtgatggcgtgtgcctgtaatcctagcactttggaaggctgaggtgggaggatggcttgagcccaggagtgtgaagccagcctgggcaacatagtgagaccctaccccaaaaaaggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctcgatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcagatggggttgttccccagaagaggcaacccgcataccttcccaggtccatcctgggctgccacctgagttgcctgtcttccttctgccacctccacccctatcccaggcctgccactgctcatagcagatttcctatcaaaggctctcctggcctcctctcttatctgtggcccccgcagggcacccactttcagaaactccctggaaggcccagcacctgcctctctccacccctggatttctaccagcttggctgaggcctggggctagtggggagagcttcttggcctcttcccagaggcaagggaggaggagggaggctgggaaagccgctggggctcagtgtcgcaattccgggccgtgctgggacctttgctccacgaggtgcctatggaggggagggaacacgattctggaggctgctgggattggggtgggggttcctgggaggcagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccgagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctggtaagcttcattccatccctctcccctgagcccagaccgcaggctccacgcctcctgtaggaatcagcctccttcattacctgccttcttccttcctccagagagcagtccagagtcattcttagtcgtgcttgcctcccgcccagatcacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatgtaagaaactacaagtgactagtcctagctagagcccacacagactctagggtcccaaagcctgagctgggactttgctgccctctaagggtggggataagtttgcagtttcccagctaggacgctgggccgtggagccgggatggggcctgagacccccttgtgcctctcttttggagctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgaggagcttctgggtttggaggaggtaggggtccagattccaggtcctggatctggaagaggttccttgggggtttttactttatatataatctcatggttaagttcagaggctttagagctaactaaatctgactgatctaagtgtgaattttgtctctaggcctttctgagcctcactttccttgtttataaaatggaaataaaaattatggttgtcataaggatcagtgcatataaaaggctcatacagtacctagaacataatggcacttggcaaatgagggctactcttctcataaaagagagactggagtttgtataatgaagggaatgaaggtcactgagtgcccagggcagtggctgagtcagggagaacatgatgtttttcctcgggggagagcgttgaagcactttcctgtatccagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgagtttctggggctggagtggggaagaggctgaggggaaagagggggccagggtgtgacccaaaacaggtgcctgaacttgcaggggctaactgatccctaagtatggatcccagtatctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcaggtgagaactgagatcacacagggattggggttgggtggacagatgcttctttttttattttttatttttaaaaattgagggccaggcgcggtggctcatgcctgtaatcccagcactttgggaggccgaggtgggcagatcaccaggtcagtagatcaagaccattctggctaacacggtgaaaccctgtctctactgaaaatacaaaaaattagtcaggcatggtggcacgcgcctgtagccccagctacttgggagatcgaggcaggagaatcacttgaatctgggaggcagaggttgtagtgagccaagatcgcaccactgcactccagcctgggcaacaacaacaacaacaacaaaaattgagatagagtcttactatgttgcccaggttggtcccaaactcctggcctcaagtgatcctcctgcctctgactcccaaagtgctgggattacaggcgtgagccacccaccatgcccggccaagtactttttttttgtttcatttttttttttagacagagtttgctctgtcacccaagcaggagtgcagtggcgtgatcttggctcactacaacctccgcctcccgggttcaagcaattctcctgcttcagcttctcaagtagctgggattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatgtttgggtggctggtaagggaaggctcccttgttttttgaagatagaaaattggaatgctgataggcttctctcagctgctccagatagacccctgtcctctgttgctttaggtcagtggttttcaaactgtattccaaggaacctgagagatatatggaatggcaccttggaggagaaacagggaggcacaggaatgtccttcatctttactttagccaaacaagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctacttttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgacaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcacgaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgcggcggggctgtcctcgcggactgactggactccatctcccagcgcggcgccgcggcgcggccacgcccccccacaacacacgccgcccggtggaggtacacgcgccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgacgcccgtcgggtgagagtctctctgagcaacccaaacagaaggtactgctgtgggtcccccacttggcacgcgacggcgctgggtcggcctggcgcgccctcctacgcgcacgggcgctaggctaggtctgtgcgcagccgctgtctcccgaggttcggccccgcctcgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatatttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacg

SEQ ID NO: 13930 - DNA, 20513 bp, Human
accttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtgggtccaccggggtcgtggagacacggagagaggggacatggagagccctagaaggcacaaggcacacagagggcaccatgagacccagaggcacacacgagctgcaagcaaggggtgtggggaatctgggaggcaggtggaggggccaggggcccacagggagatcccggaggcctgggggccagggagtgcgatgaggctcatgggagcactgtcggggacctgggagacttggtggacatgatcacctcaagggggcacctaataaggtttggccgggggtgggggggcgcccagggtggtcaggaagcctggaggacactgtgaagcatgggggcaccagctagtggggttgtaaagcccctggatgggtgagtatcagggctaagggctcaagggactctcagggattaaccagaacaattcctcattatacagacacggaaaccaaagcttgagaggttaagtggctgctccaaggtcacttagacataggcctagaaccttaagccttcgttttttgtgttttgtttttttccgccctgcccaccagaaccttaaggcttaagtccccttgtttgttcactccaagcctctgcttttcccaaccttccccagtcctgggctaggcaagggggcctctagcaagagaggccaacatgttctgctgtgcggggctgtgcattgcacaaaagcctgtatttcaccacaaccgtgtgccagcagatggcaatcatgggtttcgagatagtcccctttctctgtacaaaaactctgtatgggttaactaaagcctgagggtgcgaagatcgatgagcatttgtcactcccagcctcctttaaatatatatatatatatataatttgagacagggtctcgctctgtcgctcaggctggagtgcagtggctcaatctcggctcactgcaacctccacctcctgggttcaagcgattctcccacctcagcctcccgagtagctgaaactagaggtgtgcaccaccatacttggctaattttcgttatttttagtagagacggaatttcaccacgttggccaggctggtctggagctcctggtcttatgtgatccgcccgcctcagcctcccaaagtggggattacaggcctgagccaccgcgcccggccactcccagtctcctttaagggtgcggagccttgtctcccggcccctggtgtcccctgacgccccgtccctccatgcacacaggtctatctgttcgagctgcacatcaccgatgcccagcctgccttcactggcagctaccgctgtgaggtgtccaccaaggacaaatttgactgctccaacttcaatctcactgtccacggtgagggggccctggtgtctgtcctgggctcgggctccccatgggtcctggtctcctacctccttttcccaacactaaggaggatgcctcgtcccatccagacatgagtgctggccacgtgcccagtgctgcacacacagggtgtgagagaaaccccaaggcttgcagggtaggcgtgggggcttagggctgagtccgggtctcatctgggtgggactctgttttatcatcttggtgtcacggctcctggcccacggcctggcactgtctgaatgtttgggcgatgggtgaaggtgagttgagagatgggtgggaattggggacaataaaccgtcccacctgcctggtaccttgaccctgggaaaggctgggaaggtgagatcctggggcagatgcccagcctcatggggtcatgaatgggcaagtctgtgaatactcagaggccgcccccagggcagggcttctcaaacggccccctctgaagccccttcccccatctctccaccctttgaacccagaggccatgggcaccggagacctggacctcctatcagccttccgccgcacgtgagtggccatcctcagggcctgggggaggccagtgctggagtctgaggcccttcagggtctcgactgggggtcagggctggggatgatttgcggggcggagctgaagtcagtgggggctgcaggggagagcaagcttcccaggcaggtgaggatactgagtctaacccccacaggagcctggctggaggtggtcggcggatcaggtacccctgccccaggccctacctgcaccatccgcagacccccaggggtctgagacgggtgggagcccaatctggctagtgtccctttctccctccccactccactcccatcctgctcctaatccctttccagtccctcactgcagcctcactgggggtccctctccatagtgatagccatgaggacactgggattctggacttcagctcactgctgaaaaagaggtgagtcctgggtggcagttcctggggcagctggtgaggcctggctccaaatcccagcactgtggtttgccagctgtgtgaccctgagcacaacactgcacctctctgagttggtttccttgtctgtcgaggggatgatcccagtgtggaaggagttaaagggctctgcagacattatgtcccgtcaacagtcatcctcacagtgtcccccacggccactccacacttgaggctgcaaaagctccctccgtaaactccggggacccagaaggaacagagagagggtccccagagctgcagggtctaccaggtcggcccaactgacttatgttctctctgccctctctctccctctcccccggcccctccattatggctgctgctgctgtggcccagagagtaagaatcggggtctgggtgtttgggggcggcagggcgctggtgggtgcagaggggattcccgtcccctctctgagaggctgtggtgagagactcagagcagggtgcggctccccacggacaggggtgagtctctgtgccttgggcttctcctgccacccacctatctgtcagagcttaggagggataagaaaaagtaatgcacacaggaggtcctgccagagcctccggagcagcatgggtgccccacaacacagggagtgcaagtgcggaaaatagggaggaagtaaaggcccatgggtggggtccaggtctttgagggaaggtggccatacctctcatgtgccacctaccctttctcccacccccacccctggagcagcagtttccggaccccgaggtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtcctgggcccaggaagccccgcccagggggctgcagtcttgcccccggccacagcctagactgcgggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaagaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccgcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcctgtaatcccagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaacaaaacaaaaagaaatagagacacagagaagtggaagcggggcggcacagaggggattggagggggggacctgggccccagccacagccacagtagcttggcctgggggagcagggtgcgggcggtggggtggccggggctgaggggtggtgctcagcctttcagaagaagctggagccggcctaccaggtgagcaaaggccacaagatccggctgaccgtggaactggctgaccatgacgctgaggtcaaatggctcaagaatggccaggagatccagatgagcggcaggtgcagcctggggtggggaggggggctcgggtggaggtggggacccccatagccttgcctcctgcccctctccacatgcgtatctctgactcggtgtggctctcagccccatctctctgggcctaatttcccatccttttgctcctgccggtccctctctctctctccttttgtctcgggctcacttcctcccgtcgggaacacttcaacggccccttctgttctacagcaagtaagttcccctctggatggcttggggtggggggcacagggattatcacggggcgcactgggcccggaggggtgtccgcagctttcctgccacttccctgcggcccccacccaggtacatctttgagtccatcggtgccaagcgtaccctgaccatcagccagtgctcattggcggacgacgcagcctaccagtgcgtggtgggtggcgagaagtgtagcacggagctctttgtgaaaggtgggcctgggacctgaggatgtgggaacctggggaggagatggcctcaggggagccaaccctcatgctcaccctgcctggacagagccccctgtgctcatcacgcgccccttggaggaccagctggtgatggtggggcagcgggtggagtttgagtgtgaagtatcggaggagggggcgcaagtcaaatggtgagttccagaagcacggggcatgggtgttgggggcatctgcccagaagaggccacagcacttgccacccacccacccggctaggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcagggtgagcctggctgggggggcacatgaggctttagggcttggacccctcagcccccaccccacctagccctgtaggggagcaggcaaacctgggctcaaggcctctgtgaccttgggcctttgacagcctaaacctcatccttctcatctctaaaatgacgatgctgaggtgaccgctccagagggtactgagagggtcatacgggcctggtgagcatcaccacccctcagacacttgaggttccttatgtgcactgcaccatcacaggcaaacatggcacacacaggcacacgtgttttcacatgcccacatgcacccagacacgtgcgcaccagcgcccatgggcccacacgccctccacagggattcacgccacacccacacaccctcccgagctcaatggctctgccctgccctgcagaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcggtgagtgtgcagggcaggtggatgggacaggtggagactgagatggagacagagagagacacagggagaaacagagagagagagataaagacaggtggacagagaggcagatgcacagagacaggacagagactgagacagagacccacagagagggagaaacagacagacccaaaaagacaaagagacagaaagacagaaatagttctatagagacagaaagatatgcacagggaggcacacacataggagagttcgtcagagacagagaagaacagagggacagagacaaagaggcagcagggagagacacggacggggtcgagagctccccagcaccctcccccagcttgtgaccagggcagggcaggaggccaccaaggaggccggctctggccagaggccctcactgcctctcccgccctcttgctcatccctggagcaactgggctggccgtgctgggcccaagttcacagagattaatgagacccagcccctgcccagtctccaagggcccagccaaggagatgctttgatgtagaaatcacttttacgctgcctacctctgaaggcacattaaaaagctggaaaattagataatatagaaaaaaaaaggcatttttaaaaatcagaataccaacaagccaggacaaggtgagggcctcctgggaccctggctggggtatctggcaaggccaggggtgtgtggcccagtggggtcccctgagccactgctcccctgcagggtccacaaactgaccattgacgacgtcacacctgccgacgaggctgactacagctttgtgcccgagggcttcgcctgcaacctgtcagccaagctccacttcatgggtgagcctgctccagggtagggtgggtcggggcagtggggccaggagcccctgtcactgggccctgcctttgcccccgtgctacttgctcttccttctcttgcagaggtcaagattgacttcgtacccaggcagggtaagtcttggggcccctgagtcttggttctgctcactttcccgcaacccacccacgcaggcctcccctccactcacagagggaagagcaaggatcaaaagtgggggtcctggggcccagctccagctttgccactcatgaccatgggtcaattataatctctgtgagcctcagtttcctcttctctaaaatgggaaccctgatagtgccacctcataggatagttataaagatgaggtgacatgatgtatcagacctgtcaagtgctgtcacacgtgtgactgttattattacatcttttcttcttcttcctttttttttatttttattttttttgagacggagtctccctctgtcgcccacgctggagagaagtggcgcgatctcggctcactgcaagctccgcctcccaggttcacaccactctcctgcctcagcctcctgagtagctgggactacaggcgcccgccaccatgcccagctaattattttttgtatttttagtagagacggggtttcaccatgttagccaggatggtttcgatctcctgatctcatgatctgcctgcctcggcctcccaaagtgctgggattacaggcgtgagccactgcgtccagactgctttgctttgtttaactgagggcagattcctgatttatttggccagggaacctttttaatgtgtgcatgtgtgcgtgcatgtgtgcgcgcgtgcgtgtgtgtgcatgtgtctgtgtgtgtatgtatatatgtgtgtctgtgtctgtgtgtgtgcgtgtatgtatgtgtatttgtgtctgtgtgcatgtgtgtgtctgtgtgtgcatgtgtgtatgtgtatgtgtgtctgtgtgtatgtgtatatgcgtgtgtgtgtgtgtattgtgtgtgtgtgtatgtgtgtggcaagacactgatgttcccccagttttcaaaatgctatgctaggtgacctgacctgaatattacaagcctcccagccaacgtcctggggtgatgggaatgttccagatcttggttggattaataattgcatgggtgtattcatctgtcagaactcagcctactgtcagatctgagcataaactatacctcaatacaaatctaaaaaaccaataaccaggggcccaggctcttgagcagccccgccccagtgacctgtgctcctcctggctctcccgtttctctgaactacattgtgtcttctgcagaacctcccaagatccacctggactgcccaggccgcataccagacaccattgtggttgtagctggaaataagctacgtctggacgtccctatctctggggaccctgctcccactgtgatctggcagaaggctatcacgcaggtactgtgggtccctcctcagtctccccatctataagatgggtgtgtggaaccagccaagtgctaggacctgctgcacaccccacccacatgtgcacgccctgctgttggctaccccgtgggagagactggtcagggggcaggcaaggtgggcagtgtgggtcagggggtggaagaagcagcagaggggcgcttccaggctgagtcagctcctctgctccctacttccctcctgccctgttcccaggggaataaggccccagccaggccagccccagatgccccagaggacacaggtgacagcgatgagtgggtgtttgacaagaaggtgagtgagactgaggtcaggaggaggctcgtttgtctttcatcactttctacctacgtggtgccgagcccttggcgaggtctccatggaggtgccacacttggccgggtgtgttgctgcccccagcagggtccctgtggggccctcacacctcaggcagagggtctctgtgaagtgtgctgatggccatcacaaggatgtggacaccctctcattgccaggaagccctcatgactgggctgctccctggctcccttcatcctaagctgaccttgaccttgaccttgtgctccctctcaactcaggagtagtttctgagacacttttctgccagtgtagctgccggggtcttgctcctgcctggcactgttggttcttctgaaggctggggtcttgaggggtcctcatgatagctcatctgagaggacaggtggttgccccaggtcccgtgacaaagctagaacccgagcccctgccctcagtcggtgccacagagatgattttgaactagatgctgacgtggatgcagtcttcccacaggctgtgttccccccatggacccccgggacatctggctgttggcggaggctgcaagggcctctggggtctgacttggatctcaccccaactctgcacccccccagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcggtgaggccggccggggtccaagctggagaacacagaggggcagccccaaggagggcccatccgttcgctcattcagccactcgacaaacatcacgggcatgctccctgagccgagcggcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatggtgaggaaaggcatcccaggcagaggaaactgtgtacaaaggggtggaggagggaaagggccttttgggtgtggagaatgaatgaaacatgtcaggagaggactgggtggggttgggaggatcagagccaggacaggggtgaatatgggcagtgagaagccttaaagggttgacggagggctggcgacatgatcagaaatgcatcctgttgagacccagcctggacaacacagtgagactccatatcactaaaaaaaaaaaaaaaaaaaggaaaagaagaaagaaatgcattctagaaagatctctttggatctgggggtggtgggggcagcctgtggcggttagttggagtgggaaggggacgagcaacgttactcaaggccctgagcggggcagggctgatgtgggtccatcccaccccatccagacgtgccagacgcacctgcggcccccaagatcagcaacgtgggagaggactcctgcacagtacagtgggagccgcctgcctacgatggcgggcagcccatcctgggtgagtgcaagggcaccggatggaggtgtgagggcgccaaacagatccgagggaaggtggtgtggggatgcctgggttccagaccagagctgccacctcccctgagccaggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtgagcctgcctggcctggtcctgccccccgccccctccccagttaaaaacctccaataatagcaggtgctctgcaggcagccatgctagacactcacatccacagtctcctttcatcctcgactggggatactcagccgcattttacagatgaggaaacaggctccaagcagttaaatgacctgcttgagatctcccagctggttggggtggagctgactctcacactacgccgacccctagttcacgtttcaagcctctctttccatgtctacaaaatgggaataatgacactgcctatctcagagagctgttaggatgatatgggatgaccaggcaggccatctggcatctaacaggtgctcaataaatgttcattgtcccctgttctccacacccttcaacccagggttttcacctatgggatggggcaagggctgtagttagtggaggggtctcaggggcatctgtctgtggaaagagtcctggaccaagactcagagatggcagaggcagctccatggtccccggggggccaactggagtcatccctccctgaagcctcagcttcctcatctgtataatggggtctgagtgggcagaacaggtgttgagactgtggcagggctcaggaggacacctgttcccactagggtgggtgagtccgggggcagctgcctgtggcaagggcaggccaaggacccctgggcccagggatggggcacagcttgggaagatggcaggaatcggggcctgtggggagaagggtccaggcctctcgttttagggactgattcctggtttgttcagttcttagtcaactcacctaatcatacgtgccaggaaattcccatgttttctgtagttttagttttagttttttttttttttttttttttttgagatggagtctcgctctgtcacccagactggagtgcagtcctggcgcgatctggggtcactgtaaccttcacctcccaggttcaagcaattctcccacctcagccttctgagtagctgggattacaggcatccaccaccatgcccagctaatttttgtatttttgtagagacggagtttcaccatgttggccaggctggtcttgaactcctgacctcaggtgatcctcccacctcggcctcccaaagtgctgggattacaggcgtgagccaccgtgcctggctgctgttgctgtttgtttttaagccaatctacagacatgtcttgtaacagggacaaaatattccttaaagtggccaaaagccagctgaacaggaagtgccccctatgtgaccagtgggcagttcagagtctagggcatggatctccagcttccccaggcttgctcagacccctctctgacctctcctctgcccaggtccccccagcgaacccacccacctggcagtagaggacgtctctgacaccacggtctccctcaagtggcggcccccagagcgcgtgggagcaggaggcctggatggctacagcgtggagtactgcccagagggctgtgagtgtccccgcccccaacccccctccccaaaggaagaacatgctcaccttgccattgagcagattcacctgtagtcaagttttttaggcccacttttgccgaaagttgaggacacccagagaaatatctgtcctgttttcagaagtaaaaaagcttgcctagtgaaaaacaaatgcagagtaaagctgactgtaacacttctttgagcagtgcgaaatcagcaactacattttaaaaacatatttaaggccaggcgcgatggcttacgcctgtaatcccagcactttgggaggccaaggtgggcggatcacctgaggtcgggagttcgagaccagtctgaccaacgtggagaaaccccgtctctactaaaaatacaaaattagccgggtgtggtggtgggcacctgtgatcccagctacgcgggaggctgaggcaggagaatcacttgaactcgggaggcagaagttgcggtgagccaagatcatgccattgcactccagcctgggagacaagagcgaaactccatctcaaaaataaataaacaaataaaaatttaaaaaaacatatttaaatcctggagattcctatcagaggagtgggcagtgggagtggggtgtcagtggtgacacagcctgtggccttgcctccccctccccacccccaggctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcgtgagtgcccctttgtgcagtcacaagacccgccattgacaccccaggcccttggtgtccagtggaggtggggacagttggggaggcccagaatgctctgcccagaacgctgggcagagacaggaggggttggagccatcgtccatgcgctaggcctagggaaaaagtgcagagagggtggccaggcacagtggctcaagcctgtaatcccagcactttaggaggccaaggcaggcagatcacttgaggtcaggagtttgagaccagcctggccaacatagtgaaaccctgtctctactaaaaatacaaaaactagccaggtgtggtggcgcgtgcctgtagtccctcaactacttgggaggctgaggcagaagaatcgcttggacccgggaggtggcagttgcaatgagctgagatcacactattgcactccagtctgggtgacagagtgagacaacgtctcaaaaaaaaaaaaagtgcagaaagggctctcttggtgtatgtcagtcccttagttctggaacagggaaagtaaaagccacagtacccaagctctcttccaggagtgtctcagctccaacaggtaaatattgtctatgtagtcagattggtccctctgggatccacttcccattcctttgttccttgtcccaacaaagggtccatcttttgtaaggattggttctcaaagctggaacgaggcagcaaactcaggtggtaacaacacagggcatagggtgtcaaagcccaggcttacaccctggtctatgacttactagctgtgtgacttcagtcaagttgcttaccctctctgatccctgccttttgaagtggtgaggctcggggaagccagctgggcttgggcagcctggagttgctgtgttagcaggagctaaaggaggcgcagggcccagcaggcagcttttttcttagctgcagctctctgggccttgtctcaagggaggttggagctgtggagcccctcagagctgtggcgggccctcacttagctacccactctatacccacagaacggccacggcttcagctgcccaggcacctgcgccagaccattcagaagaaggtcggggagcctgtgaaccttctcatccctttccaggtgggactggcccccttccctgtcccccaggggagagaggctatagtgtgttgttcccatccagtggactgatgtctcagggctggcctgatctgaggtaccagaggctggggtggcggccggcccttggagtgatccaggttcagggttaagcttttcctcccctcagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttggtgcgtggccaaggcctccttgagcccccttgtttcccttccctgggctgggctgctggggccaagggtggggccaggggacccaacccacagctcacattttccagtccactgccccagcaggcctggccctggttggcaggggtggggtggtccctggagccagtgaccccctgctcactgtcaggaggcgtggtgacccaactgggtctgtctcccgcagacaagccaagtcctccccaggatctccgggtgactgacgcctggggtcttaatgtggctctggagtggaagccaccccaggatgtcggcaacacggagctctgggggtacacagtgcagaaagccgacaagaagaccatggtgagcccagggtctggggtccccacgtgcaccctgcctaggcccggcagacccaggccgcagctacccttcactgtcctcaccgtggacccctcaccctccctctgctgatctgaatccctccatagtaggggtggagatgccaagggcacccaggagaggctctcggcatcaggaagggcctggcccagagatgcctcccctccctccctgcccccaggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggtgctgtaccctcattcttccaaccaggggctggggcagggaggctgtgggaacagggagaggggcctagctttgtgtggccctctcggtaccaagtcctgtcaccaacaggcatcacctatgagccacccaactataaggccctggacttctccgaggccccaagcttcacccagcccctggtgaaccgctcggtcatcgcgggctacactgctatgctctgctgtgctgtccggggtagccccaaggtagggaactttaggcgctggtccaggccgaccaggaggcagggctcacaggccccgacgttgagcagtcctctccccagcctgtctcccctgctttctctccaccttggggtgtatggaccgggttcctccccctgggcagggccatggtactcactcttggttccatgtttgtttccagccttgggcatagtcagggactctcgtgggaccccccgagtagaaacacagatgtgtctccctgggtccctgccaggtcccctctcagcctggatggcttccctccctctctttaccttatttatagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgaggtgaggagccctcggggccagggcctgggagatgggaagagcgggcggcagtggggaccctgggctttgctccgttgtcctcggccaagcacctgccctggctgcaagggcacggaccctgccacgcccagatgggcaatagcttccagaaggctgggaggacacagtgacatggcctcctcttctgcagtgcctcagtgaccaggctggctcctggggatggccaggtatgtaccacccgacacccagggcacaagtcagtggctgagccctggcccttggtcctggggcagccatcagtaaatgggaggctgtaggggccctccattcactcgtaagataacctgtgttgcaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaatttcggtgtgcctgttttcataaaaatgcacaggggatggccaggtgcggtggctcatgcctgttatcccagcactttgggaggcggaggcgggccgatcacctgaggtcaggagatcaagaccagcctggccaacatggtgaaaccccgtctctactaaaaatacaaaaattagctgggcaaggtggcgcgcctataatcccagctatttggaaggctgaggcaggagaatcacctgaacccaggaggtagagtttgaggtgggccgagatcatgccactgcacttcagcctgggtgatggagtgagaccatgtctcaaaaaaaaaaaaagaaaaaagcccagggacattgatcttcacagcaaagtgagagcagatactgttttttgttttgttttcccgatgattaaaccaggcccagagtggtttctgagttcataaaacattaacgctagaaggaacctgtcttcccctacagcattcactcttcagatgatgaaactgagctgtgacagcggaaagtgcatttaactggtcccaggtgctcagcgtgatccttgtgccaggggccgtggtcacaaccgcctggaggtggggtgaggcagaatctcagtgttgtgattgtgctggggtggagctgcactaggtggctttggagtcccagccagcaataagccagcagcgggttcagacccatatccccggtgggagacagcaacccaatccagtccaggacgctgggcaccagaaaggtgtcagggccagggccccactctgctctcacttcccccatggggagcctaaatccgagcatctgtttccttttgggcgcgggaagccagcaggtctcaaattccctgagagtgcagccaggtttttccaggacagaattccatgaaggcagctcctaggggagcttctgggagttctatgcagtggaagacactcctggccaggagtccggggccctgtgggaggccctggctgaatcaccacacctctctcgaccatacccacctgtaagggaacggagagggccagggccttggctttctttcacttaatctcagttcaggtgaggacgcccagtctggctgctccctctagcagcctgttcattcatggcagcccagctctctgcagggccctcaggtgcccaggaaggaaagctcctcccgcagccttgctctaggagcccagaacaggggagctggggcctccgtgtgccaaagcttggacatggatgacctcatctccttccttccttccagcctgaggtgactttttagagtccagggatagctttcctcaggcctgagccaagaggaggtgtcatttaacacaaggcagccagggagcctgaagggagttgaggacatttatttcacattcacacaactgtacattttctataaataatgtggggctgaaatatttacagtcatttcttgcccatacccaggctgtctctccctcctgacaccccgtgcctggagagacagcctgcagacagatgtgcaaacccagcttggtctttcctgccccctccctgatgctcaggcagagcagccagcggtccctgggactccactagcctcgaccactccatcctctgatgccgaaggcgtggcaggccacagggaattcgccgctccactgcagtcacagaggctgtggcaggcagcagccaacactgcgggccctgggcagtagctgccggcttgggaatgcagaaggaagcagggaggctgccactcactccggctgccccccaattcttcccttcctctctgtgcccttcctctgagagggtgagccccagggttccctcactcctcacagagtgaaactgctccaggcgcccagtcatgccgggtcacagagaagggagagccagactcttgcagtggacagttataacgccagggacaaggacaaggaaccacaacacaaatgtctcaaggacacaaaatagtgggttcacaccggccccacag

SEQ ID NO: 13931 - DNA, 15415 bp, Human
tgaagggtccacaatagacaggtccatagacaccaggtggcttaaataacagaaatttattttctcacagttctggacgctagaagtccaagatcaaggaattggcagagttggtttcattctaaggccttgctcctgggcttgtagatagccatcttctccctgtgtcttcacgtgctcttcttctgtgtgactgtgtcctttttaaacatttattgtgggccaggtgcgggggctcacgcctgtaatcccaacactttgggaggcagaggtgggcagatcacgaagtcaggagttccagaccagcctgaccaacatggtgaaaccccgtctctactaaaaatacaaaaattagccaggtgtggtggtgcgcagctgtaatcccagctactcaggaggctgaggcaggagaatcacttgaacctgggaggtgaaggttgcagtgagccaagatggcaccaccacactccagcctgggtgacagagggaaagtgtctcaaaaaaaaaaaaaagtattgtggtcaggcatggtggctcacgcctataaccccaatacttcgggaggctctgaggcaggtggatcaactgaggtcagaagttcaagaccagcctgaccaacatggtgaaaccccgtctctactaaatacaaaaacttagccaggcgtggtggcatacacctgtcatcccagctacttgggaggctgaggcaggagaattgcttgaacccgggaggtagaagtctcagtgagctgagatttgccactgcactccagcctaggtgacagagtgagaccctgtctcaaaaaaaaggggggggggataccagtcttaactggatgaggtacaatgtgacttcattttaccttaatcaccctttaaagaccctgtctccaaagacagtcaccttatgagatactgagtgttaggacttaaacatatgcgtttggttgcggggggacatgattcagtcatatcaaggtggggaatggagtggtgtaactgctgatgggtgtgcgtctcctttttggggtggttaaaatgttctggaattagtggcaattaatgtgcatctctgtgaatatactaaaaaccactgaattgcccagccagaaaggataaacttttgccctggggcaggaagaaggctggcatgcagagagaggagaaaggggggctggatgagctggcctgctagcgggggccccaatactacataagaccttgcccttctccacagtatctggtgttaaatctcattatgaggaccctttcagcccggggttgggattggaagtgagacattgaaacttcaagggctgggttctggcccgggtggggatttgccatggagcaaaatagcctcttgcagcacatgcggggtttcctgtgccgggcactgtcctaagtccttctcaactctttcgtcattgagttctcatagcagtccagtgagccaggtaccattcctctcttcagtccacggtgccaggtcacttggctagggtcccactgagagttcgaaggaagccaggctagagctcaggcctctcaccagctggaggtctttcccagactctctaaggtgagagttggtgaatggtgtcagcctgggcctggatgagtgacccacggtgctcagtgaatttcaggaacagagccaggggatgctgcggtcaggggtgtcttgatggggaagaagcagggctgggcgctcacctggcttccccggacctgcaggtccagcctcgctctccttcccccgagcacctctagcccaaggcctgcccacttgctggagctggccccttggcaaggctgctgggagggcccgtgctgccagggcggtcagggtcagtgtcagaggtgccgaagggacgcccaagggggtgcccaggtggcaaggtgcctgtatgctcagggaagccacgtcccagctcgcgggtgggtgcagcagaggcccacgtgaccttgctgctgacattcctcagaggccatgtggccccaactggcagcgacagctgcagacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaaggtgggtgtacccggcctgggggcgttcgagggtcaggctggggccggatgtctcccaggctccccagtcccctctcggcctcctcgggctcccctgtgtcccacaggctggcagccagggcccgaggctctgaatttatatctaaggccctgggtcttagatactgagtcttggcatcagattcaggcctgtggccttgaactgtggtgcccgagtctctgagactgaggttctccagcctcagggtcgagggtttgtgggtctcaagcccattgtaggtttcagccttcctgtctggtgttctgtgtctgagcctggcggggtgtgggctccagggttgcggctgggggtgggtgggtggtggagactccagatctgaggcttgggatagaaggtgaaggctgcaagcctgagcttgggaggtgaggctggggtgtagggaaggtagctgaggctggcgggtagaagctctgggtctgaaaagaagctttgggatctgctgctttgggtgtgaggctggggggtgggtgtggggcctccaggtctgagcctgcagtgcaggctggggtccaaggctcagagtccaggctgagcaccacctgcccaccgtcgctgtgtgcagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctacgcccacaacaatgatgacgccatgctcgagtgccgcgtgtgctgcagcctgggcagcttctatgcccaggtcaaggtgggcctgcaccccagggggacagcagtggagggttttggggctcccctctcatgaggcacacaccctgtggcactacctcattcagccctccttttagggagggctgaggagagtgagaatcagagagcaaaaaggcttatccaggaaggtaacaacttggccaggaagccagcaagggcagagccaggattcaaaccttgatctgtgtgacttcctggaggaataatgggaggctcctctgtgaggacaggccagcggcctgcactgccatgtttgctgtgtggtcttgggcaagtcacctatcctctctgaaccttgggagagatctgtaaaatgaaggagaataggactcaccttacagtggggttgtatggagtcagtcatcaaatatttattgaccagctactgtatcccaagactgttgacccagggtgtagcagtgagaaaaacagccaagtccccgtcctcacgagggttgcattctagttggagaagaaagacgatcaacacagtcaggaagtcaagtggttaggagaaagcaaagcggggcaaagggctggcagcactggacgtgggggtgtcataatttcaaatatagtggtcggagggcctcgcagaggtgatgtttgatggcttgaagaagagagggtgtgccatgcaaaaatctggtgagagagcattctaggcaaaaatgggcgagcccctaaagccaagctggaccctgggggagcatcctggaatgtttcctggaatgttccaggaaggacagaggccagcatggctgccaggcgcgtctcaggtgtgtgcggaggtagagaggtgagaggaggagggccaactgtgaaggaactgataggatcagccacagcaggttctgatcctgggtattttttggcgggggcaggggcggagttttgctcttgtcacccaggctggagtgcagtggtgccatctcggctcactgcaacctccgcctcctgggttcaagcgattctcctgccccagcctcccaagtagctgggactacaggcgtataccaccacgcccggctaatttttgtgtttttagtagaaatggggtttcaccatgttggccaggctggtcttgaactcctgacctcagggatccgcccgtcttggcctcccaaagtgctgggattacaggcgtgagccaccgcacccggccaaccctgggtatttttgttccctttcccctcaggtatctgtgctgtgcttggtccatgggggatttaatgcctggccccagtagatgcttaataaatcttggagttagtgagtggataaatgctgatggatccaaggtgggatgggaggaaacgagtcaccaaggatgacagccaggactttgtttttaggaagcagatgtaagggggagccattcagtgagatgagataggactggggcaggacaggggtttttaaaaacctttttaattctgaagaaaagtaagctaggcctggtggctcacacttgtaatcccagcactttgagaagctgaggggtgaggatcgctcaagaccaggagttccagaccagcgtctacaaacagtttttttttttttttaatttggcaaggctcatgcctataatctgagcactttgagaggccaagcagaaggattgcttgagcccaggagtttgagagcagcttgagtcgcatagcaagaccccatctgcaccaaactttaaaaatgaaccagacatggtggctcacacctattgtttcagctactcaggaggctgaggcgggaggatcgcttgagcccaggagtttgaggctgcagtgagccatgagtgttccactgcattccagcctgggcaacagagcaagaccctgtgtgagagaaaaaaaaaaaaagcccaagtgtgggcttgtggggtgttcattgctagtgggatgtccgtgcttctaaatcttttcagttatcagaataatggaagtttatactgacatttccaattcaaatctaatgtttcaggagctccccttaacttattttaaacttgattgtcttttctcttagatgaaaaatcttagtttctaaccacataattaaatatttgctttaccctacaaaatacgtaaaataattccaaaagacaataccaatattactctagaaaataaagacaactgaatgaagtttaagatttctttgctgttcttttggcttttttttttttttttttttttgagacagtctcgctctgttgcctaggctggagtgcagtggctcgatctcggctcactgccacttctgcctcccgggttcaagcgattctcctggctcagcctcccgagtagctgggactaccggcacacgccactatgcccagctaattttctgtatttttagtagagacggggtttcaccatgttggccaggatggtctcaatctcttgacctggtgatccacccgcttcagcctcccaaagtgctgggattaccggtgtgagccactgtgcccagccttgtttttgtaatgtatcccactatgggtaaactgagtacttttgttccaaagtcattgaaataatatatatatatttttttttagagacggagtcttactctgtcacccaggctggagtgcagtggcacgatctcggtcactgcaccctccgcctcccgggttcacgccattctcctgcctcagcctcccgagtagctgggactacaggcgcctgccaccacgccccgctaattttttttgtgtgtgtatttctagtagagacggggtttcaccatgttagccaggatggtctggatctcttgaccttgtagtccacccgccttggcctcccaaagtgctgggattacaggcataagccactgcgcccggccaaaataattatttgtgtgtgtggttgtagtaatatgacacacagttagggacatttatttactttttttttttttttttttttgagacagtgtcttgctctgttgcccaggctggagtgcagtggcgcgatctcggctcactgcaacctctgtctcccagattcaagtgattctcctgcctcagcctcccaagtagctgggaccacaggcacttgtcaccacacctagctagtttttttgtattttagtggagatggggtttcaccatattagccaggatggtctcgatctcctgacttcatgatctgcccatcttggcctcccaaagtgctgggattacaggtgtgagccactgcacccagccttaggtttttgtttttgtttttgtttttgtttttttttgagacaggatcttgctctgtcacccaggatggagtgcagtggctcaatcacggttcactgtaacctaaaactcctgtgttcaagcgatcctccctcctcagcttcctgagtagctgggactacaggcacattctttcacatctggctaatttttaaattttttgtagagacagtggtcttgcaatgttgcccaggctgatcttgaactcctggcctcaagctgttctcccaactcagcttccccgagtgctgggattacagacatgagccattgcacctgacctccattttctatttttaggtatttttcaaattaaatttaattttttaatctgtaaaacatttatgtggcttcaaaagtatgtaataaggcatattaggaaaagggttttttgggggggttattgacacttctcttttggtcatgttaacttggagctgcttgttaaatattaagtgaaagatcaaatagatttaccttgaaaaagaacagtgaaatggggctttagctgaagggaaatgacgtcacgagaaggtgggttagttttcttttttctttccttcttttcttttcttttcttttttttttttttttttttttttttttgtgagacagagtctgcctctgtcacccaggctggagtgcagtggtgcaatctcagctcaccatatcctcgacctcctgtgctcaagtgattctcccacctcagcctcttgagtagcttggaactacaggcgtgcaccactatgcacagctgattttatttttgtagagacagggtctcactaagttgcccaggccattctccaactcctatgctcaagcgttcctcctgtcttggcctcccaaagtgctgggattccaggcgtgaaccactgtgcctggcccagtttttattttttaaatgagatgagaaatgccagacatgtttgcacgtggatgggaaagattctgtagaaagagaggacctgacgatgcagagactgctcatcgggggctggcatttgatgggaacaggagccatcctccacagtgacaggaaaggaggcagggagcgtgggagcagaggtgcggagatgggagatctggtggagacaggaggggaaggagcttctccctgattttcttccttttcctcgtggagttgaggcgaggtcatcagctgaccatgagcaggtagaaaatgcatttggaagcttgaggaaaaagtacaagccaatggttgcatcgcctcgctgagtctgtctgatgttcttttgagcctgttgtgctgccagtctgccactgagcttcagtgaacacctgcttccgggtgccagcaggcaagctctagtggagggatctggtatctcccatccctgtgcatctctgaagctgaggagcccatttggcattgggagaaaagagaagccaactgtgttttcttgtcttttcattcattcactcaacaaatatttattgtgcatctaccaagtgccaagaactgtgctaggctcttgggatgcgtcacaaaccagatgagaatccctgagtccacagagcgacacctttgcactggctgttccctctaccgggccactcttgtcctggatgtcacaatgaatgagcagacactcgggccccctgcccctacctgctgttagagaaacctagcccaggagcccttgacttggggcagcctctgccactcagtttgcctccttccattccatgtcccctgcaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggtggggcagcggggaagggggcaggtcggggatgaggtggtgtgggccaggggctggggcctgggacagcagggcttccttcttccaaatcagcccatggaagccccctagggcttgcctctggcccagcctctctaaaggcgtgcaccaccatgcacagctaattttatttttgtagagacggggtctcactaaaccaccctcctgtgctgaagcgatcctcgtgtcttggcctcccaaagtgctgggattccaggcatgagccacttgtgcctggcccagtttttattttttaaatgagatgagttctctacagctgaacccctgaaggaaacatttgtcccccagcctcatcccaaacccactcccttccaatccatctgcaggggagggggcttccttctgccccaacaccctatatggggtactttgaagggtagagacggaagagggccagtttctggagtcccactgacctgggttcacatcccagctttgtcacttactgggtgaccccaatcaagtcacttctctttgagcctcactttccacccaccttgctgggtgctgtgacttcagtggttcagtgtgtgagccctcagcaccatgatagattcactaggctctgaggatgttgcttccctgggctgtcccttcagaggggtctgttgaggggagggcactccagtggtggtggcagaggagtaggcctgagccactggctccctcgcaggagtctatgaagatcgcgctgcagcacggggaccggccactgcaggcgctctgcctgctctgcttcgctgacatccaccggagccgtggggacctggaggtgaggtcaccgggatgcaggggctgggggcagggggcaggggcacaggcctgatacagcctgattccatcccccacctggctctgcagacagccttccccaggtacgactccgccatgagcatcatgaccgagatcggaaaccgcctggggcaggtgcaggcgctgctgggtgtggccaagtgctgggtggccaggaaggcgctggacaaggtgaggtcgggcctttcccacagcctccagccctcccagcactccccacttggggccagtaggttagccggctctttcagccactttgtctgacgtcagcctcaccctgatcctacgaggccaggacattcctggtcattttccaggctcagagaaggcccatcacttgccctaggacccacagctagtaaagggctggaaccctgggtaaactgaggcaggaggtcacttgcccacacagcccctatgactgtgccctagtctcttcctgctgccttcacacacaaggcagctgccatgtcaccctccctaggcctgcccccctaccctgtgcttccctgtgagcaaggcctgtcagacagctctgcccgcagccctggcctatgctcaccttccaggctctggatgccatcgagagagcccaggatctggccgaggaggtggggaacaaggtcagacttgattctgtgtcctggatctggggtcaagggcccaagtggggaacttgggtctggggaagggccttcctgagcctactcacgtcatgagcccttcctgatgctgggagctgcctgcagccaaccccatactctggctctttctctgccacacacacagcacttctgagggcagggcagaagtttcatagcttggaggatagcagaattcctcagaagcttcctgatgttgattaaaacccctaacagtgggctggacatggtggctcacatctataatcctagaattttgggaggccgaggtaggaggatcacttgagcccagaagttcgagagcagcctgggctacataatgagacccatgctctaaaaaagaaaagaaaagaaaagaaaaaaacatttttgagattgagttttgctcttgtctcccaggctggagtgcaatagcgcgatcccagcttactgcaacctctgcctcccaggttgaagtgattctcctgcttcagcctcctgagtagctgggattataggcacccgccaccacactgggctaatttttgtattttttatagagatggggattcactgtgttggccaggcttgtctgaaactcctgacctcaggtgatccacctgcctcggcctcccaaagtgctgggattacaggcatgagccaccaggcccggcctctacaaaaaatgttttaaaattagccagctgttgtggcacacacctgaggtcccaactacttgggaggctgaggtgggaggatagcttgagcccaggaggtcaaggctgcagtgagctgtgattgctccactgcactccagcctgggtaacagagtgagaccttatctcaaaacaaacaaaaactaacagtggcctccactccctgagcactgagcacacacagggtccttatgggtactgggtccagtcctcactctctccctgtgaggtgagtacagcaagccccattttacagatgaggaaaagtgaggctcaaagaggcgtccaaggtcccacacctactaacttgtctgttttaactacaaagcccatgttccaaatttaataatggtatctagtgcttgctttggcagcccatattctgaaattggaacaatacagagaagattagcatggcctaaaaaccaaaaccaaggccgggtgcggtggctcacacctgcattttgggaggccgaggtgggcagatcacctgaggtcagcctgaccaacatggtgaaactctgtctctactaaaaatacaaaaattagccaggtgtggtagtgcacgcctgtaatcccagctgcttgggaggctgaggcaggagaatcacttgaacccgggaggtggaggttgccatgaaccaagattgtgccactgtactccagcctgggtgacagagcaagactccatctaaaaaaaaaaaaaaaaaaaaatcgtcataatcttattaaaaccttaaaatcttgaaaacaggttcaccacttctcaaagccttccagatgtgcatttctacgagatcctgtgcacagtccaaccaaaatgccaaaatttggttggattatagccactctggtttacctgggtatcaggctgatcagaaatgctgatgagctattgtgtgtatatttaattaataaaaacaggaaagcagattaattattattttttttgagacggagtttcactattagagcccaggctggagtgcagtggtgcgatttcggcttactgcaacctccgcctcctgggttcaagcgattctcctgcctcagtctcctgagtagcagggattacaggcactcaccaccacccccggctaatttttgtatttttagtagagatggggtttcgccatgttggccaggctggtctcgaactcctggcctcaggtgatccacctgcctcggcctccccaagtgctgggattacaggcatgagccacggcgccctgccgcaaattattatggagtctgtgcaccaggtttggtcataaaatctgtcaaaaacatggggtctccaggcagttctggggggtgaagtcttctgatctcacccaccgcctcattctgcatgaaaggaagcaaggtcccagagagggcaggacatttttccaaggtccatcagcaagacagggaagtggctgagaccggagcctacctgcactgactttgttctcatcccccactggcgctctccactcctgcgggccccagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccctgctcccacatcttccacctcaggtgggggctcctgggggggtggacaggggtgggcaggatctcttcggggcactctagggcccagctggcttaatcacagcaataatactaatagcaaacacttaaccttggccaggcgtggtgcctcacgtctgtctcgcaagcactttgggaggccgaggcgggctgatcacttgagccccggagttcaagatcatcttggccaacatggtgaaaccccgtctctactaaaaatacaaaaattacccaggcatggtggtgggagcctgtaatcccaactactcgggaggctgaggcaggagaatcacttgaacccgggaggcagaggctgcagtgagctgagatctgtggccattcttttcataatccccaaagaggagtcagagaggcccctcaaaggtcattaggtcggacgtccagggccagacctgccgtgggtctggttccatcccatcctctcaactcccagcccctgctctgccctggaggtccctggggcagaggaggagaggggcaagccgggtgcagtgggagcctggggggaccgttcccttcccttccactgctgctgaacagccaccaggatgcatcccagcccctgcagagggcaggcaaggaaggaagagagggcccggagggaaggacaggcctcaggggagtggacagggccctttgcctccccaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggtcccagggattccgactttccatgcccaaggtctgaggagtggggagagtgggagtgaggcgccccacaggagcttcctcagacgcaagcgtttcctctgcacatatgtacaagggcctccagcagcccctccaggaacttgggatgccacagagacacgatccctgcagtgagaagctgacgtgcagtgggtgggagggtatatgataaacaggaaacacacagtttggaaagcctggtgggaagctgctatagacgaatcgtgtccccccagattcccatgttgaaggcttagtccgtttgggctgttgtaacgaaacagactgggtggcttgtaaacaacaggaattgatatgtcacagttctggaggctgggaagtccaagatcaaggcacctgcagattgggtgtctggtgagggcgcacattcttgctcacagattgagttttcttgctgtgttcttgcatggtggaagggacaaggaagttctctgcattccttttttttttttctttttgagacagggtctcactctgtcgcccaggctggggtgcagtggtgagatctcagctcactgcaacctccgcctcccgggttcaagcagttctcctgcctcagcctcctgagtagctgggattacagacacgcatcaacatgcctggctaatttttctatttttagtagagacagggtttctccaagttggccaggctggtctctaactcctgacctcaaaagatccacctgtcttggcctcccaaagtgctgggattacaggcgagaacaaccatgccaggcacagtcccttaataagggcactaatcccatatataagggctccaccctcatgacctaattgcctcccaaaggcctcacctgcctaatatgacagtcctagcaggctcatataatgtgataagttctttgtaacaataaagagtagagcctggttgtgtgcagtggttcctgcttgtaattccagcactttgggaggccgaggtgggtgggtcacttgaacccaggagttcaagaccagcctgtacaacatggcaaaaccctgtctctagaaaaaaaaaaatacaaaaattagtcagcatggtggcacacacctgtagtcccagctactcgggaggatgaagcaggagaatctcttgaacctgggaggcagaggttgcagtgagccaagatcatactactgcacttcagcctgggggacagagcaatactctgtctcaaaaaaaaaaataagagtagaggcctggcgcagtggctcacacctgtaatcccagcactctgggaggcagaggggaggttggatcacctgaggtcaggagttcgagaccagcctgaccaacatggtgaaaccccgtctctactaaaaatacaaacattagctgggcgcggtggtgggcgcctgtaatcccagctcctccggaggctgaagcaggagaatcgcttgatcctgggaggtggcagttgtggtgggctgagattgtgccattgcactccagcctgggcaacagagtgagactccatctcaaaaaagaaaaaagagtagagcctggtccctcttcctcatgttcacccccttccctaaaccagttctaaaaccattaagtgggacagagcaagacaagcatctgtgtggaggggtgacctggtgtgaggcactggaatctaagcaggctgaagagtgtccacacagggcaaggcctggggtgagaggtcagaacctgtgtggagagaggacagaatccacacatggggttgggttgttttgaagtgtcagagaccaagcccaaggaggggcagcctggcgtgggccattgggacctcaccagagtaaggaggcatccaaattggtgaaggtttgtgtgaggcatcagagcttgagtagagcgaataggccatgcacatgatttggggcatcctggcagggggcattaggtcaaggatggagtgaagagggttctgtgtgtggaagggagtggcagtggaaca

SEQ ID NO: 13932 - DNA, 15415 bp, Human; identical to SEQ ID NO: 13931

SEQ ID NO: 13933 - DNA, 30032 bp, Human
  misc_feature (1)...(30032): n = A,T,C or G
gagccctatagtgtgtagtatctggcaccatagcaaaagcttgggaattacagttgaatgaatgatattaaagatgattgcagagataagatctccagatcttatctccatacctcagggaagaaggctgaaaacctttaaaagcatattgttagctattctgttgttggatggtgactttaaattattattgtctttattgtccttagagatagctttttctagtacctaacaccccacatgataggaagattgacctttatccaaatgaaaattaactttctcacagcataaatgtattattctgtcttgttctcactagggagcagctggtaagtaactcaggccagtgtttctgggccctttttattctcacgcacttctgttccagtttttccacagcactgtatgtgagccagagggaccttgtataagggtgggtggtagcagaagtttggaatgcaacaagtatttttgcctgctggggaggtggagggattggtaagtatctgaattttttctttttgtataattaaagggaagtcaacaggtaatgagaaagggggagtgaaaaaataatgaaaggtttcaggaattatttttaaacaggtcccgtttgaaggtcttgtttggctgcaaggaacagatgtccactcaagctagcatatatgaaagggctttcttataaggacacaggtggactgaactgtaatctaatcaggagctctgcagctagaagacctagaaagtgtatctttctgactccaggatatataactgctcactctacatgtacctcctttctactcttaactaccttataactttggttgcaacatgacttttcttcggatcccttctccctccccttcacattgagacataattcacatactataaagtttaccctttaaagtgagcaattcagtgatttttagtatattccagagttgtgtaaccatttccactatttaattgcagaacatttcatcacccttaaaagaaaccctgtacccattagcaaccattcccctcttcttctccatgtctcccttcccccatccccattcctaagcaaccaccaacctactttctgtctgtagatttgcctgttctgggcatttcatataaatggtaacatatactatgtggccttttgtgactggtttcttttacttagcataatgttttcaaggtctttgttgtagcatgacccattgtcttttgaccacagcactttgagcttctccatttaacccatgctatctctagttgcaacttttccacttctgacttcactactaactgcctgtttctgttaaccagttccagattctgtaaagtagtgctgtcaaataaaacattctgtgatgatgaaaatattctgtatcgcagctgggggcagtggctcgtgcctataatcccagcatttggcaggctgagatggaaggatcccttgaggccaggagttcgagaccagcctgggtttcacagcaagacccctgtctttacaaaaacaacaacaactataaaatgttctgtctctgtctcatacagtagccactagccacatgtggcaagtgcaactgaagaacttagttttttaaattaagtttaaatagccacttgtggctagtggctatcatcgtattgctcagtgcagctataaaggagcttgattggccaggcccgtttttgttttaagcataggtcaagggtcttaagtttctggccagccaatggatcagcttgccattgggttaagacccaccacatggtttagtcacttggggccagaggatgggaaaaatttggaatagaacatttgtgctgcccctgagataggcctggggtggggaaattttgagaggggaaaagaaaggagaaagagaagagagtgttcaagaattttgaacaaatacatactttgaaaataacagctcttttttgttccctcgtgtgtctcttcccaattgtatccctattgtattttctcatagtatgtttcagcagaaatcaaggtagacgaagtaacctcttgtcctgaattttcatagttgctcattcttaataatggcagcagaagcaacaatgagagcaactacctcctcaggtattactattactgcttctgctgccagtagtagaaacataaaaagagagggggtaggtttcatccctttcccctaaaacacttgccactttctgatcttcctcctcttcacattcttgcaggccctgatttgcctttcttctatcctgttcccaggtcagggctggcagtactgccccaggaaataggaatttccatagacttgcctcttaggaatgacagggacactatagatacttctccagggaactgctgaattcactggttcttgaatggagatgataaatatacataactctccattgaatggggaagtaaggtacaaatttgagaatgtatttaatgatacaaagagtaaatggatgatgtggtagctgatgtgtacccagatggcttttttaatacaatggttacttttaatcataatgacaacatgcatattggaagtatatgtggaagagggagagtgttgtttctcttcagacacaatatcagagaaagtttgtgactgcttattacatacacacgggtatacatgcgggttgttgctataccttggtagtgcttctcaagctgtgttaagggaccatatctctccccacccccactcccttgtaaaatgcaatgagaatgatgtaggggaaaaaataaggtatgagcttgtattttacatttattattactagactgaacaaatacaaaattgctcagtctaatttctgtaaaaatttccaaagagttaagtttgaagattgcccctggtccttaggccacaccttgtgtgtgtgcacgccctttttttttttttttttttttctttttgagatggagtcttgctctgtcgcccaggctggagtacaatggcacgatctcggctcactgtagtctccgcctcccgggttcaagtgattctcctgcttcagcctcctgagtagctgggactacaggtgtgtgccactacacccagctaattttttttttttttttttttaagtagggacggggtttcaccgtgttgttcaggctggtctcaaactcctgacctcaggtgagtcactgtccccagcctcttgggccacagtttgaacagtgctactctatgggagtcttctggctattgaattggtatataaacagggaaggggaggttcatggtgtaggtagacctggaaaaatagagaaggatttggagagctaaagaagagcaaaggatgacatttctctagaatcttgagtccctgctaaacttttgggtaaactgtaatctacatatattgacttgtgtttatgctttagcactaaacaggatgcaaaagttcagaattggcacacaaacaacagagggaaggggcaatctgggagcagttgcctccgtaatacagattgataaaactgcttttcagaaatagctgtcagcttccttatcaaaatgtattctgggcaccattggggttctttgttaacccactctagaatagaaatagaatgaaagattagcaacattctagtaaaatgctattacaactggtaattaaagttgtcgggacaggttgtagggagccagtgtttcactagtgatagggctgccttttttttctggagacaagatctcactctgccacccaggctggagtgcagtggccccgtctcagctcactgcaacctccacctcccaggttcaagcgattcttgtgccttagcctcccgagtagctgggattacaggtgcacgccaccacacccagctaattgctttgtattttttggtagagacggagtttaccatgttggccagggtggtctcgaactcctgacctcaagtgatctgcctgcctcggcctcccacagttgctaggattacaggcatgagccaccatgcctggccatagggctttttttcatcatggtagctgatttctgttggaacattaggattaagcatttaaaagcagtcacattatgtttttgccatgacctgccacacattttaaattaacagattacaggaaaaccagtaaaatgatgccatctgaaacactcaaaagaaaataggccaggcgcagtagttccatgcctataatcccagcactttgggaggctgaggtgggagaatcgtttgagcccaggagtttcagaccagcccttgcaacatagtgagaccctctctctacaaaaaaatgttaaaaactagccagatgtggtggcgcacacccgtagttccatctactgggattgctgaggtaggagaatcgcttgagcctgggaggtcgaggctgcagttagctgtggtcatgccactgcactccagcctgggcaacagagcgagaccatgtctttaaaagaaaaaggcgtattaatcctgtggcaattaaataatcataggagataatagctgctcttaaatttgggtgctgtttttgtgcatagcactcattttatcagagctaattggttaaatggggactgttgaaacttaaggaatttctcctttcacacatttgagtgcttactttgaaccggatactatacccagtgtgtttacaagaatgaacaggaaataaaatggtttctgcctgcaaggagctgtcagtttaattgggaagaggtggatacagcccgattatgttcaaaggtgttaagcataattttaatgctaaaatttccacaacgaaggtggaaatttagtactgttggagtcctaggattgtagctgattagttaacctggaagaatatggggagccttcacagatatagggttaggaattggtctatattccatttgtcttacagcttttgaatttagatagtgctagagtcatcaaaggtgatgtgagaataacccctgtaagtgttgaattataaaagattcaaggctgggtgcggtggctcaggcctgtaatcccagcacttgggaggccaaggcaggtggatcacttgagctcagttcaagaccagcctggccaacatggctaaaccccagctctactaaaaatacaaaaattagccaggcatggtggcgcatacctgtaatcccagctactcaggaggctgaggcatgagaatcacttgaacctgggaggtggaggttgcagtgagctgagattacgccactgcactccagcctgggcaacagagagaatctgtctcaaataaaaaataaagaaataggctgggcacggtggctcatccctgtaatcccagcacttttggaaggctgaggcaggcagatcacctgaggtcaggagtttgtgaccagcctggccaacatggcaaagccccatctctactaaaaatacaaaaattagctgggcatggtgacacgcgcctgtaatcccagctacttgggaggctaaggcaggaaaatcacttgaacctaggaggcagaggttgcagtgagccgagatggcaccattgcactccagcccgggcgacagagcgagactccatttcaaaaaaaaaaaaaagaaagaaaatatatagtaattaaaagaaggtgagctactttcatagattcagcattcttaaggatcttcagacactattcagaagatagcaatggtggaaaaatgatttttttgttgttgtttaaagagaactagcacattggctgggtgcagtgcttcacgcctgtaatccagcactttgggagaccgaggtgggcagatcacctgaggtcaggagtttgagaccagcctgaccaatatggtgaaaccccatctctactaaaaatacaaaattaaccacgcatggtggtgcatgccttcaatcctagctacttgggaggctgaggcaggagaattgcttgaacctgggaggaggaggttgcagagagctgagatcatgccattgcactccagcctgggcaataagagtgaaagtcagcctcaaaaaaaaaaaaaaaaaactagcatgttgtttgggattggatattagaacgtggcaatttttgtatatgatttttagattaagcagatactaacagaaaagctaatagtgctagatattgggaatttaagttattaatggtttagataaatgttcagagttaaatttagaaacaaataggacgaaggactttgaagtagatggtatgaggccaggcgtggtggctcacacctgtaatcccagcactttaggaggccgaggcgggtggatcacctgaggtcagttcgagactagcctggccaacatggtgaaagcccgtctctactaaaaatacaaaaattagctgggcatggtagcagacacctgtaatcccagccacttgggaggctgaggcaggagaatctcttgaacctgggaagtggagattgccatgagctgagatcaggccattacactccagcctgggcaacaagagtgaaattccgtctcaaaaaaaaaaaaaaaaaaaaaaaaaaaaaaaaaaacaagatggtatgttctgagtggaaacatctatagtgtaagaattcacctaggttgtttacagtggcaagataggaatgaaggtattaaaatagctgattatccttcaggttctaaaggtaataaaactgaaataggagaattacaagtacaatgtgataggactagagaaacttgggatcgttaaaatggttgccctcagtaagggaatcttaactggtcttagagtaatagcagtaaattggataactcagaaacagaaaatctaaaatgatggtaacattgtttatgttcatcgcacaatcatctggaaatataagaggtggagctctgttttggtctggagacctaactcgagcattatgattatacatgagtcagctacattcaaaggccagcattctagtccttagtttaatccttgaaaatcaagtgcttcttttctaacttctactgaaaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagttaagatcattaaagaaaagaaaatttcctctggaaagcaacattattacataatagaagtttcattttatctcacacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaaggttagggctttgggttttggtttatcttattttttccactgactctcagagcaggtgagggctttgggtttttaacaggatacaaaaaattggatttttatatgtaatttctttcatgtgcattctctctgtcattgccagaatactcctgtctgtctgtctattggaaaaaatctgtccttttatagtagtaatatcttgtaatccaaacatatttaatggctttaaaaagttaaggtgttagcatgaggataatttgtaaattgggtcttgggcagtcctttgtgagggttctaaatttaagagacagactcacgtgagtgtcttatttgaccttgggaacagataacaaagataaaattgaagttaaaccacataaagttttctttagtgtttgggctagcataagctgaaggagaaagactgtccacatacccattggtttcttgttagtattacagaggccttgcgggatagtttatcaaatagaaaggatttgtttaggcagcttgtttgctgttgccacaaagtgaacaggagaggaaaggcggagctgcttccagaattgcctagcagagtggaagtttcacaagactgatggtagataggtattaactttgccccgtatatacacacagacatgttcttattttccattttaccagttttcaaataattttctgtgaaagctgtccaacagtgcaaatgtaagcaagcatgattatcatattgaaactagcttaatagcagaggatctagaagcagaggaattactttctctttttggcatggttaactaaaaatataaagtataatagtttctgaacatgactggcaatataaccttcagtaatttgtagttctaactgctgcagcatgatttaaaaaaaaatctatattgtatctcatgagaatatgggagtgtcagaacatttaagcccaagatttacaagatatacttcctctcctactacccaaaataaagatacaaagcacaaaatctacagatctgaggcagcaccatgtgcttttagaagcttaattatatttgatgagaaccaagagtccaaaaaaagatgttaagaggtgcttgctcttaagtcattttataatttaataagtgataattatgtttgaggcatatggtagaatctggctacgaagtagggagtggtttattctgagagagcagggaaagaaagagttcctggtagactacaggctgcaaaagtatagagccccatctgtcttgttgtctcatataccacctggtgttccaagtagggtaggttgagtcaaatggcacatgacctttctttatgagaagtcgtattttccagagaagttacatgagcagctaaataagacttatagtgtaactaactaggaggagactaaaacaataaagtgtatagaaaataatctcttattcctctgctagatattctattcgttcttttccactaccctccccctctcactaattttaataaacccagccctcttttaagatctgatctgtcagtggaggaaggattgctctaggaattctctgctttccaaagtttgattttatgaaatcttatttattgcagggtgctgttttgttacattttacacccgtaaagctgcattagaagctcagaatgctcttcacaacatgaaagtcctcccaggggtaagaaagctcccactagtaaatggaaatgtggtaactttgatatgtgggatatacttacacatatcagacacacactgaaaaccattttggggaaaaggtaactgctgcaggaattgatgtaaaggaagacataaagggagcagttcagagattacctgacattagttctctctcagtcaagagtcttgtgtattttgacttcttgactcacattctgttttctggggaaagatcatgaagcagacatgagttcagagagaactctttaaagctctagttctggtattttagagtccatatgtatttttgaataccatcaatatatacagtgataataatcatatttttccttttcagatgcatcaccctatacagatgaaacctgctgacagtgagaagaacaatggtaagcaaatgtatacaatcttccccttaagatttctgcctaggccaggcacggtggctcacacctgtaatcccagcactttgggaggccaagacagatggattgcttgaggccggagttcgagccagtctggccaacatggtgaaaccccgtctctactaaaaatacaaacattagctgggtatggttgtgcatgcctgtaatcccagctactcaggaggctgaggcatgagaatctcttgaacccgggaggcggaggttgcaatgagctaagatcatgccagtgtactcccgcccaggcaacagagtgagactctgtctcaaaaaaaaaaaagatttctgcctagtttgtttgctgttcttaggttatctgaattgaattgtgctttaagtaatccgttgtctaagttgtctcagttttttctttaaaagtatgatgaagaacagagctgacagagaaatattataagcaacattgtagcaatgaactggaatatacttggtcagtataatttcttttggacaggaatgagggggcaaaatgaacaaattaggaaggagaacttaattctcgaattttttttttttttgagatggagtcttgctctgtaccccaggctggagtgcagtggcaggatctcggctcactgcaagctccgcctcccgggttcactgcattctcctgcctcagcctcccgagtagctgggactacaggtgcctgccaccacgcccggctaattttttgtatttttnnnnnnnnnnnnnnnnnnnncttgaacccgggaggcggaggctgcagtgagccgagatggtgcacggcactccagcccaggtgacagagtgagactccatctcaaaaaaaaaaaaaaatccaaccaggtgcagtggcccacatttgtaatcccaccaccttgggaggccgacacaggcagatcacaaggtcaagagatcgagaccatcctggccaacatggtgaaacccgtctctattaaaaatacaaaaattagctgggagcagtggtgcacgcctgtaatcccagctactcaggaggctgaggcaggagaatcgcttgatcccgggagcagagattgcagtgatccgagatcgtgccattgcactccagcctggggacagagtgagactcatctcaaaaaaaaaaaaaattcagaaaagtagacagttacattcactgaaaggtgtattctcttccacttgtcatatcaagtgtgaaaacctcttctttctttagtagtattgccagtaagagcaaacaatgctggctgggcacagtggcgcacacctgtaatcacagcactttaagaggctgaggccggaggattgcgtaagcccaggagtttgagaccagccttggcaataagagtgaaacctctctgcaaaaaattagctgggtgtggtggtacatacctgtggtcccagctattcgggaagctgaggtgggaagattgcttaaacccggcaggtcaaggctgtagtgagccatgatcatgccaccgcacttcagcctgggtgacagcgagactcttgtctcaaaaagaggaaacaatacaaaggactagggaagatgccaagtacttcacatttaatagcaactgctaccctttgaagtaaacctgattattcctattagttagatgaggaaacaggcacagaatggttgagtaactttcacaagattacaaagctaccatatttcatctaaatgcttctaattataattttaagataacattggttataaaaagagacgtgaagccgggcgtggtgggtcacacctgtaatcccagcactttgggaggccgaggcgggtggatcacctgaggtcgagagttcaagaacagcctgaccaacatggagaaaccccatctctactaaaaatacaaaattagccaggcattttggcgcatgcctgtaatcccagctactcaggaggctgaggcaggagaatcacttgaatccgggaggcggagcttgcggtgagccgagatcgcgccattacactccagcctgggcaacaagagcgaaactccatctcaaaaacaagaaaaaaagagatgtgaaaaatacaaaaaacaaatgtgtgtctttgaatctgtaaaatatggtacagagccaggattcaaacccaggcggtctggctcccaaatctgtgccacattgcctctttaagtagtaatattcaagtcttttctgttttactctcttagcagtggaagacaggaagctgtttattggtatgatttccaagaagtgcactgaaaatgacatccgagtcatgttctcttcgtttggacagattgaagaatgccggatattgcggggacctgatggcctgagccgaggtaggtagttttagcttttaaataatcttttggttttttgttttggtttggtttggggtttttttttttttggagacaaggtcttgctctctctcacccaggctggagtgcagtggtgccttcacaactcactgcagcctgaacctcccaggatcagcctcctgagtagctgggaccacaggcatgcatcatgacacccagctaatttttaaattttttatagagaaaaggtctccctgtgttgcccaggctggtcttgaactcctggactcaaacgatcctgtcatcttggcctcccaaagtgccaggattgtaggtgtgagccactgcaccgggcttggaatctttttaatttgaccggtggaaactagcaacagtgattccctagccaatatggcccagtcaagataaagaggttgggcctgctgcttcctgctgtatatctatgtcctgtcttgactcctcctatcagttcattctttttgtctcccagcccctctaaggagtctacattctatatttcattgtcatgtattaaaattttctcttttggtgctttgcaagatccttgatgccaaaatggaaatactttcttcttccattttcttttattttcaagaggaactagaggatatgagtcctcctttctcctgtcaagcattttttttttctgtcagtggttctgttttttcattatagcacatatcaccctgttgcaacataccagcacatgattccctgaaaacagggactgtgtctgtattgctagcatgatagtcagcacatagtaggtgctcagttaatgtttgtcagagaaataaatgaatgcatgagttactgactcttctcttaccaggttgtgcatttgtgacttttacaacaagagccatggcacagacggctatcaaggcaatgcaccaagcacagaccatggaggtagggagcagataggtgatggggaaaattcctcagcttgggaatgctgggacagttggccattaaagtccagcagcatgtgcagcatctgattgcccagaaggttaaacagccaacatcttaaagttaaaaaccactgatttctttaaaattaacgtattggaaatgctctccctacccctttttttgagatggggtcttactttgtcacctgggctggagtgcagtgggaatatcatggctcactgcagccccaaccacccaggctcaagtgatcccccctacctctgccactcaagtagctgggactacaggtgcacaccagcacgcccagttaatttttgtatttttttttaatagcgaccgttttgccatgttgcccaggctggtctaaaattcctgggctcaagtgatccacccgcctcagcctcccaaagtgttgggattacagtctcttctctcttgtgtctatcatgaggagaatcatttggcagtgaatgaaattagaatgtaacctgcatgtcatccaaaaggaagattttttttcttcttttcagatggaggaatttgaccctttcgttatggtcttttcacagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcagtgagtctttgtggtttgctttctgcagactgtgcaagctcccagctgttccttcttctgctgtccctagccaacaaacacagtggcatttacaacttttggcatatagaaattatatgtaaaaattcaggtagtactatttcttttagtcctgttagtctctttctctctctatatatatgtatctctggacatgcatctctggttatatcttgaggcttttgctgcaactaaagtgaattcctggtttcccgttttaaagatttagaaacatcttgtgtccttgcctccaagaaagaaattcctgagggaatcttaactaccagtgtctttctccatatctctttctaccagatgtagagggcatcattaaaatccttattgagtctttcctaaagagtatgataaatgtttctttcagcggacttgagagatcaagagattttttttctttttttgctttatttatttatttatttatttattttttgagacggagtctcactcactctgtcacccaggctagagtgcagtggcacaatcttggcttactgcaacctccacctcgggttcaagtgattctcctgcctcaacttcccaagtagctgggactacagacacacaccatcacacccagctaatttttgtatttctagtagggatgggctttcactgtgttggccaggctggtctcgaactcacgacctcaggtgatccacctgtcttggcctcccaaagtgctgggtttacaggtgtgagccactgcgcctggcggagatcaagagattaacatgaacatttttaaatgagcattacaggtgtatattcaagtttactacattgtaaatagacttcctttaatttgatctctctgttgtcgtgagccaaaagaaggttgtctagtccaaaagaaggtctcgccccaatttgtgatttagatttactaggtctgcagtgtatatgttacaggggattattaatggaaaagaattgggccagcacaagacagttaaaaccacccatttgtgagtcaaagaggaaaaaggtcatcttaggctattaatggtgaaaccactagatttgtatggatgatacaaaaatattcacatagaaatagctagtatagtcatttattcctcatcatttcaagtattattctgtatggaaacagacaaaaggcactgatttctgtctcccagtactgaattttggtttagttccagtggttttcatatttctaatatcttataagaaatcccagtttaggccgggcgctgtgactcacgcctgtaatcccaacactttgggaggctgaggtgagtggatcgcctgaggttgggagtttgagaccagcctggccagcatggtgaaaccctgtctatactaaaaatacaaaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaaaaaaagaagaagaaaaaaaaaaaaaaccccagtttatcctagctagtatttctctgaagtttttttaaaaaaatataaagagttggggttgttttgttttgttttgttttgaagcctcgctctgttgcccaggttggaaaacagtggcgcaatctctgctcactgcaacctccaactgcaagcagctgggattacagtcatgtgccaccacgcctggctaatttttgtagttttagtagagacagggttttgcttatgtgagccaggctggtctcaaactcccgacctcaaagtgatttgcctaccttgccctcccaaagttctgggattacaggcgtgaaccactgggtccggttatatttcaacagaaaaaattgtttcttagtgctgaaacattgcttatatgttcagaaaattcagggaggttttagtcatctgcagaaatgataatgctttgaaaatggtctacatgctatgcatttgcttttcttagagacttttggagcccccctttagggaaggttaacctttttgttgtcattgccactaccagcaagtacatgatggcatgtgttgagagctgtgttctctttgttttggttagacatgattcctgccctaagagctaatctcatttggagggaaatgaagggaccaagtacagtattcacagtccaccagttaggactgaacacatagcccaaggtgtttaagaagaaaaaggccaggcgcggtggcttatgcctgtaatcccagcattttgggaagccgaggcaggcaaatcacctgaggttaggagtttgagaccagcctgaccaacatggtgaaaccccgtctctactaaaaatacaaaaattagctgggtgtgatggtacacacctgtggtcccagctactcgggaggctgaggcaggagaatcgcttgaacctggaaggcggaggttgcagtgagctgagatcaccattgtactccagcctggcgacagagcgagactccgtctcaaaaaaaaaaaaaaaaaagtgtagacgtgggtgctagtggactgtgtgatagtacatcatcattaattatgaggttctttctggactatgtggacttgagttagccaggctctactgtcctggaggagttggtttttatctttttatcctttgagaagcggggggaaagggtgtataggtgcattttttcccccattctgttcctggaggtttgtagacctcctgaaacttatccatggtctctagcctggaaggatttgcggcgacagagaaaccaggtcagatgtttataggaatgggaaacaggttgaataaaaggatcctgtacaagaataccaattttccataaacaatactaattgggtttagttggagcaaaagttttcagcaagctggttagatgaaggttgtggtttgccaatatacaaagtaaactaatgccacaaactcagggacaggccctcttactttatttgtcatgggaccatcattgaaggagaacgtactctgaacctggtatagactaatccatcagtcatttggtcatctgcaacagggaagaccagtttggaggggaggaagtaaataaggttggatagatgtgtagctggagtgattattagtcatgtggtccattgtgaccaataaagggtaactccaagaaatactatgaaatgtttagatttgatatttaaaatagttgtgtgaagtagaaattgagtatccagatggaaacaatctgcagagtgagatgtgtggacctaactaaggagaacttgggagagggtagctggaaatggcattcattcattcgcagacaataatcacagttgactgcgtagctcctcaagtttagcttattatcctgctgtagttctgtcctttgctgtgctgaattctgctgcccagggacttgagcttggctcagtattcagtgaacatactatcttctgggccagtgctttagctgtgttttttttttgtcctgtgctgtcataagcctcatgtttctgttgtgttggcttgggttcttgtctttgactttcttctctctgggggcctctgcactctcgctttgctgtgctgtagagttatcccagatgcagaaccagccctcactctcactcttgttctgttttttggtgtaatgtctagctttatttgcagctccttcagcagactgcctcctctgggaacctcaacaccctgagcagcctccacccaatgggaggtaagtgtttcactgctgcagaggagcagcagcacccaggccagcagacccagctaacaacagtcttgggagtttggcatcgtttctgtgaaaacatttttttgcttattatgtaaacctgacctaggataaacatcccaggactcaattttcttgtctctgtacagtggctctatggctagttgatgccacattgctctgacgttatctggtgcctcctaaccttttaggtcactgttgaagaagaatatggaaaagggctgtttagctcctatagactgaggctgttctctgataaggggaaaaaattgcaagaactctttatttccattataaagtgacttttccagtgactgcagaaaagccaaagatggcttccatgcaaatgccctaccttgaagcttctagaacccaggcatttggtttacctgtgtatcttcttgtttcttaggtgaattcctattttgttgttgctattatcgtacacagaaaacttaaatggagtgccacaacaaacctgagctagggcccatcaggagtcggttgggggtagggcatgggacagcttcaaagctgcctgtgcctacaccctctgcattggatttaggctaggccaaatgtgcatttgagaaaggcatagttttcagtgaactgcattttgctctttgaaaatttttgatagtcattcactttgtctcaggaaattatagttggctatatttttggaaagttgctagattgtaatctgtattgtattttaattctcgtttactctttccactccccccacccctcaccccatccatctttccattgtctagtaaatggtttgcagcagcgacagcacagtttagattccttcttcccctttcaactgtgttgtctgggctctacttggaagtctttcactcagtgatttttcctctctcctctttctggtgatgaatctgctattcaagtgacagtgtctttattctttgtgtcattgctgctctgctgtgttctcccttgtttgctcctgggccttctgcatctgccatgttttctgcgtgttcccctctattacagagagcgaatcccctgtaaagtgtgagtgaggggcctggatgcagtcccattctgtgctgtaggttttggcattgttctcctgtgctcctggccctatggtaggcagtttttcttggtttcctaattgcccacacctttattaatgtacacttggcatggtatgctattggattagccatctcttctctgaggaaatgatttcaagtttcttaatgagtgatacatgaatcatttttggagccctgtaatgttgtttgtaaggcttatctagaacagttcctctttgtcagggaccagccctctgccagtgtgtgcttgtcattgctggaatggatatgaagcacccttatctgctggctaatctcttgctttggatgttgtagggttgaatgcaatgcagttacagaatttggctgcactagctgctgcagctagtgcagctcagaacacaccaagtggtaccaatgctctcactacatccagcagtcccctcagcgtgctcactagttcaggtaagcatgaggatgacccagtgtgccattatgtgccttggacagatgctttgtgtttaaaggcagagtccagagagggaaaatagttaacacctgtttccagagaggtcagattatgagcaacaaattttcaaatgtcatcttttgtacttaagagaaatcttcctgattttcaatgtgctgtggccattatttgtctctgtcctgcaaggacagttgttagaattagtaactgaaaacctctttacaaatagcatacttggatagtgacactttttcttgtatttggcgagaatgccagtgatgggttgaattttaactccttgctttctaatagcagggtcctcacctagctctagcagcagtaattctgtcaaccccatagcctcacttggagccctgcagacattagctggagcaacggctggcctcaatgttggctctttggcaggtaaggggcagcacctggctgtcatcagactattctttgtgcaggtagcacatcttaaccctggtaggggcaccactggaatgattgcagtggcccagtgaagttaaaaataatcatgagggccaggtgtggtggctcacacctctaatcccagcactttgggaggtcaaggtgggcgaatcacgaggtcaggagatcgagaccattctggctaacacggtgaaaccccgtctcccctaaaaatacaaaaaaattagctgggcctggtggcgggcgcctgtagtcctagctacttgggaggctgaggcaggagaatggcatgaaccggggaggcagaagttgcagtgagccaagattgcgccactgcactccagcctgggtgacagagcgagagtccgtctcaaaaaagcatgggatttttaaatcagacctgagttaaatcccacctgtgtccgttagctagctataacttcggaccacctttctaaggacattttctcatctttgaagtgggaataatagaatactttgaaggattgttaaaaattaaatgaggccaggtacagtggctcatacctatagtcccagcagtttgggaggccaaagcaggggatcaccctaggtcacaagttccagaccagcctgagcaacatagtgagaactccatctctacaaaaattatctgggtgtagtggtgcatgcctgtagtcccagctacttgggaggctgaggccgggaggattgcttgagcctgggagcttgaggctgcagtgagctatgattgtaccactgaactccaacctaggtgacagagtgagactctgtctccaaaaaaaaaaaaaaaaattagaacataggtaaagtgctgctgagcacattgcatagtacagtagatgacacatagaatgtacttagtacctgttagttgctgttttaatggtagggttcacccacatcttgtcagaaatcacatgtacccctttgagtttgcagtcttgggcctcttcttttatgacattctagctcattatgagaaagtggcagaatagccagatagaaaatggaggctctcattccacagattggatgaaggtaatggggagcacaacacccgcgtatggcatttcttaatgtccccattagcaaggcctggtgaatgtcctgaaatctagccagtcagatagtttcttctcagggagaaactaagagggagataaaggggagaactttggagttttccctcttctagatgtcccaagtagacttgtctttggcatcagtttagtctttctagtatattaatccttctcttcctccaaccaaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtgagtgcaaagggagatcggggtcaggtatggggggcggttttcctcctataccagaacggaaaggcagagcaaaggctgagggaaccagttaggtcgtcagaccattgtttttctttgacagtgtcaagtgtagactgagaaaccctgtgaagtgtgatctgctttttaaatgttttctggatgtggctcaaatcagaacctctgtgtgccctcttgggatggggctgcagtttttagatgaagcaacagacactgaccttatcgggtctgacacatttgacaagaatgtttctgttaggaggtcttctctacagattacaaatctatcagaggatcttctgtctggatgtcttctgtttcagtgtcccttttagctatatcatttggcattttcctcactttctgattgatgtttgtcctgattgaagacaaactgaggggtgatgggacagagtttggcccatgagttgatggagtgggaagtatgtcgtttgacacaaatggtattcaatttaggagaaaaataggagagactctttagccagaaagaggcctgaaggtgacttacatgaatagaaggtcctgctgacacctctgtgctcagatttgactgggtttttataaccaggagctggtataagcactaatgtaggaaaaagatgagtgtcctcttgtcacagcagaaagtcctggttcatctctcctcacctgctgtgaatcacttatatcccctagggatgtggtagtaggagaatgtagcgtgaaccaatattttagtggagactgtggagacagacaataaataaatgaaagcatgaggtgtttcagatgatcctctggagaatgacaagccgggaagagagatagggagtgtcagaggcactgcattttatgcagaatgctcagagaatgtctctctagattgacatttaagcagagaactgaaggaagtaggaagcaagtcatgcctgaatctagagaaagaagagtaacaggggcataggaaaagcaagtacagaggccctgaggcagcaatgttccctgatgtgtttgaaaaaaacagggaggccagggtggctggagaatggctggactgcaattgtaataaagctttttggttagaaaatcattgagtaggctgggcgcagtggctcgcgcctgtaatcccagcactttgagaggccaaggcaggcagatcatgagatcaggagttcgagaccagcctgaccaacatggtgaaaccccatcgctactaaaaatacgccaggcatggtggcgcctgcctgtaatcccagctactcgggaggctgaggcaggagaattgcttgaacccgggaggcggaggttgcagtgacctgagttcacgccactgcactccaacctgggcaacagagtgagcctctatctcaaaaaaaaagaaagaaaaaaaaagaaaatcattgagtgtaaatagtcagatgaagaatgtatattctgtttttaagctcagtgttaatcatgggtgcatttttaaaactaatttcttattttcccatttacatatgatgaaactcactgattttggcatacagctatatgagtattgacaaacagtcctagtcctgcaaccatcaccacagattaggaacatttccatcacccctagaaattccctcgtgcccctttgtagtcattccctgcatctggcaactaccaatctgtttgctgtccctgtggtttctaggcattatttggaaacctgttttgtttataaccccttttcacctcctcttctgtgttcctctctgagcctacagtctctgttttcctgctccacacacaagtcggcctgctttattatcccaacactcctcctcctgcgggtagaatttctcacatcctcaatgagatggagcttggctgaatgtgagggaaggaatctgttttaatgtttgcctttggttccttgctttgtatttagagaatctgtttagttccccagatgaatctctgtttttagggattgtgacagttttaacataggtggaaatgaaagatcactggtgcagggcgacgagcatgtttgacactgatacttttccaattcctgggtattttgaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggtatgttggcttctctctggtgtcaggatgggattagtattttaccactgagaaagaaggagctcactgcagaaagatctgaatatgagtttgtggtgttgttttaacttggccatgggcaggtcattatgacctctttttgagccccagtttctcattgctgtagtggaggtaaggatttctacccacactgttgctccagagagaaaaataatatatggaaaatggtttgcaaaaaaacctttaaacagtccaggtttgtgcctgtaagtcccagtacttggggaggccaaggcaggaggatcgcttgagcctaggagttcgagaccagcctgagcaacagagtgagacctcatggctacaaaaaattagtcagacgtggtggcgtgtacctgtgttcccagctacttgaggctgaggtgagaggatcacctgagcccaggaggccaaggttgcagtgaaccatggtcacaccactgtactccaccctgggtgacagagcaagaccctgtctcaagaaaaagaaaaaaacctttaaattaccatgtagctgttaagtggtactattaagaacctaatttatttcgtatgacataatgtccagatttcttgtccctgctgaataaaattgggatttgagatgaagcacataaggtatcttgcataaggaggactgagaatctccttgcctcattatgtccctcacctaggtttctgcttggacacacaggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgacca

SEQ ID NO: 13934 - DNA, 11667 bp, Human
gagaatggcgtgaacccgggaggcggagcttgcagtgagccgagatcccgccactgcactccagcctgggcgacagagcgaaactccgtctcaaaaaaaaaaaaaaaaaaaaaaagatggctcagaagagcctacctaaaagttggttaaggggagaatgtctgcatccctcctaggcccaggctggaggctttctaaacatattcgtatttgtcaggatctccaaaagtaggccccagaatgggacccaactgacccaggcatagtgggaccagcacagattggacagtctttcccctctgggcttcttggctcctatcgggcaactcaaagtgagaatttggggtcagcagtcctagtgctgccagtgactcactgaataacctccagcaaggcacttaacctctctgagcctccctatgcttatttaaagttgagaatggtaattcagtctgtccacaaggcaggcttgttgagagaatggaataaagcactgttacttgaggagacgctttgtcagcctgagtgagcagctgtacatgttgttatttaaagaaaaaaattctgctttcaaccgtgttccaaaaaaaactactgcaaaggctaggtgtagtggttcatgcctatagtaccaacactttaggaggctgaggcaggaagatcacttacgcccaggagtttgagaccagcctggtcaacatggtgaaaccttgtctctactaaaaatacaaaaattagttgggcgtggtggtgggtgcctgtaatcccagctacttgagaggctgaggcaggagaatccattgaacccgggaggcggaggttgcggtagggagagaccgcgccactgcattccagcctgggcgacagagcgagactccgtctcaaaaaacaaaaaacaaacaagcaaacaaaaaaaaggcaacgattgcacagattttcatcaggttaacagagtgtttgtgatggtttgacttgaaatataagctatgttgcttacatgaagttccctttaaaggggctccagggctcacctcaaaggataaggagagatcatttaaaatagccgacaagggtacaacgaatgagtctcccatgatccggagacccgctctgctcactgagattactaaccatggtcagagaaaacaaacaattgcagatacgagacataattttttttgagacggagtctcgctctgtcgcccaggctggagtgcagtggcgcgatcacggctcactgcaagctccgcctccgaggttcatgccattctcctggctcagcccggagtagctgggactacgggcgcccaccaccacgcccggctaattttttgtatatttagtagagacggggtttcaccgtgttagccaggatggtctcgatctcctgacctcgtgatccgcccgcctcggcctcccaaagtgctgggattacaggcgtgagccaccgcgcccggcccgagtcataatgtttttaatcgtagaggctgatggtcaattgagttcttcccacgtggacaattccgtgaagcctgctctgacgttaggagcagcagcgatttctctttaaagctggttaatgattccctcccgtaactccgggtggccagcttgtacttaaataattgtaaaaatgcggactgaggtggcatgcctttttggccctttgcacacggctggcctatgtcgtttattaattgggaggcagtgtcattgtgtaaatccccttattcctagcggggtcacggtctgagtttgaacgcgcccctccgcaagcatctgtcacgggccagattaaagactacatttcccaaaggccctcgcggatcccacccttctccctccctttccggttttacacataggccccgcccccaacgcgcgtgtcggccaatagcggccccacctctcgcgcccggcaaaaataggacgcgggcgggaacgtttcggggtccgcgggggcggggcctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgaggtgggcaccgggcgagctggcggtccgggaaccggggcccgcagggagacgccattgacaagagggaaggaggtggctgggggtcaaggtctggcccgatcccggggacggggttgtttgggatgtgggcaggggtcctgactccatcctggttttatgggcgtggaaactgaggctgtgagtgggttcggagaacgagggatgcttgtcctgagtaaaagtaaatatataaataaacaaataattttttacagcaagatggaattggggaggaggtgctcaagatgtccacggaggagatcatccagcgcacacggctgctggacagtgagatcaaggtgggcgcacagctcctgtgcgggcgatggagcccccacaggacaggccccggcgatccgagtcgcctctcgtacttcctaatcgggcaccctgggggagacatggggctcgggcttccccctcatatcaggaagagaggaaagaaaactaagccttaaaagggacaagaagacaggtagggggtggtgggaggcctgggctgagatgagaagttatcagattgcctttcccagtgagaactgggaataatcctctcaagaatccttcttttagtaaaatgcctattttacagatgaggagacaggcccagagaggtttgtactgcgataaagcacccagttcttactatgaggcagaacctaaaacctatgtttgcctctctcggaggcctgcttttattccaatactaccactatttcaccaggaggtttccaaactggcctcctcttttgacttctgcaggatgtggacacagtcagactctgccttcagagagcctcagagctggatgaatggatgcgggagggtcccctgggcaccctggacctcactagttacagggctctagcataagctgtgccagggtttatatttgcttctcctcccctcctgatctcagatcatgaagagtgaagtgttgagagtcacccatgagctccaagccatgaaggacaagataaaagagaacagtgagaaaatcaaagtgaacaagaccctgccgtaccttgtctccaacgtcatcgaggtgtgtgtgtatgtggaggggaagagagggagtcagcagggaatggggacagcctggggtggggccactagggaaagagtgggtggaggtattgaggccaaactgcatgtcagagctacacctcctggggcactttcatggggaagacggggcctgcaaagtcctgggaggtctcacgtgtctccttttctgttggttatgtctcctccggggtagatgagccctgtgcagaggagcagcacctacacagagatcaatccctgggcttagcaggggcacccacgtttggtgggctcagggctattggaggagggaggtaaggatggccagccctgcaggtattaggaactgtcttaggaagcactgggccttggggagttcaaggagctgagtattttttccttcccagctcctggatgttgatcctaatgaccaagaggaggatggtgccaatattgacctggactcccagaggaagggcaagtgtgctgtgatcaaaacctctacacgacaggtgagcgtggctcagcaatgagagactggaggagggtgaggagcggatgtgggacaggactagggagccttccctgaggacactaactgagactgcccctgtaacttgtccacagacgtacttccttcctgtgattgggttggtggatgctgaaaagctaaagccaggagacctggtggtgagtggggcctgagcccaggcagtgcttttctggtgactagctgagcccctgtacccgccccaggtcactgttggctctgaatcttggcagaacagctccgagagtctgggattctgtctacttgctgtttgattcttgtattgcccagtcctgtgtctttccctctgcagacacctgtcacccagtcagttgggtagcccttgagctgggccaaatctgaaggccctgtgctgtgtccttagggtgtgaacaaagactcctatctgatcctggagacgctgcccacagagtatgactcgcgggtgaaggccatggaggtagacgagaggcccacggagcaatacagtgacattgggggtttggacaagcagatccaggaggtgagggaggcacggcagctgccagcagccttgtcagccttttagtttctccacgccattgatgcagctcatctccctaatgtgtctttcatcctcatagcaacctagggaggaagggaggggtgccatgtgacaggtgaggagactgaagcccagagagtttaaatgccttgcccaggatcacagagagaccagagccaggactggagcccaggctcctggttcttggcccagtgtccttttttttttttttccgagatggagttttgcttttactgcccatgctggagtgcaatggcacgatctcggctcaccgcaacctctgcctcccgggttcaagcaattctgcctcagcctctcgagtagctgggattacaggcatgcgacaccaagcctggctaattttagcggagtatttttagtagagacggggtttctccatgttggtcaggctggtctcgaactcccaacctcaggtgatccgcgtgccttggcctcccaaagtgctgggattacaggcatgagccactgctcccagcccctggcccggtgtcttttctgccatatactcccgttcctggagagtccatagccagcctgggtggggatgagtgttctgtgtcctcttttttttttttttgtgacggagtcttgctctgccgctcaggctggctggtgtgcagtggcgtgatcttggctcactacgagctccgcgtcccgggttcatgccattctcctgcctcagcctcctgagtagctgggactacaggcacccgaccaccccgcccggctaatgtttttgtatttttagtagagacggagtttcaccgtgttagccaggatggtctcgatctcctgaccttgtgatccgcccgcctcagcctcccaaagtgctaggattacaggcgtgagccaccgcgcccagccttgtgtcctcttgatatggggaaagaaatgggcgtgtccctgagttagagtaggagggatgcagattggggttggagccatgaagggttgggctgtagaagccctcagggcttcatctcctcacccaggacttcctcctggcagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggtgagtactttgggagggatgcgggggaagtgggcaggagcagaaactctaccagatgggctcaaagggtctgcctttgacctgactctaccaccttttcctgccaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcggtaagggagggccaagggtccctagcgatctctgtggcggtaaggggaagcgggttgactctcagttgtgctaaattgtggttccttcccaccctgtatcccctcctgcccctggatggtggctcctcaactcttgagattccaattcctaactcctgatcaatagcctccctgtttccccagccattcattcccacagctgccagcatgttcctttcaaaacaggaatctgggccgggcacggctggctcacgcctgtaatcccagcactttgggaggccgaggcaggcggatcacgaggtcaggagatcgagaccatcctggctaacatggtgaaaccctgtctctactaaaaatacaaaaaattagctgggcgtggtagcaggcgcctgtagtcccagatgcctgggaggctgaggcacaagaatcacttgaacctgggaggcagagattggagtgagccaagattgcgccactgcactccagcctggtgaaagagtgagactctgtctcaaaaaaaaaaaaagaaaagaaaacaaaaaagccaaagcaggaatctggccacctcgctcacatgaacccacagtggtccctgacataaaccaatcctgttaaaaaccctggctgggtgcagtggctcactcctgtattccctacactttggaaggctgaggtgggcagatcacttgaggtcaggaattcgagaccagcctggccaacatggtgaaacacatctctactaaaaatagaaaaattagccgggtgtggtggtgtgcgcctgtaattccagctacttgggaggctgaggcaggagaatcacttgaacttgggaggcggaggttgcagtgggctgagattgtgccactgtgctccggcctggatgacagagtgagcctctgtttcaaaaaaaaaaaaaaaatcaaactttcctgggcctccctgttgctccctgggataaatgctggaattacaaggctcaacgtgtgctgcctttttgcgccttcaccctcatctcatgcctgtccccagcctcccctgctctggactcctgccacggtgcttcctgcgtttcaggcccgccgtggctcttaccctgttctccactggttggttgcctagctggtgtgctttcaaccttcagatctcagcctcagggatacttcccgggggatgcctgcctgggctctcctgtacagcaccgtccaaggctgggccagatacctgtgtttttaagcgttagctcagtttgcaagtgtacattcatcacagttaacagcccaagcagtggttggttttgcttttttttttttttttttttttttttgagatggagtctcgctctgtcgtccaggctggagtgcagtggcgtgatctcggctcactgcaacctccacctcccgggttcaagtaattctgcctcagtgtcccgagtagctgagattacaggtggctgccaccacgcctggctaatttttgtatttttagtagagatggggtttcaccatctcacctggttggccaggctggtctcgaactcctgacctcaggtgataggcccaccttggcctcccaaagtgctgggattacaggcatgagccaccacacccagccttgctcactgttttatcctcagcccagcacctgattctaggagtctcttcagtctctgaatgtggtcaacaattaatgacactttttatgtgccagtccctgggctgggggccccaagttgagtgagccatttccctgccctggacgggttaggttaggcttccagggggtagaggaggggagggctctgcctaagctgtgccctcaccagcatctcgggcttcctgtgccctagctttgacagtgagaaggctggggaccgggaggtgcagaggacaatgctggagcttctgaaccagctggatggcttccagcccaacacccaagttaaggtgagtattagcactcccaggcaaagatgatgaggctcagaggtcaggagctgtcaggcccccagctagccagtggtggagctggaatgagaattgggatctgtctttaacatcccatgtgtctcacctgcactctgggggctgcctctctgccttttttgaccgtgtctgcccatctgtgaacaccttgctcctttcaagttgtggcttctcttcctcaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcaggtgagcaggagcacgggcagggcacagagacctgaacaggcgcaggaggatgtctctgccatgcttctctgtactgatcttccccagcctccacgaccaccacctcccaggccccaggcacacacagcaccgttccacacgccagcctccgtttctcctcagttgtgtgatgtagcgtcttgccagggcccatgtcgtaattctgggtgctctgctccttagactccacccctcatctgaaggcacagaggctggaggcacttagtttcctggcctcacacctcagcccattaacacacgctaggaatggccgggaccagatggacttgagttcagatatgtatgactctcagcaggtggcatgccctctctcagccttacttttttttttttttttaatttttggagacagtgtctcgctctgtcgcccaggctggagtacagtggcgcgatctcggctcactgcaagctccgcctcctgggttcacgccattctcctgcctcagcctcccgagtagctgggactacaggcgcccgccaccatacccggctaattttttgtatttttagtagagacgaggtttcaccttgttagccagaatggtctcgatttcctgaccttgtgatccgcccaccttggcctcccaaagtgctgggattataggcatgagccaccacgcccggcctcagcctcacttttcttatttgggacttggggatgatagcactgatttcacagggtcgtggtaaggattagatgtgacagtgtcaagcgcagtgctgggcacaggatgaggacagtcagtccctggagtcccagatgcagatttctagaaggccagagctcaagagaccctagaaataacctgttataacctgcattaacttcctcccttcatcccccacatcttgtactgagaagaaaacaaggcgcattgagtaagggacttgcctctgatcacagggcaacttgactttgttgcttgacggggccaggggaggatatttggcccctctgcccattccgcataagccactgagcctgtggtatctgtcctgtccccagtcctgacgtgaactacgaggagctggcccgctgcacagatgacttcaatggggcccagtgcaaggctgtgtgtgtggaggcggtgagtggtcagctggggtgggtgcgttgctttgtgccttcttgccccctccctggacaggatgggggcatttggctggtggagacggctgagggaagaggcctgagcctcagggagccagggaaggcattcaggcgttcagacctagactctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgccgctgcttgtctgccttccctgggctctggctggaggagtgggggcgtgtgtgggaggcaccttccccaggtgctgacgcctggaaacccggagacagccgtgggccccataccactggtcaggatgaggctttctggggctgtgtgtggtgctgcagctgctgcctgggccttcaggcccctcagagccctctctccccgagcaccactctgctctgagctttcagaggctcatggccctgcagttcctgcacagaggacctggatagaagccaccctttcactttcggcattttggtgtctggcactagtccttgcctcctggtaaagccaggcttgggtttaggctttcagcatcctcccttgtttcctggcccttgggtccccttttctccagatacccccttagctctttctctccctatctttggccaaaaactgagcctgaacaggatccactgggagcccctctaggactggtctgtcacgctgtgctcccctcccccaattctgccatctcttcactccagctggccccttgccttccctgggtggccctgcttggcttcccactgactccccagcccctgcctcaggagtccagcagcacaacccctgaagtgcttctgtttctgtcccctgccctggacttggccgccccagtcctccattcctgttctctcttctaaccggacagggcatttgctcctgaccatgacacccaagttcccccacagggaccacacccaccctgctttgggttcctcatctctaaaatggggcccccggcctcttccagtgggctgtgatgcttgcacgcactgtctgccatccagcagggcttggcaccccagctagcagccctgagcacctgcataggtgaggggggcagccggctgggacggccatggctcattccttggatctgaggccaggagtcaatgggtccttgagacagttatcttacgggatgtgttgcagctaggtgaagcaaatactatgttgttttaaaatgttttgctgatagaaatactgacagccaagcactcccagctaaggacatcactggggtttcacacccacctctcccacgctccatgacactgcccagactgcagatcccagccagtgggctattgacggtggtcctgggagggaagaggtggactggacacccccacccccattctcttgacaggactggggaaggggcgccctgcgcctggtgttcttatactccacacattcagaagggagggtgtgtggttttgaataagggtcccatattcttttttcttcttttctctttcttttttatttatttatttttgagatggagtcttgctctgtcacccgggctggagtgcagtggtgtgatctcagctcactacagcctccgcctctgggttcaagcaattctgcctcagcttcctgagtaggtgagattacaggcacgtgccaccgcgcctggctaatttttgtatctttagtagagacagggtttcaccttattggccaggctggtctcgaactgctgacctcgcgatccccctaccttggcctcccaaagttctggcattacaggcgtgcgaccacatccggcctttcttttttaagcgaatgagagcttaatttcactgaggccaaacctagagatgactttgtggctggagctcccttccctgataacattttcagtcaaggtggaatggggggcaggtggggaaaatgctccagctttcaggtctataaggacagcactaactgggtgcggtggctcacacctgtaagcccagcactttgggaggctgaggcgggcagatcacaaggtcaggagttcaagaccagcctggccaatatggcaaaaccctatctctacttttaaaaaaaagccaggcgtggtggcacacacctgtaaatcccagctacttgggaggttgaggcaggagaattgcttgaacccaggaggcggaggttgcagtgagccaagaccg

SEQ ID NO: 13935 - DNA, 7336 bp, Human
tgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagataccttttctctttgtgtttctttttaattcatgaaatactgcaggtcctgcactggtcctgggatgtagatgttaactgtatttaaccagattcctttccagtgtacctggaaagagagttaaatacgcagtcagtacacagtgaaacagctctatctgggaggagggaagccccagggacagctggatcccacaggagatacctgacaaggactaagaggaggcttcccagagggcataacacctatgctggatcttttggaggaaaaaataattgtcaggagaaaaggagtgaaaaagacctttgggcttaaacatgaaccaacatggcggatgcttcaagcaagtggggttgctgggccctaaaggtggagaggggtgaaatgaaaagactcgcctcttcttccccacatttgttgagaatctggtcacagtggcattgtcgagggtattgaaggtgaacaaaggagatgtggtccctgccctcagggaatgcctagtctaatggtggaggcagagctgtaagctaacaaggtaacccagacaaagtgggcatcagtcatgtgttctacaaatatgtactgaggacacactctgtgccaggtactggaaatacagcagtgagcgacacaaaagccatggtgcttccactcttccaggggagttggacaaataaaatacttagtatgccaaatggtgatcagtaagtaccgtgagaaatgtaaagctgggaagcagaggagcgtttaagcggggtggaatattaaacagaatggtcagagaaggccttttcaagaaggtgagcaaaaactgaaaggaagttacaggatgagccgcatgtatagttaggagaagcagagagagcaagtgcaagggcagtgaggtcgcggtatggttggcacgttcaaagaaatagcaaggagggcagtgcagccagaggagggagttagtgggggaatattagaaggtgaagtcagctgaggggcgtggggagcctagcaggctattgtgagaactttggcttttctcctgaatgaaatgggagccatcagggcatttcgacagggtagtgacatcttactgaagcttaataagcatcaccaggacatcgcaggagcccagcaaacgcgcttccctgccactgggttagggaaggcttgccggaaggacgatttcggaggacagcaggtgttagccaggcagcggagcgagcgccaacaggcgcactggggcggagagacgccgtgagcaaggtgaggcagagggcacgcgcggcgccacccgccacaggctaggacgcacggctgccagagaggacgccttaggggcccgcgagcaggctcgggaataaaacagggctggcagggcgaggtggagagactcgagaaggaccggccagatgtcgaagttcctagagaggagggcgcccaagcctccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggtaagggagggcagggggaggattccccttgaagcttcttccctgcagcctctcttcttttctctggtctgagtccctcccccacaccactgcctgcctgggacatggacctttgggaaatacgcggtcagttgttgcctgtagaactggtggtggggttgaagggggtttgaggggttaagattttgtgctccgcttccctgctagagctgaactgctttcttctctgcttccacaacaggttcctgacggagacttcgcccttcatgtggtccaacctgggcattggcctagctatctccctgtctgtggttggggcagcctggtgagtattggggtggtgggactgggggcaggggctgagtcatggcaggtggtgtcactggggtcttaggcatgctgagggcagtgacagcttgggctctgctcatcagttttttatccttccaccaggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgccaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcagtgcagcttctgttgccctcttgcgtcaccgttcacagaggaagggtaaagaggcctgtacgcctcagcctcatgccaatcccttgtcagctttctgactgcacacttctgatctgcacagagcttgctcctaggtggggaggcacgggtgctgggtggactctaacccccaaacagacttgtttggggatgagggagtgtgcagataggggcccctgggtgtgtttgtgcctgtagtccttctaggcccgtttgctcagggctctgactgaccaccatgcccgaattgtctgacagcatctacttacctggttgtacagtcgggcaccatcatctccgtccttgtgaggcctggagcctaggcagtggtctctgcctccagtgatggtcctgtccttctagcagcagcccctcccagaaacctctactctgatccttgttcccagggcccagggcagctcctcccaccccatccaatctcgttttctccttccctgaccctgtttcctgttaccccagaagccccagccacctccagcccacgcctttaagggtcctgccccctctctgctggccgaccttgaatcttggtccaattaaagagttgacaaatccctagccccgcagcctgagtccgcccaacctccaggtccccttcctggggagttcgcgctccaatgcaatccccactccccgctaagggactccacggtctgcacccgctcgccggtccgacctctaagcccaccctttggacgagcctgacccatttcctcccgcgctcccaggtccgtgcctcctgggtgcccgggttcggccgccggcagggcgggctcgcagcggcgcgcggcgggtgcgggcgtgctggaggcgggggccgcgggggcgcgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggtgagaggagggcgcgcgcggcccccacccagggccccgagattccagacccagccccgcgaggggcaccccgagcgcggccccgagatcccaacccaggagccggtgagagaggcgccggcggccagaccccggcctggctgcccccaccccgcccccactccggcgcccctcctgggcttctccgcccgcgtccagccggcctccctcattgtcctcgctcgccccggcctcgtggcgcggggaggcgttccatacacgtttccccttggcctttgcctcatccgctgccctccacccactccccctgcccccaggctccacacccacccggtctgtgcggcctgcccgtccgcgggtgccacgtgttcagcctgccagccccgcccaaacgcacccctcagcctggccgccagcctgacccagaacccctgcgccggagggagggtgggaatgtctgcacgtgggtctgggtgtgagctgtctgagagtctggatgtatggctgtggaagtccaggagcagtggccttgtttgtgagtgtgggacttagtgtgttactgtcacccgggtgtgtctgtgactgtagttctctgtgtgtctgagtgtgggtgaccagctgggaccagggtgtccctgtgattctgtgtgcctgtgagactcaccctgctccctgaagcactgccagaagtggctgccgctctcttggaaccacagctggagccatcgcccaggcaagacccccttcctgccatgcccagtgctgtgcccatctccaggccca

SEQ ID NO: 13936 - DNA, 23825 bp, Human
gataataatggacctacctcatgggacagctgggaggacccaatgagttaagatatgggaagttaacttgtaccatactaggtgagtgcccacagggtgatgggctgtctgtgaagcaagcgtcccatgtatgctgagccaggacagtgcctggcccacagcaagcacttactatgtattttctattaccattattactaatgctcactagattcaatgattggtgggtggtttccccgttttagagatggagaaactgagatccgacatgttaatggacttgcctaaggttatatatggtgagaaactgacaaagctagggtttgaacccaggactgtcaaactctaaaggctgtgactttttatcttattttaaaatttattttttattaattttttgaaacaaggtctcactttgtcacccagtttggagtgcagtggtgtgatcatagctcactacaacttccaacgtctgggctcaagcaaaactccctcctcagtctcctgagtagctgggactataggtacacaccaccacaccttgccagttttttgtagagacacggtctcactatgttgcccaggctggtcatgaactcctgacctcaagcgaccctcctgccttggcttcccaaagcactggcattacaggcctaagccactgtgccccacctgtctttttatttttatttattattattattattattattattattattattattattttagagagagagttttgctcttgctgcccaggctggaatgcaatggcgcgatctcggctcactgcaacctccacctcccgggttcaagcgattctcccgcctcagcctcccgagtagctgggattacaggcatgtgccaccacgcccagctaattttgtatttttagtagagatggggttggtctcaccatgttggtcaggttggtctcaaactcctgaccttgtgatctgccctcctcagcctcccaaagtgctgggattacaggcgtgagccaccgtacctggccctgtttttaaatttttaatgtcatcctgtgcttgacaaaactccttatgttccctacggggttgccacactcaccaaactcacaggaaagctgttcttacaccagaattcatgcacgtgtccatctgactgatatttcctgaggtcctgtggtaagccaggccttctgctgactgaccagtttccaaagggcctgacacattcctggcaccggaatgcatatgcccaccttccgagccactggtctgaggtatcttggggtcagcaggagactggccagtgtgtgtggcctcagagaaagggactggatgggtctgagtggcatcccactacagtagtggtgactatagtcatggtgacgacaccactggacctaccagcccacgccacgcacactcccagactagcacctcagcttctgggcatcacggtgcaaatcctcacgggttcttattccacagtccccctttgtctggactctgggatgacttgcccccttggctaatgccatctttgtccagacagctgacagcgtggttcactaggccagggctttcttgcatggtcagttgcattctcctaggaagacgccccatcaccctggcagtttgggagtccccatctctggttggtggggggtgtcaggtacagccctagggcttggtttctcccagcccgcacccctccgtggagcctgagctgctctggtggtgccctgtggactgtgccttccatcctcctgccggtcaccatccagggcccaatggggcagaccccgtcactcatcagacacccaactaccctagcaggagcccacccagtgctaggcctgtgggctcagacagcgtctggtcagctccgtggggggagtgagccaccctctcgcctgctctgccccagtctgtgtgtgtgtgtgtgtgtgtgtgtgtgtgtgtgtgtgttgttccagttacttgctgggaacaagggaaaaacacaacaaaccccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgtgaatgagcggcggagacacgcgggctgcgatcgctcgccccaggatggccgcggctcatggacctgtggccccctcttccccagaacaggtcagtcaccttccaggaagttgagccccctccttggtgccaggcaggctgagaggctgggctgcggatggggagaggggctgagtggtctgtgccagggaggggcaggcacagccagcaagcaagacagacaccagccaaagtgacccagaaagttgcaactgtgcaaaggagtgtaggaagagttagctgtgtggtgggggtgagggggaggagagtgggggtgtgagggctcccccagcccaaggacctgctgagaatctgctctgtgtatcaaagctgcattgtcctagctcccggggagacgggccggaggtgcccaggaattgtactaatcaatacagcctcattgtctgtgccacggcagttactcctatgggaagagtgggtgagggggcaggggaacgtggtacatggtttcagtggcaaggggtgggggaaggggatggggcaagagtctcagctgggaagagagagaccccacagaacattttccagggtccagggcaagtgcccgcatgggctgggagccggtgtgtcctcatccctggacgccggggacgggtggagatgtcagcggatggcagcgagggtgaggagactcgaaagctacacttctcccctgtaggacatcctgacttgaccttcaaaaggcaagagagggaatgtcctctgaggcgatgtgggatgggtctgggaggaacagtacgcagggctgccctcaagcctcagtactgctagggtcaagaaccaaagccactttccagagtgcctgcctgctgctagccagtgagggtagacgccgcccccagccgctgcagcacaggacatgaccattgcctccagtcttccctcctgggcttgtctggggtgggaagcgaggagctggccagggtccacccagggtcctccatcactcaccccagggcctggagtggagcccggcatgcctgggggtgccagtcatctgtctgcagcccacaatattggcaggtcccttgctgccagtcagggctctgcaatggataagcacaaggcgtattcttgcctctctcatctgctatatgaaggcctggactctgaaggcacctggagtcctgagaggtgcccagagatggctctgaggtttgccttgaggcaggaggcatgaatggccactgggggctgctcggcccgggggagattttcccatgttctgcccctccaccccggccccagactctcccgtatccaggtaactgaggccagagatcagagctgcagctgggtctctctgcccctactcagtgccatgtaggtgaaggacagaagattctgtcattgcagggtaggtgctgcctgtgggccaggctgggccctgcactgataggagagaacaaaaactgaggggtgcctggccggaaggaggtcgtggggtcttctgaggcagccacaatttactgtaatggctgttctgtctagattccccattggggcttagagaaagttgccagtgatctgatttggctcaaagtcagtctgggatgtgaggtcttgcccattctcctccataaagtttgtcttggatgggacttcatcccatgagcaaaccctggggctggagagtcctaaacacaaagcctgctgggtcccagaggggcccgcccatccagggcagctccaggattcctcagtgtccacccagagcaggagggggaagctcacaattcacaaaaatatccactggccactgatctaggaggcgggagtgtcacaccagagcacagtcaccgtccagggtggagagctgggctccctgagtctgtgcaacagcaaaaggcaggagtgcatcctggggctggcccggttcgctctgggagtaggctttgttgctgcatttcctctttacctttttctgtattttctaatttttttgtgtgtgatagcttattatgcttttataatcaggaaaaaaaagggcaaaattgtttttagtaatctagaaagctagtgggaactaatggaatgtacaggggaaagtcagaaatagcaaaattccaggtgagggagagctatggaatatgagtagctacagaggctatctagcctgggaatctggcagatcgattgaaagtgaggttatctagtctatggccataccatcctgaacgcacccgatcttgtctgatagtgaggttatctagtctgtcccctgcttttgtagacagcagtgctgagataccaagagtggaagtggcttgcccagggctctactggaggagcgggccctagagcaccagggctctcacctgcaccggtgtcccgcctctgccaagcccagggctgagtgggagatctggattctgccctcggagctgagcagccttaattccaggggctcagccagagcagtaaataagccaagcagagggctgtgtaaaggacttatgtaagtgactttgctcagtgtggctctcccagctaggcagggaaggggtgggaggctgttaaaccaggaaagatcataagtccttgtgccagggtggacactcctgtctcaatgactggttctaagggtaagggaacatctgaggggtgtgtgtgtgtgtgtatgggtgtatatgtgtcagccagctcaccccaccccgccatggaaggaaagcctccattccttccatggctgggagagcttggggacagggcagggtagtcctgtcctggagaccacctgctgagcccatggcagtggcaagtggaggctgctttgtcctggcagtggcctctcagagctgccaggaagggtgacagggcacataggggctgcctagggagcctgcagaagagggggccaagccagagggaaccatgccgctatggtttaattccccactgagatgtcagcaagtgagtgagggtgagcagaggggggcagatggtggtgatggtggtgggggttaggagaagcctggagcagagcccatccatggggctgagctggctcaggcagacgggcagccagtctgagtcaaatcgtgagcacaaagggatttttccgtgggtacctcagctgatgaccactgcagggacagttcatatcagtgacacagccgtccacccagcagatcaagaaaaactagaggcttagaataggaaagattatgcaaggagggagaaaaaaagccatacagtattgaaaaagatttagctgctcaggagggaagtcagagggtggtccccagaggagatctggacaaggaagggaactagaacacccagaaagtgcctggatttttttttggagagtctttcctccagtttgcttggagaaaggtaggcctgctctgtcgtccgctgagagctcagccctccccagccaagccacctgagcgtagacagccctggagttgaagacagaggccaagcctgggccagattcccgtggtcgagcgccacagtgctgggacccaggcccaagcagaagtgggtgctgcttctgcaaggatcctctgcatacagcagacctttagtgttgtcagaaacttcctgccagagccccgtcgccaaccccggttcagccctgtcgcgggggctgtggcctccctgggttacagcccgcacggctaagctggttagcacacggctcattaacggagcagtggctggctcttgagggctcaggcaggcggctgtctgtggcacgtggctggaagcatcaccaccttccccgtacctccccctgccagggaaggagcagacttcagggatccaaatgtggtcccacttggtcagggggtatggggcatctgtccctcatcctgctgggaacaggagacaggccttgatcttcaagccttgggaacctggatctctgcaaagggccttgcccttaccctgcccatgggtccatcctggaccatcagttgtcccttttacagctgtaactgctgctctgtgaccccatccgtgtactgtgctgctggcacaatcaggcattgtgcccctaagtaaacaaccctgggacagaataaaactggtattgtagggtcaacatataggagccctatttggctggcatttgtttgggaccagatagaccacccccagcaggcctcacaccctccaaaaaatgggcccttgactctgtgatcttgccacacctgccccagtgaaggccccaggaggtggtgacatgctcagacaggattctgtaggggcatgtcacagagggcacactcaggccggggggcaccctctaccagggccaagcatgtcttcaagcctcttcatcagggagaccttccttgacctcagccctgctttcctgccttgtcctccttccatactcttgtgattttgagatgatcccctctgtggtcaccctgaagccacatctaaagatgatgggtgtatacatttcattgcacccccactagatttccagctccgaatgggtaggagctctctgctgaagtcccacttcctggcacagtgcctggcacatagccagtgtcaataaatctgccattgcatgaatgaatcaatgaatgaatgaaagaaggcttgttcagccactgatttgctctgggtgctccttgaaggaaacccatggtccctggcactgcacccctgccctctgtggagggtgtgaggatcacatctcggcagggtcgatgctggattgagagcacagggtggctgccccacaaaggtgtctgtgctgcagtgcccacccgtcaggccttggtgcctcctttgcccacattcccacctggcctatccaaggcgcttggggcccagggaggccattcattccgtctgtgtttgttcatcagcatcagggtctgatagcatttcacctgcaccaggctgccttgcttattgaccagagtgactgctgtcgaatatgtctctttcaagcggagggtgaatgtcacatcactggcatctctctgaggctacggggctccatctctgatgccaggtctgtctgtttctctcaggggaatagctcacctctgggaggctgtctctggcactaaggtctgtctgtgtttctgttggtgacactgagcccctgtctccttagtgagaccccttggggcccttgggctctgattaatttcctgctcactgtgggagggaggtggaaggagcatggcacttattaagggacttctttaaccaagggacttgcagagccagttccagcttttgggcctggggttccacaaggggctgtcctcagtggggcccaggccaccagctcagtcctgcaggccccacattcttccctggggcaaatccccgcatctgcctctcctgaccttcggccccctcccctgcaggtgacgcttctccctgttcagagatccttcttcctgccacccttttctggagccactccctctacttccctagcagagtctgtcctcaaagtctggcatggggcctacaactctggtctccttccccaactcatggcccagcactccctagccatggcccaggtcagctccccagggcccctccccagccatgggcagtgtagctagctccccggaccctcccacctagagtcccagaatgccctccccatgtctgtcccggctcagctgctcccccatttccccccagccctgcccactctgtgcccccaggaagaagccttcagctgggggaggggtctaacctcccctcccccgcagtcgcctgcccaggggcagcgtgctcagcctggtgatgtggtaggcgacgggtgggggggctgtctggacacaggcccctttgtgcccagcctgacttggctgcttggtatgaggctcagctgctcccagatccttacccagaggggcaaggggaggttttggaggggcttgggggctcctggccctagctccctcttcagtgtcccgcctcccggatgctggtagcagctcctcaggtgggctgtgcacctggcactgggtgctgtggggctggtgagggaagctctgcttggcgccctctggcagccactactctctgcttccctcctttgccaggcctgcctgaagctcctgccagcagaggggaagcccggggaggggtgttggaggggccacggtttccctgctgggggaggcccagagggtcaggcatggagcacaaatgccttgctgatggtagcttctctcctgtccccacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggtacccagtgggcacagggcagggaccacccacttgggtagagcccacccaccagggcctgggccaccctctccctggcacagacccactccagataaaggctggcctctggccctggcctccttcgcccccatccctggcttaggcaccctttgcctaaggcaggccaccccagaccctggcagtctgttgttgggggctggccctgccagttggccccctttgaggtgaggagaggtgagaaaaggacctaacccccccccccccccgcccacaaggctccctgttctattccctggggttcagcagcccccctaaatggttcagggatgttgaggatctcagcaacttatgcttgtgaaatcgcttgtttaaaccatcaaatcccacccaagtatggaggctctggggcctggattccactccaagcagaattcctgagagcctctgtcaagttgaaagacaggctgggggtggtgtgcctcagcccaggctcctgctcaagcctggcacactcctccctgggtcctacccaatcgcgaaggttttgctgttgagttctgagcaggaagcccagggtgagatccctccaagcccactcctgagccagacctctccctgcctaccaggcgccttcatgttcccctacttcatcatgctcatcttctgcgggatccccctcttcttcatggagctctccttcggccagtttgcaagccaggggtgcctgggggtctggaggatcagccccatgttcaaaggtgaggcctgggcggggcactcgctcacacatacacaaacacacaacggcctctgagggccgtgccaactcgcccatctgtacaaacatggctgacctctgtagagccctgatgctgaccccaagccccacatcaacggcctaagccatggatgcatgctgggacccatgtttacttggctgccaccctcccctcctaccacgtgtacacacaaaactcctttgcgccaccccccgccaacttacccctaccaagaccttgacctggccttcctttggccctccatctcagcctgccccttgggcccttagaaattattaacctcgggccaggcacagtggctcacgcctgtaatcccagcactttgggaggccaaggcaggcagatcacctgaggtcaggagtttgagaccagcctgaccaacatggagaaaccccatcttggccgggcgcggtggcttacccctgtaatcccagcactttgggaggccaaggcaggcggatcacaaggtcaggagatcaagaccatactggctaatacggtgaaaccctgtctctactaaaaatacaaaaacaaaattagcttggtgtggtggcaggtgcctgcagtcctagctactctgggggctgaggcgggagaatggcgtgaacccgggaggcagagcttgtagtgagccaagatcatgccacagcactccagcctgggcgacagagggagactccatgtcaaaaaaaaaaaaaaggaaaccccatctctactaaaaatacaaaattatccagatatggtggcgcatgcctctaatcccagctactcgggaggctgaggcaggagaatcgcttgaacctgggaggcggaggttgcagtgagccgagatcgcgccattgcactccagcctgggcaagaaaagcaaaaactccgtctcaaaaaaaaaaaaaaaaaaaaaaaggccgggcgcggtggctcacgcctgtaatcccagcacttcgggaggccgaggcaggcggatcacgaggtcaggagatcaagaccatcctggctaacacagtgaaaccccgtctctactaaaaatacaaaaaaattagccaggcgtggtggtgggcgcctgtagtcccagctactcggtaggttgaggcaggagaatggcatgaacccaggaggtggagcttgcagtgagccaagattccgccactgcactccagcctgggtgtcagagcctgggcaacagagctagactccatctcaaaaaaaaaaaaagaaaagaaaagaaaaaaaagaaattattaacctcacctcctcctgctggatgctgaggctcctccccccacccctcccctcctgcaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggtgaggcacctgcaggacctggggtggggggaacctggtggcaaccctgtccccactgggcaaccatctgaagacaaagtagggtgcctgctgcaggttcagcccgctgctgggctgggagagggtagaggtgagtgaagagtttaggagaagagcctgatgtacagaaagcaatggaagatggaggccgggcacggtggctcatgcctgtaatcccagcactttgggaggccgaggcgggcagatcacgaggtcaggagatcgagaccatcctggctaacacggtgaaaccctgtctctactaaaaatacaaaaagagaaaagaattagccgggcgtggtggcaggcacaggagaatggcgtgaacccgggaggcagagcttgcaatgagctgagatcgcgccactgcacttcagcctgggcgacagagcaagactccatctcaaaaaaaaaaaaaaaagaaagaaagcaatggaagatggaatgttgagttgcaggatctttacagagtagccgtgaggaaggccgtcagaaatccagcaaaccagccttcagaggagactcaggggaaaggggggcagatcctggggagaagaagagtgtgggcaaaggctctgtcccagatgagcagaggctggccccaaagctgaagggagcctactctgatgagagtaacaggtgtggggagaatgcatgggcttcaggtggcctaggaagtggcactgccttcataaagaacttgccaggattaggcttagacttgatgatgcagaacaaaagacgccatggaaggtctctgagccgggggtgccgtgatcaagacatcctggcacattttgttcagaggcgacagagaccagagtctcaggccatcctgctgtgccctccacccaccagttggaaattccctgtgtcttgctggggaacccctgggcagagggctttgggggcatgctggcaggcctccaccatttattccacaacattcacgcctctgctctgccaggccctgtgtccccatggtaggtatgaacagcccagagcccctgtcctgaggagctcacagggcagtggggagacagattgctaatcacagtagggcaagtgcctcggtccaggtatgtgcaggggtgtcacagagacacaaagaggtagtgcttggtgctaaggggatggggcaagaccaggcagtcagagcttcccagagaagggagagaggaaagtagagagattgggaaccacatgagcaggtgagcagaggccagaaggaggcaaactggagctggggttgggagcaggtgggacgctgagtgacaagacagaagaggccagcaggcatcatataacacagggcctcccatgccaggctaagggtttgaggcttttctccacatgtgatggaaagccatggctgaaatgtacaagggtctgaggataccgcaagtcaccacagggcctctaaacccaggtccaagtactctgaccctgaaggactcagcttccctgtgccaacctctgggctgggctgtagacactcaaagacaggtaagacagggccactattctcaaggacccagagcatagagaacacagttgctgtcccccagaggggcatgggcagactcaggcactcagttaccagacaggtcatttcatttgtctttcattttttaatttttaacatcctaacatttattttctttttaaaaaatacacctggaactgaatggacagatgatttcttttttttttttttttttttttttgagacagaatctcgctctgttgcccaggctggagtgcagtggcacgatctcagctcactgcaacctctgcctcccggggtaagcgattctcctgcctcagcctccctagtagctgggattacaagcacccgccaccacgcctggcttgtttttgtatttttagtagagacagggtttcaacatgttggccgggctggtctcgaactcctgacctcaggtgatccacccacctcggcctcccaaagtgctggggttacaggcatgagccaccacacccagctgatttcttgagcacctactaggtaccaggtactgttctcagaggggagagagggcagggaggcagacattgtcctcacggagctgccgtccgatgggagaacgagcagatattgctgagtgaggcgttttattacatttgaggcatgatgtggactggtcaacttgatctagtctggggtgatgaacctttctggaagctcccagaaacacaaagccttgtgcaaccccacccccagatgctccagtggtggttgtcccagggactgactgccagagattcccagccctgggcccacccagggcaaagctctagagattttatccagtaaaatcagaggggaagagccttcaaagaaatctggctggtggagccgctgcactctactccccagcgcgggctggagccaggcctgcctaactggccactgtcccatgcgggataccttcccggcagcacggctccctgctgccctctcctggagatccagggaaatggccctgaagagagcaacccaggctggcttcagcaagggaggaaaggaagcacccttattgttgagcacctactaggtgccaggcatgttatctaagtagatattagtatccatattttcagactcagaaactgccgtttagaggttaaggagctaggcagcagtcgctgtatcagaatctgtgtgtgttgcgcccgtctggtgctgctgttgctgggtgtgccggggtgaattaggtgggggtggctgtgcaggtgtttagtccacactctccaatgaccctttggacagctgcgcgatctcactggagtgccacaaaaaccctgttaggtagcttgtgtagggattttaaaaatcaccattttacaaatgagggaagctaatcaaaagtaagatgaagagactctaaagcgagagaagctcaaacggcagatttctgagcccatgtctgcctctcacccactcacccttctcactcagggtcctcccctccctcgccaccctcttcacaatcttgccttccagtcccctgtgctggtctgatacctgctactgggtcctaaactcgtgaccaggccttctcacctctgcggtccctgtggggcccagctcctgtcccccagggtcttcatggcagctctggagtcacacagactcctcccaaatcctggctctgtcgcatattagctgtggccttgggaggtcgttcacagtcatttgtccatgaaattgggcagtcgtgatacctacctggttttaaagacaaaatgagataatgcagcctaaatcactaagactgctgataggagctcaggcagcacaaccacagcccctgtgggacctgttcctgagggtcctgttctcaaggcactcaccacctggccggggaaataagatttgtcatgtggagacatttttaaagcaacgcagagtaattctggagatgtcatgtgtcaagaggtcacttgtaaatacgttgggttccaaatgtccttaggctgtttgatctcaaaagcatgtggtccaaaaccaaaaccaaacaaaaaacagaatatgatgccctaaaaataaagctagaattcatcatttggtttccaggctagccttttaaactcttcagtccctaacactgtaacgctatattcttgcagtcaaaaataatataggccaggtgcggtggctcatgcctgtaatcccagcactttgggaggctgaggcaggaggattgcttgagcccaggcattcgagaccagcctgggcaatatggcgataccatatctctacaaaaaatacaaaaattagttgggcatggtggtgcacacatgtagtcccatctactcgggaggctgaggtgggaggatcgattgagactgggaggtcgaggctgcagtgagccatgattgtgccattgcactccagcctgggctatagagcaagaccctgtctcaataataataatataaaacactacctgtttagcatatatggttagacaaagtattaaaaaatccttcaggccaggcgtggtggctcacgcctgtaatcccagcactttgggaggctgaggcaggtgggtcacctgaggtcaggagtttgagaccagcctggccaacatggtgaaatccccatctctcctaaaaatacaaaaattagcccagcgtattggtgcatacctgtaatcccagctactcgggaggctgaggcaggagaatcgcttgaacctgggagacggaggttgcagtgagcccagatcgcacgaatgcactccagcctgggtgacagagcaagactgtgtcaaaaaaaaaaaaaatccttcaaacaagaaatggtttctttactttgaatgctggtgctggaggtagagcagttgttctttgccctcttccctgagggctggggagatgcccctgcaggcctgtatgcccagcacttagcacaggcccgggcacgtaaatgtctgattgatcaaaagatcacagctggtatgacatagggtgccagatggagccacccagaggggagaaatttgggtccaatctttttttttttttttttttttttgagattggacttttgctttgttgcccaggctagagtgcagtggcacaatctccactccctgcaacctccacctcctgggttcaagcagttctcctgcctcagcctcccgagtagctgggattacaggcacccgccatcatggccggctaatttttgtagagacggggtttcaccatattggccaggctggtcttgaactcctgacttcaggtgatccacccaccacggcctcccaaagtgctgggattacaggtgtgagccaccacacccagccagggtccaatctttactgagcattccactgcttccctcaatttatcagagatagagctaattggtgcacgtgaaatgctcactggtggcttcctggaggaggtgacacctgacagaatgaggaaaaggcattcctgaagggagaagtgtgcaaacaaggacctgggctgagcccaactggggacaaggagatctcctcgcccaggaactaggaagaccacccaagcctggggtgtggcctccaggagcccttgaagggcctgggaaaggctgcagagcagtggactgtgttgggctccccaggggctgcagcaggtggaggggactgggccggccagggctgggcccctgaagtagctcccatgtcacacaaggtggctgctgggacctcatgacaaaggagggtacagcccgggtgggccctgggccttgggaatttgttgctgggcagcggcggctggccctcagtgacagagtctccccttcccaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagcaagtacccctccccagcagggtctgtgcccacccagaaagaccctgccccctacctgggttatgtgtgtattgcagggaggggatgctgaagggactccggagccggagagggaccagggggctggtggtgattagggagccagggtggtggtgcccaggggaggggagagcccagaagagtccatggagccctcttgtgccaggtggtgtacttcacggccacgttcccctacgtggtgctgaccattctgtttgtccgcggagtgaccctggagggagcctttgacggcatcatgtactacctaaccccgcagtgggacaagatcctggaggccaaggtgggaagtgagggaaaccggaagggggctggggaggggccagggaggtgcctgcctctgcccacagctcctcacccaccggtccttccctgcaggtgtggggtgatgctgcctcccagatcttctactcactgggctgcgcgtggggaggcctcatcaccatggcttcctacaacaagttccacaataactgttaccggtgagtgctccctgctgggctgaggctgcccccttcctgcactctctgcagcctgatctcagctccagtgcagccatgggcccacgaggcctcctttcccctcatgatcttgaggttctgggaatactggttctggataaagttgttggagaatgaggagagaggtttaggcaggagagagaagagagatagggacagtgatgtcccaggggtctgtgaggactcaggcagctcaggctccttaaaaatgcccagaacagaccagaaaaggagttgggggccaggctcagtgcttcacgccgtaatcccagcactttgagaggccaaggcgggaggatcacttgagcccaggaattcaagacaagcctgggcagcatagtgagaccccatctttctttataaaacataaaaaagaaaattagctgggtgtggtggcacacacctgtagtcccagctacttaggaggctgaggtgggaggattgcttgagaccaagaggtcaaggctacagttagctgtgatagcgccattgcactccatcctggacaacagagtgagaccctgtctcccactccaaaaaaaaagagttgggggtgcctttgtacctagaactttccgtgtctccatgtctcctcttggcccaaattggggagagggaagctgaactctgttttcctccccatcagggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcaggtacgaggtgcaggacgtggaccggaggcttggggaagggaggggacaggaacaaggggcaggtctccgatctgacagccacatcctgcagttctgcctcctggagacgctggtcacagccattgtggatgaggtggggaatgagtggatcctgcagaaaaagacctatgtgaccttgggcgtggctgtggctggcttcctgctgggcatccccctcaccagccaggtaagagctgcgtaagggaagggctggcccagagttgccaggacgtgcagggaagggttggggagcccgggctgcaggcgcctcccacagctgcccgctgttccccaggcaggcatctattggctgctgctgatggacaactatgcggccagcttctccttggtggtcatctcctgcatcatgtgtgtggccatcatgtacatctacggtgagcactcgagcctccggcctcccgcgacccggcccttggcccgcccactctgtcctgcgggtctgctgaccccccatctctccagggcaccggaactacttccaggacatccagatgatgctgggattcccaccacccctcttctttcagatctgctggcgcttcgtctctcccgccatcatcttcgtgagttccctggccggcccctcccttcccccgctgccccttggccatgtgtccatctcttgggacccagcggagggacagtgggagctcccgcacctggccggagctccatacccatgactctggcctttgggaggctgagggaggttggagagagtcagagaggcgtgtggcgactcagagctgcctgggccctggcctcaggttaggaggggagtgccacagcctttatttgactgcagacgttgctcaggcattcctgcctggcacccccggggactcaggagtcaatatcgatagcgtgtcagcctctgcctgctggccttatctcccatccctccagggagggtgttccagggccttggctatgtggtgggaaccagtgttccagcagcagcccaaggctggtagaccagactgtggagtcagaggtcagctctgcatgggggcaactttgcaagccttccaggcagtgaggtgggtggcttgggaaggggagttccaggttttatgaatattcaacagctgagaaattcccatcagggagctgaattggtggaaggaatccaccatggcaaggaagcaggcactttccacacaccattcccatgtaacccgtgatagagctctccaaggtgtcattgttgtccccactttacagatgaggaaactgaggcatggggatgttaagtaattggcccatggtcacacagctaataagaggcagagccacaattcaaatcaggttgtccaattccaagcctgggccagcgccacactagaaacacctctgcaggagggaggaatggtccaggggccaaaaccgtatgacttggctccttcctgtttggggtgggattcggggaaggcaggtattgacagtgtaatggtcactccacagaggacaggcaaggccacctctgagtgatagtcagagggctggcccagtggcccggccagtgttcagagccacactcttgtcatgtttaatgcctcggtggcacagggggctcagcaccggacttcccctgtggctcatgtttctgaataaaggcccgtggagggctgaggcctctacccggtaggttgtgggatgttcccgagcctggcacaggctccccgctctggccactggcccagctttgaaacaggaggaacggaagtctcagtggtgggaggcaggggagggcaggcaccaccaccccagagtgccatgccttctggggctatggcccaaggggagctcagcctctgcggctcagagggtctcccagcattcagactagattgatgtcctggggagagaccagggggcacctgccaagggcagtggggaggaaggagacaagcacaagaaggatctgtaggggcaaccttggctgggatctggtgtctccacaagattgaggcacagcgggcggggctcttcctgtgcccaggaagccaggctggagttacctttaggggagcctagagtcctctccttggggtaactccagcctggctttctgggctgttgtgttttctctgggggctttcctttttcatatttctgaaaagctctttttgacaaactccacccttctgtcagctcaaatgagggatttgtccacacgtaggtcaggatctgttccattcaggaaacctgttataagctcccatcgtgtgcagtgtctccggagggtcccccaatttggatgtgggtcttgcattctagaatatggccctgtgctccaggatgtggctggaggctcaggaggagggtgctgggactgcccccccccttcccccgccaggccctctgggtggcccgccagccactgcctgtgtttctgcctcctttcactccttttgttactgcagccacaagttttatttccaatctcactcatctctttccaaggaggttccctagagcaccgcagcctgacactcaccatttctagcccatggagcttccccaggctgaatgtccctgtctccacggccatagacaggcagggctttgccctaccctctttccatcctcctctgcctctctgcacaaatcagttcaaatcaacacaagagactgtggcaggcactgtactgggcactgcacccccagagttgatgcaattccaggagctctcaggtctatgggaacgttaaaccaagtcactctaagggaagcaggtggaaaacgccgtggggaggccctgcagaaggaaatggaggaaatctgggatggcttcttgaaggagagggcactgacatagggtttgacagaggaagatgcagaggatgattccccagaataaatgaagagtgggtgggaaacactgggtgtgactgaaacactgagggcggagtagtgtggccggcaagacaatttgaggtcacactgccaggtgacagcctaaaggcccaggatgtggccttacttcagttagccatggggagccatagcgagcagaactgactgattccaaaggcggcagcagctctactgtgcttggccagttcaggactgtggcaaagacagacttctcccttccgcagagccttcccactcaccgcgctccggcccccggccctgcctgcttcttccacggcccagatgttgacagctgtccctgttctgccccaaatgcccttttctagtttgggaaaccagagaggaaagggtgctggtagagggatggcctggggtctgggctctgggtcggcctcacgcccactcccacacctgccccgtgcagtttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccaggtgagggcagggacaggctgggtagccaggcaaaatgggaggggccagctggaaggggcttaagggctccctcctgacgtgccctgcccctgtgccccatgcctacctcatgcagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccaggggagtggccccacccccaccccgtgctcccaccgcagagactggtgaggcagaggccaggtgtctctgcctgccccctgccacgccctggccaggacggctgctgtcaccttggtcaccactgctagtgcagtcattcatgctcatgtccccagtgtttacatgtcctttggatgccaagatagcagctggggggaggggtgggagtggagggttgctgggaggtccaaagcactttggaggggtctcgggccaggtccccagcagcctggatggctttacgtggcctccgatacccttataccctgccctgagctgaggttctgggtgggcctccagccccatgactagtgctcctgccctcagagccgaccccagcctctgccaggcacatttggctattcctccctaggggcaggatgaagggctgggggactgcccagtgttacttgtcaggctgtgctgcccagccctgtttatctgtgtaattatttttgtaaacattgtattctctgtggtcgccacctcctcgcccccagcctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccagcaccctggggaaggggaccctgcacgacacccccttgccctccctccatgaggctaaaggcccagtcttcccaaatgtgctgccctcgttcatgtgccaaatggccccagcccacatgcccctcccctctctggagtgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttctattcctgtctctgagcggctgctgtgctttgtctgggtcccccaggggacaagagtcaggctggaatgagacctctgtctgccaggcctttgtggaggcctgggaggagaaaggccaaaggctttgatgcttgggaccgatgcccggccactcagctccagacaccagggatctggcaagggggtggggcaagggccagacagaccaacagccttggggtcctggcgagagctcgccaagaccagatctgaagctggctgggccaaagcagctgaggcggcagcggcagacaggtgcgctgtggcagaagccagagcctactcggtgaccagcccttcaggctggggcttggggtgctgcactggacatgggtgtggaagctggcccttccctggggctgcactgaagctgccgtccccagcggtgggtagccgactggcctcgaggtcgaaggtagggctccagaggaggtgcaggcaggcagcactggagaggtgcaaccccgcagaggggaagcgggggtctgaggccctgtgtggaggaccccaagggccgctgcctggacaagaaagagtaactgtgaggggtggtggtctgatccttcagtccaccctgccctgtgtctactgttgtggtttacctgtggttgggagagacacaagaaggccccacagatgcctgcagctcctgctccatggccttcttctgttcctttagctctgaaggagagattgggctgagacagtgcccagctcttctagggtgtgtacaagtgtggggtgggagcaggaggctgggtgttctgggccctgctccgtgtcctcacctgccagggtgggctccagggctgcctcagaggggtggcaaggcctcaaatactcctcttccaggcagcgctgcagggagagctgcgtcagtgcccagactcaaggcaggggtggggcaaggcaggatacagaggccaagatccccagggcaggcccgtgcagccccttc

SEQ ID NO: 13937 - DNA, 13290 bp, Human
tggaggcgggggccgcgggggcgcgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggtgagaggagggcgcgcgcggcccccacccagggccccgagattccagacccagccccgcgaggggcaccccgagcgcggccccgagatcccaacccaggagccggtgagagaggcgccggcggccagaccccggcctggctgcccccaccccgcccccactccggcgcccctcctgggcttctccgcccgcgtccagccggcctccctcattgtcctcgctcgccccggcctcgtggcgcggggaggcgttccatacacgtttccccttggcctttgcctcatccgctgccctccacccactccccctgcccccaggctccacacccacccggtctgtgcggcctgcccgtccgcgggtgccacgtgttcagcctgccagccccgcccaaacgcacccctcagcctggccgccagcctgacccagaacccctgcgccggagggagggtgggaatgtctgcacgtgggtctgggtgtgagctgtctgagagtctggatgtatggctgtggaagtccaggagcagtggccttgtttgtgagtgtgggacttagtgtgttactgtcacccgggtgtgtctgtgactgtagttctctgtgtgtctgagtgtgggtgaccagctgggaccagggtgtccctgtgattctgtgtgcctgtgagactcaccctgctccctgaagcactgccagaagtggctgccgctctcttggaaccacagctggagccatcgcccaggcaagacccccttcctgccatgcccagtgctgtgcccatctccaggcccaagcatcccgttccgggaatcagaaccagctgtgctgggcaggacccagagtcttggtcccagtcccaaggggctggctttgaggtcttaagtgaggggtgtcccctgccttgccccgtattttgacgttttgctccagtgggaagggattctgtaaacatccagtctgtatttgggccccccggatgctgagggcaacttcccagcctggtcccagttggcctggcctgcttgtcgctgggatctgaatgaccaaaccacttcccaccatggctcctggaaggactaaatgaagtcatgagtataaagtgctcctgcatggtaggtgcacagtattccgtctcttccctcttccccaagccatgagttctgggttaaggatgctgccatgtgaggtgtctgttctcaggggcacaggggcacatgggggtctataggtaaacatgtctccatgcttaggtacaaaccagtgtggttagagttcacgtgtctgtgttcctgggaatgcgtgagtgtgtgtgtagagttgtgcaataagggtgagtgcctgagtgtgtgtgtcagtgaggtggaggaaggtaaatgtatgtggcttagtagtggggtgtgcttgaggatgtgagtactgagttgccgggaactgtgcctgggtgtctgtttggaggtaagttcttgagtctgtgagtgtgaaagggtatgagcaggtcagtgtgaggtgtggcccacgagtgtgagcagctgagtgggaggtaggtgggcagccttgcctgtcctgccctgacctgctggatctgtttccctcccaccctgctcaggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttggtgagcctggagggtagggcctgcctgtggggaaacagggttttattggtttgactagagaaatggcatctggacccaggggtgtgccaggggtccaggtctgttgtaagagggctattcttggggttccctagcccacccccaggctgagggtgggggctggtatctgtggattctggccaatgccctgattcctgacactgtcctgtctgcagtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccaggtgcccatgcgggggtccatgtgcctgttggtgtatatatgtgggttgggggcgtttgtgggtccttgtctgcccgtgtggatatgtggatggacctgggcgtgggtagtcggtgtttgtcagtgtgcacaggaatgtgtacgcacagtgtgtgcatgtgaatgttggcatgcacactggcaggtgtgtgcatggtctcagaaggggttgagccccactctctacccttggcaggcctcaccccatggtggtgcaggccttgggtatgctgtaggaggagatgttgagggccctgaggagagggagttagaccctgaaagaaggatgaagcctgtagaaccctttggggtaggtgccagccacagctgaggccagggcactcagctcagcatcttaaggcctttggtggacctggctagggctggccactaggtcccagaagggacctctgatgcaggcccccccgcccccgccgaccacagagacctcctagacttggacatgggtccctcccgtatgatgggacacaagtggaggtggagcagggggccgtgggagcacagagggccccagtccagccctggggttgggaagcagttgctgagatgggtcttgcgggatgagcaggcatcaggggctgcagaagccagcattctaggcagagggacctggaggatgcagggccagcaagataactggcctcgtgttcacgaactattggctgaggtgtggtgtccagcatgtggactgggtagcaaagatgaggctggaggagttggaagtcaaactgagaaatgtcttgggaggcatgctggcagtaagtccagcgcaaaagtgacagggcaccatgtaaggttgtaaggagagagtgacttgcgtgtttgctttgtagaaaggtcactctggttgcatatggagcatggatggagaggggagattagagacagcgtggcccgtttggaagagaggacgatgcccaggaaagaggcggtgaccctgcggatgtgtggggcgggagtcgcggggaagaagtggggttgttacgcaagtagtggagagtgagaaaagagcgacgtcaggacagcgcaagggtttccgccttggctgttggctgtggggatggctgtgtctgagtgagatggggacacaggagctgggccagctctgggggagtgtgactctgaatcctttcttgcgtgtgatgagtttgagcgcctgtgggaagtacatgtttagcaggcagttagacaaatgagtctggacccagaagggaggtctgcagtggagagagggatctgggagcaccaggatgaagacggtctggtccctaaaaccaacaacgtctgacctgccagggagcaaggggcatgagaggaggaagccagcacttcagggatggagggagaaagaggccgctacagaggccgagaggcttggccagaagggctggaggagacccaggggagtgtgggatcccggaaacccggcagtcagtgtcaggaaggagacatggcagctgcatgggcactgtgggggtgtgaggagggatgtggaccaagactcgtccagtggatttagcaacaaggtgggcccagcgagagccatttcaggggcatggtgggggcggaagcagattgcagtgggttgaagaaggaatcggatttgacgaaatggaaataaccaattagagacaactctttaaaaaaaaatccctgctgagaagggaaggcaaaaggtagggtggtggctggagggaggtttgttttttcagttgggagaggattgagcatgtttatgagccatgtgggagagacacagggctcctggctggtgagaggtcagaaggagtgctgctgagctgggaggaaagcgatggtctctccaagggctgggggaagaggaggtgcaggagagggagagaagagagctggcagggctgggcaggtcagggttcccgaggggagcagctcccacctcttctggcagtggctttgctggtggagaagagggcctttctctccgctcattccagaaaggccactcaccgatcccctctccaggaacctttctggttctagcctggagactgcaggttggggcaggggctcaggggtcagcgcctcccactgaatgctccctgctagtcctagtccagagtctggtgcttaggcctgcatggccaggacccctgcagccccaattctcaggggaccccaggcttgctgggctgtgactgcctatagaccctatgcttgtcattttgttggagagacaagtgaatctagcccagacctgtcctggtctcagaggctgcccaggcagccggatgcagctccagggagcctgaggctcctgcatcttagacactggtcatttggggcattcgttgtttgtctcactgcatgactctatacacagcagggaggggaccagggctggccatctccagaatccccgctagcacaaaggagagagcgccacagggcatgtttgaatgagtgaatgagatgagaactccacctgacgttgtcaatgggtattggcataaaggaagcccatgggaaggaaggaataagcgtactggggtggggaagtgtggtcaggggagccgctccagccctgagtgtgacaagcacaggtactgctaaccccaaggcctggaggcaaggaagagtctggcatattccggggctgctgagggatgttgtgtggctgggcctcgggacctgagggcagtggccagagaggaggctggagccacatatgaaaggcctttgtaggccagatcccggtcgagaagctggactagatcctgagagcctggaggagccatgcagcgagggggctggtagatccccagagactgctctggagagtggcaaaagggcaggtgcttgttggtcacaggcccagggttgacctgctcctccccctacccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggtgagggctctcttctcagctggacccagccctcctgcccccaccagacgcaggcccacttccagcccccgagccccgcttgctcctggctgtggcccagaccccactggcgaggctggatcctccctggaccccattggacattccccccgacctggtctctggtccttcccctggagtccccttgggacccttactgacacctgccttcccatgccacaggcttccctatgctggctactttggaggtgtgtcaggcctgagtaaggctcagtttctgagaatcaatggcttccccaatgagtactggggctggggtggcgaggatgatgacatcttcaaccggtgagtaagcacgcggtggggaataggctgggtggggggggggggggggttcagactgggtggggttctttgcccttcctggagcctgttccagtctgtccgtccccatcctcaggatctccctgactgggatgaagatctcacgcccagacatccgaatcggccgctaccgcatgatcaagcacgaccgcgacaagcataacgaacctaaccctcagaggtgaccccagcaccctcaccccttactccccagaggcaacttcccaatatccccaactcttgaccccaagtggcccaatccctgatcccccagtgggggacctccaagcatccttgactccaaaaaggtgactcccagtgccactgattccctgatgtgatccaaggcccctcaggactgctggcacccctgatcgttgtcccccaacccccagcccagcctcagcccaatatctctgacctctggcctgattcctagaggtgaccagaatttaatgtcagggcctaaatagtcattgagtagattgcattcctattggtgccctcgaagacctcacttgtgcacctgtgggacccctgccggggcagataggacacgagctaatgggtgctgggcacagctcctgtggacctgacaaaggggacctgagcagtatgggaagggggtgtggaaagacagtgcccacccctctgaaattgaaggaggtggatgtatctcttaggaggtagccacatttggtatcaggctggctgggagaagggcctaaagggtgtgtgaaatgtaaacaagggcttcctgacactgctctgacttgtgctaaactttctgggggtgggagacccagagtagtcacacccaatccgtgctttcccttacgaagttcattccaggcagggagatagtcatggaaaaaggcagttatagcacaaggtcatcaaggcaaggtgttgtcttggcagaagagggactggtgatggaagccttcctggaggaggtgatggtaacctggagtttgaaatagttactcatttaacaaatatttgcctcacacctaccttgggcacagtgctacattccccaggctaatagaggaagccagcctggataaggagaatcatatctggaagattctggaatgtgaacatgtatgatacataccgagagtctgaaactatttggttttaagatctctgaaggctgatagtgacagtggggcgggggaaagtcacgtctggatgttaggggtttttcttctgttgccctttcaccatgtacatgtcaggggtcttgaatacctgatgggaggttaacttttgtcccagaggactggggagtcatggaagaacctgaagaagggagaggcggggtggggtttgtgtttagaaggcacactgtttgagcttcaggaaggcgaaagcctggcatagccgctgggtggagcaggagagaaagtcagcccggcctgaaggaatcgatggagtccaagggagcatagtggtacagggcctggggatggaggtgctgtgtccccagcttgagcaggagggtttttctactctgaacacggggtaggagtgggggaggtggtttgtagccctggtgtggggttggtgcctgggagaagcatgaggcactggggaggcacagggagctgatgaaaaagtggttctgatgaaaactatggtcagcaggaaacaggtaagagaccaagaggagaggggcttcagggcatctggggaggagtggagctccacagtacacgccaggagccttggtcctgtttcaggagtagcctgcctgagtgccaccatcaattacacatgtctggcttggttgtagatgtggcaagatagcaagaagtttctggcttaaagaactctgtgaatgttggattcatggattgggtatgactactctgggtctgccacccccagaaagtttagcacaagtcacagagcagcgtcaggaagcccttgtttacatttcacacaccctttaggcccttctcccagccagcctgataccagattcacagagttcacaaactgtgaactctctctacctagttgctgttgcctaaaatctgggagttctggattcttcttttcctcaccctacatatccaaacccatcagcgagtaatatcactgccacccctaaaacatatttgagtccatttgctttccccctttactacctttaccttagtccaacctctgggatcctgcctggactactgcagtggcctccaactggtttccctgtttatggcttggcccccaactgggttaaacatttctcagagcctttacacatttcattctgtgagaatgaaaacatgagctgctcgctctgacttagagccctgcccttgcacggtgtacttgaacctccaagctaatattctgcttttccacgtgccccattcaggtttagccactcagctgtgcaaaatcttattcccaatttagggtcaccatgtgctctgacctctacctggagtgctttgcccctgcccttagctcagtgtcacatatgccctcttgtctctcttagcactccgatgttttctctgttacctgcctcccctagagaagccaacttgccctgagatgaaggaccccacctgtcatggccatggcagtagccttggtgcttagagcacagcctggcacatggtggtgctcaataaatagctggcaagagagtcactaaagaacgaggaacagagaaaatggcacaggcgtggggagtaaaaatgatgcatctgattgcgcttgaagtgcctgtgggatgcctggtctcaggcttagaaaggtctgagctgacctcacaccgtggctcatgtctgtaatcccagcactttgggagactgaggcaggcagatcacttgaggttaggagctcgagaccagcctggccgacatagtgaaaccttgtctctaccaaaaatacaaaaaaaaaaaaaaaaaaagacggggcacggtggctcatgcctgtaatccctgcactttgggaggccaatgtgggcagatcacctgaggtcagtagttcgagaccagcctggccaaaatggtgaaccccatctctactaaaaataccaaaaaaattagctgggtgtggtggtgggcgcctgtaatcccacctactcgggaggctgaggcaggaggttgggaggcaacctcttgaacccaggaggcagaggttgcagtgagctgagactgcactactgtactccatcctgggcaacagagcaagactctcaaaaaagagagcgtctcaaaaaaccaaaacaaaaagccggacgtggtggtgtgcacctgtagtctcagctactcaggaggctaaggcaggagaatcgcttgaacccaggaggcagaggttgcagtgagccgagaccgcgccactatattccagcctaggcaacagagcaagactctgtctcaaaaaaaaaaaaaaaaaaaaagtctgagctgagagatttgtgagggtgtcagacgtctgttttctgactggagcagctgacatctctgttttgagggccaatgcaggagcagaagggctcctgccaaatcaaccctggaaggagccagattggcttaagcctaggccccagagatcccatattgggtttggtggtgttaacttaaaaatcactagatcagctggatgaggtggctcatgcctataatcccagcactttgggtagtcaaggcgggtggatcacctgaggttaggagttcgagaccagcctgaccaacatggtgaaaccccatctctactaaaaatacaaaaatcagctggcgcagtggcaggcatctgtaatcccagctactcagaaggctgaggcaggagaatcgcttgaacctgggaagtggagggtgcagtgagccgaggtggtgccattgtactctgtctcaaaaaaaaaaaaaaaaaaaaaatcactagatcaataaatttgaaaaggagactttatttctcttttataaagggttacaacctgcaggctggccatcccactggctaggaagcagagcctccagccaaagccttaacaggcactttgagggagggaggagtgagataggaattttagttgaatggattggtcaacaggttactggaggagctacgaatatttacggaaggggtcctgacatatgcatatcgaacaaacatgcatgttatataccatccatgttcaccttggggtggagacttaatatttaaatatatcgcagttaggccccatacgtcaaaaagacaaaagcactcaagtgcgcagcctctgtaagctggctagaaccagtccatggccgatggtcttatcaggagaaagttactgagatcagtctcttgtcccaccaaagctataattatggcttgtggaacaggggcgtaggggtcagcatctggcagtgggtgagctgcaaatttttttctattatttatattaccacattatacaaattgttttaatattggttatctcaagtcctgtacttgtttagctgctacagaaaaagaaaatcctcgcggcagttagagcatagtctcttctttaagtgcagaggtgcaagacttaacccttgcctggcatggccttagatcctatttataattaggtatcttattgacacaaacaatgcattctgtcagtcttgtgatctctgctttgacgttaatgctggtcatttgttgtgtctaagctgcaaaagggcgtgggcataacatggcatgtttgacgtcccttcccatcatagctggaaaccctgtttttaaggttccctggggtccccttggccaaaagggggtccatttagttggttggggggtgtaggattttatttttagtttacagttgttagccctgatgtggaccatttccatcctatctaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagcagctcccttgtctgtttgggggtgggggtcgggtccctgaacgtggttaccctgagtgtgttgtggtggaagggcacttggggaacctggcccaacaagtaaacctgacccgggccatcctggttctccaagcgctgccactccctaggctttcactggccttaaggggaagtttgtccttgcactgcttccgggacagtggaggcgacgaagtaataaacccgtggacccagatttctcaggtcttaacacgttccctgaggcctaaaggtgcccagggccgagcccaaagtgcttgggtcagggctcggtggagcgccgaggtgagtctgaactcccagccggcacgcgccgcccgccggaccaaacacgagagggggcggggccctagagtcgcggcgtggtttcccgggtgatggccacgcggaagaggtggggctagggccctggttcccactgcctagtttctgggcccccggcatccgagtcggccaaaagccgggcagaagagagcgccaaggactggcagttccggaacgggcaatcccagccgaggggaccagcggcagagcacgggtggggcttgggagagggcggggcccatagaggggcggggtttggtgagcgttgccggcgggcccgcggtacctcccgcactctgacctgcggcccgtaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccgtctccctcactcccccagcccccaccattccggacactcccctccccagtcgcaaggtatcccagctctccttgcaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcaggtgggagcctcaggcctgggccctttccctagataccaggtgggctagcgctgcccctaa

SEQ ID NO: 13938 - DNA, 13290 bp, Human; identical to SEQ ID NO: 13937

SEQ ID NO: 13939 - DNA, 13261 bp, Human
gttgagttacttgataaaaagtaagtcagtagaaataacttaaatgctcaacattaatgtcattggttaagtagcaatgcatagaactaaatattatgctattaaaaagtttatttgtaaagtcaaggatatggaaaaatatttgatacatacatatctttttgagataggttctcactctatcaccaaggctggagggtagtggcaagaccatagctcactgcagcctccaactcccaggctcaagcaatcttccagcctcaggctcccaagcagctgggactacaggtgtgcaccaccaagcccagctgattttttttttttgaaagaaggggtctcactatgttgcccaggctagtcttgaattcctgacctcaagtgatcctcctgccccggaatcccaaagtgctgggattacgggcatgagccacagtgtgggactgatacatttttgaaaaaaggaaacaacatatattcatgaaggaaatacacaccctcctggtgagtttatgtatgatttttgttttgttgttttctgtgttatctgatcacaaattactttccttttcaggaagaaaaaaatttaattttttttttattggggcaacatccaacccagatatgattactacctagcctgaactgaatgtattactaataaacaaagaaatgcagaatggcatacagtcggtaaagcgtagtgcttgagagcatggattatggagactatttaaatactggctccataacttaatagcttgggacccacggtgttacttagcttctatctgctttaatttactcatctgtaaacttgggataagatacttcctcataaggttggtgtgaagaccaagtgaattaactatcgtttaaagcacttacaaaagtgccgggcaccaccgagatatgcatccgttagcttttattattattagactcaaaacactgtagtagttctaatgagaggggtaagaataaaaaatccaggcacctgcatagagccagagaggcacacatagaagcaacgtaagagtggaagcggaatgaaaacatgctaaagccaggtacaagccacaagcgagggtccacaggaagaaattgttaattctgaagagagtgaatgcacgaagttacaggaaaaataacatctgaacagagtttaagaatgagcaggacttcaacaagtggctagtaagacataaggaacctacaaaagatcttagcaaaggcgcaaagattaccatcgtattgctcgtttcttcctactttgcagaagtaacctctggcgaacagaggtggttgcagagcatgcttatcaagcaaaataccacgaagcagtaaggaacgacagagataacagtaacaataataattcaccccaaggtactcaactggaaaaaggaaatacagaggagaggtgtcgttaagaaagccaggacgcacatcacggccccgtcgctgcactactctcgtctaggggtcaacagtggagtcgagactcgaagcttccacgcggcggaacagcgtccctctcaggcggcgaacgggctagggaagcgcccggaggagacctagcgtgagaactacaactcccgcggagcccgagggcgagctgcctgcgtaacttccgcttccgccacctgcccctcgcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgtgaggggcgtggaggaggaggcgggctgggttgcgctcacacttaagcgtctgtgacaggagccggaatcgcattctcccttgaccatggttctagccaaagatctggctgaggagccctaagggtagaatggaggcggaggcatgagagcggagagtcacggagttccgaaaggtgtgagggagaaaggacttccaagaccagagaggggatttacgatatttagaaagcagggaaaggaaaataccccaagtatggagtccgttggaggtgttggtggatttatttgtaggaggaattttggcctgcatcacggtgggaggtcaagtggcatcatttggagagggtatggctacaagcgcttggaaagtcgggacactagacagagcgagaatttctggcaccctgggagagctttgagggggatgcgactgtggtgtggataagaatggctgatggacggattatcttgtgttcctcgttgtggggagcttccgctcttgggacatagccgctacttgtctgaggctccttctctcttgagttctttcagcattaggccttttagccaattgaggctgcttttctaaacatgtaggctgctggagaaaaagggataaggactgctacatcagaaaggagccagcgggaagacagtagaaattccactggtaaatggccatggctgtcttaacagatggggaagtgagtgctacagaggcccagtggtgtaagctgcttcccagttgctggcttagtcattggccaccctaataaaggataatttttagcattgccaaataaaatagatctgtcgttagagaataagaaaactgaaagatttttcaagatcataaaatcctgctccttatttccaaagtatatagacaaactcttgtaccttgagaatctaattgtagcatattaaaagggggctaccgggcccttccatttcattctcttcctgattgttgcacccctatgtttataagttttccagcagttatctttatgccacgaatcgtctaaattgccccagtaacttcacacacatttaatatctgtgtaatgtacagcaagtaatttaacaagtaattctgtaaagcatcagttttctcatctgtgaagtatgaaaaattatacctattttctgggttgtgaagatgaatgaacataatctagggaaaacatttagcgcatatgccactgaattaaagagaagcagcttaaatttaaagacaagccttaagcaggaaagaagaatacagtataaatttattatcctaactttttgaataataagcaaatgaaagatagttcaactcagctaatggctgaggtgtttaacctttcatcccttcctaattttgtgagattccttgttctaatttaggaaaagaaatcaactgtcagtttttaattaggtcctgagagactggaaaggaaaatggcaggctaagtcagtctagaagaaggagtctcctatttctttttagtgagtcagctggtcaagttgtgtgttgagcagtgggttaacttagggaaggtgggagttggaggtctgagttctttatttcacctcctattcagtcaactgtgtgaggaatcacttccccttcacttcttagtagaaaaaaaaaaaaacccacagttttggctgtctactctcatctccaaaaaattgttatgcacatagtggaaatatacatgtagttgttcaacacagaccatgagctctggagctagactctctggctcactccactagctgtgtctcagttttcttactggtaaaatagcaacaataattgtatttactcataaggttgtgaggattaattagttaattaatatatgttaagtgctttgaacagcacctggcccaaggcagtagtctgttgtttcctgctgttgtgtggtttcagtgcattaaatgtgttatgagggccttggacctcttggttagctatgattattctatggaaactaccataatattacagtagagaattgatgtttggggtacaggaagtcaggtagacaatttcccgggattttttgctttagtggggtgtgggaagtggaaggtcagatgttaggttgtttaggggaatggggaaagtgcattcacggccaaggttggagcttccattttcccatcttcaaactcattagtacccatgaaaattctgcctgtttcaagttttatattttaaaaatgaggtggagtaagtggacccgcatgaaaaagaactagagaactttaaagaatattcaaaccaaagtccagacttgcagcgttttttgtaagtgagaaaagtttagaagagttaaatcaggaaattgtccgtgatactcttggaataaacaagtagcaatggcctgagggatcattaacagataccagagtaaagtgttttgcaagggtaagtcagtctgtcctgggtatgaagatggataagagaaaagaaaatgttaggttttggtggggtttttttgccaaaaccacaatgacctttgcaccagtctagtaagtttgggaaagagagctgtctgtgtgttttcattcctagagcagtacaagcagcaggtgcattgaatttactcaattgtaaagtggcttggtgatccccaatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaaggtaaatgagaagaaccttaaagagcttgagaaaatatttatgttaaagtcttttcttcttactgattttatttcataatgtgctctcttttatgacatagagcaaattctcagcccagtttttagttgctgtgtgcagttttctcatctttcacagaagtgtagctatttccaagactggatccaagagaccagcttgtagaaatttaaggattatttgacacctacatataataggactttagaaatatcagataaacatatttaggccgacacatgtcattataagtgtcaggaaccttcagatatataaatctgaagttggtccctaagaaacgagactatccgatgaacatgggcccttattcattggaacatggttactaacaggcattctaaaaataactagaatattgagctatcaagatagctcaagtgtgttttaataattcatcatcagcaataaggatggtctgtcaaggttatgaatatcttaaaattaaacaaatattcactcagccatgacctcaaataaataaatcgagcatgttgtttgttttgttttaattaaggaaagggatgctgttattcctgaggctgatagctagtaactctcctcttctttcttcccacttctctttacagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaagaaaactccccttcctaccatcgattgactaactgatcccaagtcaatccctctgacaatcctgtatgtcttggccgtttctagtgtcttcagcatatcatacgtgtggttcggcacacctgagactgtaatataccacaggatgcctaattccacagctcctctgtaagccacagctcaggacagttgtgcattaaaatcagtgaaaaacttatgcaaaatgaagactctagccagaattgttttgttttgttttgagacggagtctctctctgtcacccagcctggagtgcagtggcacaatctcggctcactgcaacctcagcctcttgggttcaagcgattctccagcctcagcctcctgagtagctgggactacaggtgtgtgccatcatgcccagctaatttttgtatttttagcagagacagggtttcacaatgttggccatgatggtcttgatctttgacctcgtgatctgcccaccttggcctcccaaggtgctgggattacaggcatgaaccaccgcgcccagccaactctagccagaattctgtagcctagagtccttttattcacccaaatacttttaatgagtttcacactagacttaaaaataccaaccaccaccaccacttttcatcaaattaatcaaagtttaccagttaaattttaagagctcaaacttttttttgcaaactactcagtctgcaaaactttacccactgatttttgtgctatggtggtgatatttcttaaaagtcatattgctggagaggaccatgtaagcacctatggtccaattccctcccatacagataaataagttatacaaggtagctatttactcctggtaaataatacaataaaaaagtaacaaaagggtttggggctggggatcatgtgaccaggttctcctcctgtttcctaatcctgtgactggaaagtcgtatcaccttttgaccttgttttctcatatgcaaaactaggagcagaatctttaccttattcacctcacaattactgaatcaaatgatattttgcaaaagaactgaacacagtaaatactaaagaagagatatgcattccaatcttagatatccactctgaatttatctggggctaagttgaaatcttagatgggcttacccctgctgctcagcaattgtatggaacctctttttttgcttttagaaggtattcagaaaatgaatcagtgttaaggtatggatcataattggttttgcattgtcagttgcctacctttaatgttaaaaattaagattattcttaaatgaatatctgattcttgtcttaagggaacacaagtctttgtaagcaaacaagtttagcttggcatttctggtataccaagttcgtactgatgagggttgtttagttataaccaattgcaatgaattacgcaattccactctgccataccacccagatctgcctctgcttttcccccaccccatagctccattttccttgtccctcctcaggtaattggatcatgctgatctataaagggggtgatgaatatgacaaccactgtggcaaggagcagcgtcgtgcagtggtgatgatctcctgcaatcgacacaccctagcggtgaggcaccctgtgttgtataagccgagggaggagactgaaaggactgacctgaggttggggagaatatccagaggggacacgatacgttgggatggacattagaaaactaggagctcagtttctctctgtgtcagacacgcatcttccatggaaaataggctgctgaaccaggaaggagcagatgttttttgggttttttattttgttggacaggagtcaaaacacttaaccacctgaatgtgttatgccatctcatcatcaggacaattttaaccctgtgtctgaggagcgtggcaaagtccaagattgtttctacctctttgagatggatagcagcctggcctgttcaccagagatctcccacctcagtgtgggttccatcttacttgtcacgtgagtatgccttcctttatcagaacagaccttccttccttttgtttttaaggtcagtaactatatggtggtacataagcacaaattgtatgtgtacattatgctgtaattgatggggataactttttaaatcctctggctataaaataattctgccaggacacagggctcacgcctgtaatcccagcactttgggaagccaaggcagatggatcacctaaggtcaggagtttgagaccaacctgaccaacgtgatgaaactccgtctctactaaaaatacaaaattagccagcacagtggcacatgcctgtaatcccagctacttgggaggctgaggcagtagaatcacttgaacctgggaggtggaggttgcagtgagctgaggtcgcaccattgcactccagcctgggcaacaagggcaaaactccgtctaaaaaaaaaaaaaaaaattctgactgcaagtttttgaaaaatgagatttaatgtttagttgccggtatagatttgcatttggaggtgcttttttcccctactgcaggactaggcaatttttatattatttcattagattatgagaacttctagagaaatggaatcatatacttaatggtgattattcttggccatagaatcacacgctgtcacattttgtctgggcctttgcttctcttggactgacagcactctaactggttttctaagagttaccagccccctttttcatttagtatcactactcatttttccttttcagggaatgtatcttaggaaacagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctcttctaaatctgatttagcttttaagagggcctgggtgggaagaaggtgaggcctaataagaagaaactttttctcctgttgccccaaattgaatttaggctgattgtcagatcttttaggttttctcattatccctatagaaaaccaattcttgccacattcctagaccataagtacactttctcatatcctaaagttagatgctgcgaattatttccttcttttttctccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggcagcctagaagaaatggtgagaacatgtaggtaatgccagatgataggagaagggaagctaaatgaaactgaggtctagcaatgattaattccaaagtacctgtcctaaattcagtaatatgaagtcagatggcaagctttaaaagcaaaatgaaattagaaagcaactggtatttaaaaaatggccaggtgcagaggctcacgcctataatcccagcattttaggagaccagggcaggcagatcacttgagctcaggagttcaagaccatcctgggcaacatggcaaaaccttgactctacaaaacatacaaaaatcagctgggcatggtgatgcatgcctatagtcccagctactcgggaagctgaggcaggaggatcatttgagcccaggatgcggaggttgcagtgtgccaaaattcatgccacagcactccagcctgggcaacagagtaagactctgtctcaaaacaacaacaacaacaaaaccaaagtccaagaccaagaaaggaaaagcaactaaattgttcaaccacagaaataacttcattcaaatagcttagagacaggggaaagggagagaacagaaataaaagcatgttttcttttatactggcaaaaagattctttgtgatatttttgtttaagggcccagaattcagacaaatagcaagaagggtagggtgattttcatttccgaaaaaaactctgtcaaaattgcatataggctgagtgcagtggctcacacctataatcccagcactttgggaagccaaggcagaaggatatcttgagcccaggactccaagaccagcctgggcaacatagggaatccctgtctctgtttaaaaaaaaaaaaaaaagaagactagcaaacaagccctctttgaagagtggggcaacaatggccacttagtttctaataccctgctccactgaaaa

SEQ ID NO: 13940 - DNA, 24402 bp, Human
ctgcaaaactgaaaccctgtacccattaagcaacttccttttctttttccctccaaacttctttcagtaaccattcttctttctttgtctatgggtttgactactttagattcctcatataagtggaatcacacagtatttgtcattttgtgatcagttcatttcacttagtataatgttttcaaggttcatcagtgttataaagtatgacaggatttcctttctaagactaatattccattgtatgtgtagaccacattttgtttgttttgccttcatattaagggcgtgaaaatttgttctcagaggcagctaaactattgatgactctttttggcaatgttaagttttgctctgtttttggttggtgctactaagcaatgcatcacctctgtcctttctgttcagctcttggccctgcaggaactatctcagcttggacttgcagagttttgtcctatgtctgcgcagcctagaacttggccacagacatacagtgaattcctacagtcttaagggtgcctctctcttgtgaattatcctgccctgcaaattccagccatttaagcagctcaaaactccaatatctgcctcctcattttagtaagactgctgttctgtttaggattcatttttgtgctctgtactagaaagtggtcctagatagaaagctagggtgatcattgcactcacctttgtattctctcaaggatcacaatgctgcctgtgtgttcctgaaaatagctgccttgtgtgtcttgccatgtgttgtattttgattggagagtaagtctaatgccattctgtcatggctggaagcagaaatatatttgtttttattaatataaaacaaattaatataaagcactccctgtttctcttcttttatccttatgcagtctatcttgatgatcttatccactcttaagagtttcaatactctttctgtttccttactttaacttttgttttttttagacggagtttcactcttgttgcccaggctagatagagtacaatggtgcagtctcggctcgctgcaacctccgcctcccggtttcaagccattctcctgcctcagcctcctgagcagctgagattacagcccccaccaccacacccagctaatttttttgtatttttagtagagacggggtttcaccatgttggccaggctggtcttgaattcctgacctcaggtgatccaccctccttggcctcccaaagtgctgggattacaggcgtgagccaccacacctggcctactctaactttttattaacttttcacctactaaaaacaaattactaagatgttagaatgtatttgtttactttgctcttctttttagttatctttgcatgaagtataataataaaaaaaataagacaacaaagagaaaaaatataatggaatttctgatactgtgaagggtaaagaccatcacacaatttggacaaggttttggggaagatgtggtcatgtcatattcacaaaatatatctgggtaatagtctatttctcccgtgattccaggcatatgcacccaacagtccatttcgttattgcttatcactgcccaaaagttccaagaaatgatgaagtcagtctcatttggcatacatctactttttcagaaggaaacaaagcagagaaaaaattccgagagaaattcatagctagtaaccactctcacttttattttagtttccataactgaaattgctggacttgagagcaatttttccttgctcaacagaattaggtgagatggggaatcaatttaatatatatttagtgagcatctacagtgtcatggggcaaaaaaatagcaacttacaatattaatttctataggcagcccccaaatttgaatcatttcctgaaaaattacttctgcttttgtgaagtttcctgctagcagtttagagattgggctgtttcctcactgatacatatcccttcacacttctataatttaactctctcaactgcatgtgaaagatcttagctgaagatgactgacagtgttatttattccatgttagagttgcctacggcaacccaagcccagaatgactacggaccacagcaaaaatgtgagttaaccaaggtagcatggaagacgatgcatagcaacagtaggctatggatgaatggggagtagaataagtttaaagcagagggtgcagaagaattgaggataatttgaggaaatacttttggttcagtttaaagtccagagttggaatatgaaaagttggtgtatggtacaggatctgatcttaggtctcaggtaaactcttttctaactgttcacttctttgatcgcatcttagaaacccaacttagggcattgccgttattccttcttgctcttagctaaagcgggaactttgttgggagaattttatctctttagttatattcggagtaaccttggaccagctgtttaaattctaggtatggctgtttttctgactatggaatgaggaggacaccaatagttttgctggtggatacgagtaagatttttgtcaggaaagaaactgatttacatatctagttttgttttttttttttaacttcacagtgttgcactagaatggtgacagggaagaaaaagtatcaagaaactacagataatagtctctgtgactgaggatttgaaggcaaaagagccatttttacatagagccctgagagaatattatctgagacagacaggtaatagtgtaaatgccaaaattaatccttgattttgtatcgtaggcagtgaactcccacaaggtgtattctttagggtagttccctaagctttctctctttttactacatagttttactattataatttttaatgtcttttgagagtgttgccttaatttgctaaatcattctagtatacttgggatatttagacctatttctattaccataaattatatagcattggatatctttatttgtgtaaccttttcctatttttgaattgtatctatgttaatttctaaggaatagaaatattacgttagaagtaatgcatatctcaaagtatatgttcaaggtcacacacacaactggtgataaattggaacctagttggaactatttagaggctttcaatatatacttaaagtaaattttaaaaatttactttacttcttgaattggcttgtggttacacaaattcaattatggtttgatacctttttaaaatttagcataacataaaaatgaacatttgtgtatttcattaaatgttctcctgtgatgcaaatgtatttttaaaagtttttctagaaatcttaatgcttttggattcatcagtccaaatatttattatgcagaattctctatttatgaaggcatctctcattatgaatttttttctttaagaagttcagaatactccatagatacacacatatatagaataatttatctaaaatttaatcagaaaattgaagcccaaataggcaagtttaatttcctaattaaatgttattaagcaaaggaatcaaaattagaagttaaatatcatcttacttcacagagttttgctcgttacacgtaatttctacactattgcactatgagatacctttgattttaaaataaagatttgctgaaaatacttccatttttcaaatttaaaatttagatttcggttgtatgcaacagctaacatgaagtagtgtcctattcttaaacttggcatcaacttaaacttactgctcttttaataacgacagtttacaaagcacttctgaaatgtagattatttttatttaaattttatgtatttcaatttcgagtagataatatgtttacatggttcaaaattcaaaaggtacaaaagaaaatagggtaaaaagtctttttcctattttgtctccagtgactgttttttccattccagaggcaaacaatgttatcagattcttgagtgtgcttgcagagatatttgtatatcctgttctgcagaatgtttctttgtcttgactatatatcttacaaaatattccatatcagttaaaaaaaaaagccagtttttattagaagctatatattcactttatggatatatcaaaaatgtatttgactggccttttactgatagaatgtagattgtattcagtcttctcctcctacaaatattgctgccacgaataaatatgacattttgcacccgcgagtatctgtaggagaaatttctaggtcaaagggtacatgcctttgccgttttggtagatattgcccaattgtcctccaaagaggtaccaatttgtattctcaccacctaagtatgagacagtgtaagtcacagtttcaaaggaaaaaagcattctttatcttgataaatatagtaagttctttgatacaggtgttggtggttaccttagactttagagcaagttcctgacacatctagaaaaggaatctttatggcctggatctcagttcccactaggccaaattgctttaagatgcgatatccttccctgactttctcttttctttcaacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggtaagtgcaaacttaaaccaaaattaatctttcattttatattataaaagcaatataacatagcagaagctttgaaaaatcaaaaaataattcaaacaaaataactctccatctgtatacagctatttcctgggtatagcctttgaccacgtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattatttttttttttttgtaaagacatttcaccatgttgcccaggctgatctcaaactcctgggctcaagccatttgcccttcttggcctcccaaagtgctgggattataggtgtgagccactgcacctgaccatattttcttaatagaactgcagtcaagtcctcttaaaatttctcccacctttctttcttttaatgcaaggctgagaatagttcttatcgtagtatgctcataattttgtatattgctttttaattttatgttgccagaaacatttccttactgccatatttattgggatgattgaattataatattaatgatgtttaacttttcacataatagatatatcataatgtaatgaaacattctgaatttttttttttttttttgccattcaggtgctttcacattttctaaaactaatttttaagtttagttcttctaggaccttaaatctggtgatctagaggactctcagtttgttgttttacagtctagagtcctagcttaggtttatatttttaggggatgatagtgaccgattacacagaagtgatttattagggttcttttttaaatttttttaaaaattttgagacagaatctcgcaatgttgtttgggctggagtgcaatggcgtgatctcggctcactgcaacctctgcctcccaggttcaagcgattctcatgcctcagcctcccgagtagctgggattacaggcacctgccaccacgcccagctaattttttgtatttttattagagacggggtttcactatgttggccaggctggtctcgaactcctgaccttgtgatctgcccgccttggcctccccaagtgctgggattacaggtgtgagccattgcgctctgccgatttattaggattctaagagttcagctccagggcttctacctcagagccaagtccgacctttgacaaaaaggaactcctagggaagttgggaatttctaatccaggctgagtaatgtcacagttgtatggaaaaagcaaaatctataaggtgccaatttaacagcttgatctccagaacttatattggttgtatgccagtacttcctagagaacaattatctaatatttatatgaaaaatactactttccccactttgtaactcccaaatctagagtagatatatactctattctgcaattatatatctacacatgtgctcatggagtataatggctcatacttgctcactgtagaattgtgcttatggcgagtttatgcacatatgtttaagtattgaaactgaagtagaaaaatcaatagaattttggaatcttggttggaattaccttgaaagcatattcagttccctttcatctttgattgtttgtttttgagacagtgtcttgctctgtcgcccaggcaggagtgcagtggtgtgatcttggctcactgcaacctctgcctcctgggttcaagtgattctcatgcctcagctcctaagtagctgggattacaggcgggtgccaccatgcccagctgatttttttgtatttttagtagagatgaggtttcaccatgttggctagactgatcttgaactcctggcctcatgtgagccacctgcctcggcctcccaaagtgctgggattacaagagtgagccaccatgcctggtcagttccctttcatcttgacagaactatgaaccaaccattttaaaggaatgtggatcttccgtatttaaaagagctcggttagggcattctatcacttttcactttagcacctgttatgcttctctgccagaaaacccttttgaaaaatatcaaagtaagttctttttgctgaggtataagggtttttttccagttttcaatggtgagggacagttacatctgtgataataaaaaagcaaaacctttcattctagttaagtttgcttttcctaatttctttttggcattttcagttgggcattctgaatgattctgcctgatttaagcaatatacattatgcaattatgcaatatatacacagagcaaagacagtacacagatgcatatcatatgaattcacagttatctggtgtgtgtatattacatgtgcacagagatctctagcacaagtcaagtacttgctccagagttttcaggcagattgttgtatgctttcttctttgttccttcagttatagtcatattcttgtgtagtggaatatatacttagtagatgatggagttggacattatgaggacattatgaggtattcaaattgacaccacgcattgttacacatttctctaacccttaatctgaaaagtggtggagcagggaagacccagggctgccatattccattttatctcccatttcatttccaagactgagtggtccataaagatgtgaaccaggtcctcttctctcctaggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatggtaaatgcaaacatttagaaaatgtagggtttttgttttgtttttgtttttgtttttaaactgctatttaaatgtatcatgtatcctcttttaaggaacagaaggaatctgtgatttgggggggatactatattcttccccttccctcttcttctctttcctcttctacttctgccttcttccctctccctccccactctttacccttatgctgtctgacccaacaaacctcagttacagcaacccagatgcttgtatagcatgtaagtgtgtatgtggggcaaggaggcagaaggatggtgagtgttttggagaggaatgagacctgaaatacaggtctagttaaaagaagtcttaggtccggaaacctacaggtccaacaacaaggcagcagattctttttttttttttttgacagagtctccctctgtcatccaggctggagcacagtggtgtgatcttggctcactccaacctccgcctcccaggttcaagcgcttctcctgcctcagcctcccaagtagctggaactacaggcgtgtgccaccatgcctggctaattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggagggagggaaagatagagatcacggggacagagtgattgtggcaagggcttaaatgccttcttttaaaaagttttcccttaattcactggaatccaataagttccagactgcaatgttgagaaagttgggatataaggaagaaaacacgcgtgcacgtgcatgtgtgtgtgtgtgtggtggcctccacttccttcaggcccctcagatccttcctatccacccagcaatctcttggaaaagagcttgctattggtcctagaccatctcaaggcaatacaaggaactgacatcctgaggttgcctagtataaaaatcaatcaaattctaatttgtcaacataaataacatctataaggaaaacaagaaatcttagttttgtgttagtgctaatttgatactgatttttgtgttttgctattgttttctgttttcttttattgggtaggatctagtcacagagaacaatttattgagaattaaactatattaacttaccttgggaaaaatccagaggttactctaaagcagtgggggagaacatatagttcctaaattttatagctacctatataactacctatataaagcatacagattcttgttttctgccaaaggaacacttactcctttggaattccacatagaatctaaactctaaatcattccacatttgtgactaacttttttttttaaagccttctctaagtgaggtggcagaatgcattgagttgtattaattaaacatgagttcttagttttatggcctccagcaatatagccttgctttctggaccttgttgtagcaactcctattctcattctgatatagtgactctcaggatttgagctgactaaagtcagtagcagaagtgagccatgaacttgaaacattgagggcaaaactgataaacaggagtcgtgagtcatagcacaagacactgccacagaaaattgtggtgtagcagctgctataaatttcacagtgtgatcatgagaggtgaggagggaaaggatgaagggcacagaatatctgggaaaatggcaatatttctgtttctctgaggaacccagaggaagggcaggatcattagagggattttgtccttcctctgcttcctgacatgcccccattccttagactattgttgagtaaaaccagcagagttacattcactgcatttccaaattgagtttattttctcctaaggctccttggggccaagtcagtgctggagagggcggaatgtccctgctagatgtcataagttttacttttaacattcctgtggaatcttacttgattctctggtttaattctttttcttgctccggcttttgtcagattctgtagaaccaaattgattttacgtgccctgctgcgtctgttgttctagtgttattattcttttgttctcagggcaagatttacatactattttgaggtatgtacaatgtttctagtatcatactggggtctgagccactaccaaaaaagcaagaagtaaaaataaaaaagagagctctatggatctattaaaactgaagtttttcaaactgacattccattggtggagagtgctgctagagaattttgttgctatatgtagaatctacaggcctatggaaaatatccctcttatgctgttaaacggtcatctttcagtgagatgcttacgtagagttcacctcctatcttagatcacttacggcaaagtgtacaataataacagaggctaccatggattgagcacttgctttttgccagatgttttatgtatagtattctttttttttttctttttgagatggagttttgctcttgttgcccaggctgaagtgcagtggcacaatctcggctcactgcaacctctgcctccagggttccagcaattctcctgccttagcctcccaagtaactggggttacaggcgcctgcctccacgcccgacctttatgtatagtattcttaatcgtcacagcaattctaaaaagtagagttcaacatccccattttgttggtgaatgaataaaattcagaggaattggctgggcatagtggctcctgcctgtaatcccagcacttttgagaggctgaggtgggtggatcacttgaggtcaggcgttcgagaccagcctggctaacatggtgaaaccccatctctgctaaaaatacaaaaattagctaggcgtgctgttatgcacctgtaatcccagcttcttgggaggctaaggcacccgaatcgtttgaacccaggaggtggaggctgcagtgagctgagactgcaccactgcactctagcttaggcagcagagtgagacactgtctcaaaaaaaaaaattcggagaattaatgagtgtaagtctaaggctacaaatctggcagagccaaattttaaattctactccagtgggcatggtggctcacacctgtaatcctagcactttgcgaggccatggcaggtggattgcttgaacccagaattcaagaccagcctgggcaacatggcaagaccctgcctctacaaaaaaatacagaaattagctgggtgtggtggcgcacacctgtggtcccagctactcgggaggctgaggtgagagaatcccctgaacccaggaagtagaggctgcagttagccgtgatcacaccactgcactccagcctgggcaacagagcgagactctgtctcaaaaaaaaaaaaaaatccacatcaactcaccttcaaagtcacttatagaaatatcgtatttgacagcttccagaatccattttgcatatgttcaacaagacaactttttctactaattgtcttctggtttcttttctatacatatttaaaaatttttttgaattgacatacagaatgtacgttgtatgaccgtggatatttaaatttatttattgtgatgaggtctcactatgttgcccaggctggtcttgaactcctgggctcaagtgatcctctcgccttggtctcccaaagtgctgggattataggcttaaatatatttaaaatagtgagatgctttcttattatctcttttttttttctatctgggacttcaagattattcttgatagagaaaataaaatggaaattaaatttctctgttattttctcatttttgtgttaacattatggcatcagcccttgcttcttcttgccctatgagtatatctttagatgtttggatatattcaaattcttgatttttcttgccatttttcccccaccaagctcagttcatcctggatgttgttagcctggttccttatagttattggtatgttattttaaagtatgcattcgttagtgagttcccagtgaaactgctttgatttctttaaatctattctgatgctccttgccctataatatctctcttcctcattatcataatttggaattatatgatccaactttactcttgcaacaacctctcattcaactttacctatcttcctgaccttgggattccccgagcttttgatgtcggcttctcacatatttaggatttacatctaataatatccaaagtttccttctttgggtgcagcaatgcaaacactatggtaacatggtcacttttctgtatatttttaatcaggtaatgaaaacagcttggtttctttcagacagtcatgagtgtgcttttactatatttcttactagctatgcgaacttcaacaactttcttaacctttttgactctcagtttcctcatgtacaaagtgaagataaaactttctagactgtccgggcgtggtggctcacgcctgtaatcccagcactttgggaggccgagatgggtgaatgatttgaggtcagaagttcaagacctggccaacatagtgaaacctcatctatactaaaaatacaaaaattagctgggtgtggtggcacgtttctgtaatcccagctactcaggaggctgaggcaggagaatcacttgagccccggaggcagaggtcgcagtgagccgagatcaggccactgcactccagcctgagagacagagtgatactctgtctcaaaaacacaaaaaactcaaaaaacaatataaagcccagagccaaaaataacttttactttgctcttctgtgtcccaagacatacaatttcagtaaaatatgcatcacagagtaaattatgacttgttgaattgagtatattgtttatgaggaaatctgagatgacatgtcagaagattcaaagaaatggctggaaacacagcatagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcattcccaattgaagctctgtacctcttaaacaataactcccctccctctagcccctggtaatcactattctacttaccatatctatgtatttgcctattctgtcctttagtgtctcacttattcacttagaatactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatccatctattgacagacactgtttccacaagcttttaaaaagtggagcaaatgatggtttacggagcagggcttactgacttttagcattgtgtacttacacaaaattatagggaaaattcttattgatattaagctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattacatcctttgctttaaatacttcacctgaaaaagtgtctgaagaaaaacatattaatgatattattttaaaatatgagactgtagggttccccagtgcctggctttctttctgtgtattggctgaaaatcgcagagggccttgaccgctctgtgacccgcccagctacaggtttttcccctgcaggctctacccaaaccccagccttgaacatttccagtcactgataaaggtatctaggttgctgctcaaaacactgaaataaactagccccagccctaagtcagattccttaaaccctcataaaatctccatctctgaccccctggccgtggacatatgtaggtcaaatgctccttttctctggctgtccatcgtgagtgttgctgcagccctctgtaacttcccctaatagatgctttgcacagatcaccttgacatttagtgctttattctatggtatcccaaccaaccccatctcatgatgatttggggtcctcccttgtgggaattcccctgtcgctgcttttgggatgatttcagccatgggtttggtgggacaaaacagagatatactgcctaaaaatacatttatcctatgtttttaggtgttttggaacccattattttgtattctgcttttatcaaatagcattatttcattcttggtttttgctaagcattaaattattccaggtaataaaaagttgcaaccagattttattttattttttatttagttttaaatattatttttatacgtcttgcatcattccactattgcttaaatcttttcatattcttagataaaattctccttgttttcaattgtcatgagctgtgagcatatttatagaaatcattttgcttgcagttatttatttacattatattccctaaaattaagttggctaatcaaaagataagattttatagttttgatgtattattagtttttcttaatatgggttgaaataacttacatacattctgtaaaccattttaatttggaagtttaaggggtatgctttgtgccttaatgatattttaatttcaattaaaaatactacatacagaagtgtatgtggaaggtataaatgttgaactaaaaaagcaaaaaaggaaaagaaaagaaaaagtgcccttgattttatttgtttgggttttatcttcactttgcttttagggtttgcattttttctaaaatataagcaaacattacaaactctaagtgacataacacctaagtgttctagctcacaccctctctgggtgacaagagttctcagttaccacctttacctatacttttgttgttgttgttgttgttgttgtttgagactctcacccaggctggagtgcaatggcacaatctcatctcactgcaacctccacctcctaggctcaaatgaccctcctgtctcagcctcctaagtagctgggactacaggcatgtgccaccatgcccagctaattttcatattttttgtattaatggagttttgccatgttgcccaggctggtctcgaactcctgggctcaagagattttcctgccttggcctctcaaagtgctggaagtacagatgtgagccactgcaccagaccgatttgtactttcatgctgcttctatattctctctctttctaatacacacacacacacacacacacacacacacacacattatccatgagtacatagaatataaggttattgtactatggttttgaaggcctcttccaagtgggaagattttcgagtgaaagtgccataataaacattttcaatatccagcctcaccaatgagaagttgtaagaggactgactgatcaagtgatttagaattatatgggtcttgagggtagtaaatgagcacaggattggggtttgtacgtgggcattacctaatcctagctctgcagattctaactgaaatttctgagcaaatctttatcaatttctgtgcttcattagctgccgttcctcctcttgaaatgaaagaaaaagaaatggactgtttttctcattatcagtggagaaatggggaatcactctttttttccttttgttaattttatttattttttcaaatatttagcttacaatttttgatttgaatatactcaaattttatatactttgaatgcagtaacatttatttttgaatcttttagatcatggctatcattcacaccaattttgtgaaaatattaaaaaaaatccattctttttttcctaatttaaataattctttaaacaagttggttaagaaatgcaaaaattttaagctatcttgaaaattacagtgtcatttcatctgtcgtatacttcattcactctccggtctaccttcttacccccagcatgcacagttaagtgctccacagagagaaagtaaaaaatacagagtttgtgttcagagggtttttttttttctttttcttttttattattattatactttaagttttagggtacatgttcacaatgtgcaggttagttacatatgtatacatgtgccatgctggcgtgctgcacccattaactcgttatttagcattaggtatatctcctaatgctatccctccccccttcccccaccccacaactgtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttatagtcctttgggaatatacccagtaatgggatggcagggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccatgtgttcagagagttttaacttcttgcagcataatacctaattgtgtgttctttatttctatagatacttattaaacataattttttaaaaaagagatgggatcttgctctgttacccaggctggagagcaatggcatgatcacagctcactttagcctcaaactcctgggctcaaatgatcctcctccctgcctctgcctcccaagtacatgtcaccaagtacaagcacatgccaccatgcctggttggctacattttttacttttcgtaaagatagagtgttactatgttgtccaggctggtcctgaactcctggcctcaagtaatcctctcaccttggcctcccaaattgctgatattacaggcaggagccactgtgcctggtctgcatttattgagtataattttatatatttttctaggtgctagggatatggtagtcgagttgttgctattataatgtttacattttatttattatttttaaggaaaatgatattttaaatttagttttgttattaacatttttttaaattggcacataataattatatatatagggtatttatccgaaggaaataaaatcagtatgttgaagagatatgttcactctcatatgtattgtagcaatattgacaatagccaagatatgaaatcaaccaaaatgttcaacaacaaataaatggataaatgaaactaacacaagaacagaaaaccaaacaccgcatgttctcacttataagtaggagttgaacaatgagaacacatggacacagggaggggaacatcacacaccgggcctgtcggggggtggggggcaaggggagggatagcactaagagaaatacctaatgtaggtgactagttgatgggtgcagtaatccaccatggcacgtgtatacctatgtaacaaaactgcacattctgcacatgtgccccagaacttaaagtataataataaaaaatgaaataaagaaaatgtgtatgtatacaccatagaatactaatcagccatggaaaataaagaaatcctgtcattcatagcagaatggatggaactagaggacactgtgttaagtgaaataaaccaggaacagaaagttaaacactgcatgttctcgcttatgtgaaaactaaaaaaaatgttgacctcagaacagacgatacaagaagctgagaatggctggggatggggaggttagggagagttatgttaaaggatacaaaattacagctagataggcagaataagttctaatgttctatagcaatggtctccaagatgtttagcaccaggcaccagtttcgtggaagacaatttttctatggaccgttgctgggggctggtttcaggatgaaactgttccacctcagatcatcaggcattagttagattttcttaaggagcaggcaacctagatccctcacatgtgcagttcacgatagtgtttgtactcctatgagaatccaatgccaccgctgatctgctgatctgacaggggtcagaactcaggcggtaatgctggcccgcctagccgctcacctcctgctgtgcagcccagttcctaataggccacagaccagcaccttgcatggcctgagggttggggacccttgttctatagcactgcagggtaatctatagttaacaaccatttattgtatattttcaaatagctagaagagaggattttgaatgttcccaacacaaagaaatagtaaatgtttgaagtgataggctaattatcctgctctgatcattacacattgcatacatgttacgtgtgctttcattttcttcggaagagacagactaaataaatgaatatggtgatatgtgctttaaagaaaatgaaacagtatgatataatagtaaatgtgaatactattttagattggttagttaaggaaggcctctttggggagggaacatttgagttgatatctagacctgattgacagccatgtagaaatctcgggtaagatattccaggcagagggaaaagctatgcaaagaccttaaagcaagaatgaccttggcatgttaaaggaaaagaaagaaggctcatgtggctggaacctaggaagtgagtaaatggttagtaggggctagattgtgtaggactgtgcgtacatagtaaggattttagattttattctatgtgaaaagtgagactactggagaacattaatcaggggcacagagtgattaaaagtttagcactgggagagaaaagttggatgattatttgaaaaggagacttggatgaattctttcacccacatgaccttgtcttctcatctctaaaggtgaggataataatagttgcctaccttccaagattgtcaagaatttcataactggaaagaatcctagaaaatatctaacctaaatcctcataaagaagttgacgctcagccagattaaaccacctgcttatcttcagataggaggacagagctaggaggctccagaattttgtttctgctttgttttcctaaatgccatactgtatattcagtatttcaaatgatactgggaatgaacgcaaagggattttgcaaaccttagagtacaatacaaatgtaagagataattgttttcaggatactgggctctgagagaacaaagttatcataaggaatagattatttgggaagaaaagcactgataaacaagttgtactgatttttcaaatgctttgtctaggagccaccacagtcatgtcctgaatggaaacaggactgaaacccagtgaagagaaaatagaggttattctgaccatgagaaatagcacaaaagactccttttctctcctgtagtgtctccactagaagtgcaaagaggctttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgcccgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacagttaagagcagagcccataaatgtttactcttcagcaaccatctttcaggagtggaataaaaacaacatcaaaatgggacatctggtggtatcataatcaccataggcagttgaaattgtattgctttcttagtagtttctagataaaaaagaatattttattccaaaggtatttaaccaattaagctgtcattagaaaatattgaaagtgtaattgttaattacaccaacactaaatcctacaacaaaattaccttggattatctttctaaccttttattttaatctattttaatctttaacattttattttatttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcgtaatttatatatttaaggatgatgggaaagatgaccacttctgcagcaaatgtttagcttctttcttttgaaataatctgaatacctatcaggtgctccctttaattaaggagaaaattgcaatggaaggtagagatgtaatattatcttatttgctacattataagaatccagttattgacagaaaggtcaattctaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcagttctgaaggctggaaaatccaacatcaaggttctctggctcctggtgaggacctacttctggcttgcacatggctgcctttttgttgtatcctcacttggcaaagagagtgctttgatctcttcctcctcttataaggacactaattgcatcatggaggccccaccctcatggcctcatctacacctaattacttgctaaaggcttcaccagcagatttcatcacattaggggttaggggttcaacatattgattttaggacgcattcagtccttaagagtggtgatgatggaggctgtaaggaatgctagtttgtcttttaattaattacttaacttagtattaggaatccaatgtggaaaggaataattgtttgactgtgacactaggtcccttttttggttttcaacctctcccttagagcctgctccaagttttcctcagtgaggccttttgctggattggtctgaggaacaattctggctggaggtgggaagatggatcacctctaaacttctcaaggtaaggggcttcaaaggaatgcaaaaaaagagagagaggaaaaaggaaagccaaattatgatacttggggaatagataaagaagagcagatggagaggagaggaaagaatgaaaaggagaggaaatagggaacaaggaagggaatgaacaatgggtaagggcaaaaaaaaaaaaaaaaaggataacattttaaagagaggctgatgaacaattttaattcttctgctgtttgggggaattaggggcctgaatagggagacagaatttgcttcatttttatcccttcatgcctttcaactccttttctgtgcatgcggccttaagtgattgacttttctgatttcttacaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaagaatgaaaactgttcattctagttatttctgttagcccataaattagaggaattgaagatgagaaaaacagtatatcctaatcctccctaactcaccaatatgagtcttcagtagctaactctacaaaggcaaagggccagttaatctggatacaatgctcatagaaggaagtcgtggaaacaagctcccatcccctagtgatctcttccctttggttctggtgcaggaagtatcccttagttatgaatattttggtagtgactctcaattaaggatgtaatgatagcgattccatgtgggccatggcttggctactacagggtgcacaatttcatttacttattgaaagataagaaaaggagaactacagtcgggtcttaaattctcatctgagcaggcaggatgtgtgcagacctcctctgtgactagggttcaggccttttataaggattcatccacctattgtcagaattgggtgtagttcttcactgctttgtctcccttaaggttgttacaagagaagtaacagtttacttcctggttgcttatttattccttagacttatttatgaagggctggggtcagttagtaactcaattcttgcaccttacctagtgaaataaagtttggtaaaactagaaactaacattttttgattagcacttacattgcacagtggacttctttgatgaacattatacattaaacatatctgggacattcagtgtttggaataggacatttattaaagataataacagagcagtcacaaaattaaaatgaagaaaatccaggaacacacaggaggaggtggagcaagaacaagaagcctccactgatttttcccccgcaggaatacaaatggaacaattatccgcaaaagaaagcaccttcataagaaccaaaaatcagatgagcagtcacagtacctggttttaacatcatatcaacaaaagaggcactgacgaggacaggagagacagtcttgatttgccaatgccaccccttccccatctcccagcagcacagtgtggtgtggagagagagtctgtgctttggggaggaagagtgctgtgattatgggactttgcagtggaactcggtgcagctctgtcaaagcagatagcgacatgggacagaaatcagccagtgcccacagagggagcatttagaccagccctagccacaggggaatggcccatcccagtggtcggaacctgagtttctgctagtcccaccactgcggctaaaacactctgggatcctaaataaacttgaaaggcaatctag

SEQ ID NO: 13941 - DNA, 19146 bp, Human
  misc_feature (1)...(19146): n = A,T,C or G
ctattttcactgccccaactccagactacctcctacaaccccaggagaacgccccctcccactgcctggggaggctctcctaaactatagcctctagccaggccagcacattgaggtcattgctctccctgccaaatgactggcctgagttcagtgtctccatctgtctgagcttcatggaaaacttgattgttgctctaggctctctattctatgtcctgccttagctatgtcctgctttgcatctgcttttttgtttcttctcccaacacccttttcttcccctgactctcctcagactagaatcacatctgttttctagtctcagccccttcactggggagcagatggaagaagagcaagttctggggcaggaagatcaggaagagctgggcgtagcactcagcttgttctgcggactgaccagattccatgtatcttagagatgtagcacttacagctccctcggaggtcccagaggtgcttacaaagtgcgatttgcttatttctgtgtccactgctcttttttcctctcaactagactccttccttccttctttccttctttccttccttccatcatacccccttttattttcttctagtatgtaatttattaatactatctgctctctgtctacctgtactcttctctaatttatttcatcagggagatatataatgtagactaaaggggagccaacaggaaacctgaaacttacatatttctatggcatacaaggtccaccattcctcagacttgagtttctgtaattcaagtttgctcttgaatccaaagcgggaatgttttagtggttgaaccactagagtctctgtgaataagaagaaatacaaagcctttaaaattcctgaatcaaggctgagcaacatagcaaaatcctgtctctacaaaaaaatacatctaaattcgcctggcatagtggcatgcacctgtagtcccagcgacttaggaggctgaggcaggaggatcacttgagcccaggtcaagcctgcagtgaactgtgatcatgccactgtactccagcctgggtgacagagcaagaccctatcttaaaaaaaagaaaaaatcctggatcagagaaagtgttatctacacattatatgatctaaggaaaaatattggtagaaaatgaggcaagcataataaccttgcctttcaattttctttgggcatctgattgcattttatccttaagagcccagaaacccagattcttagttaagctcaaacaaagccaaaagacaaagtaaggctggcacccctttcacagagcttctctacatttgaaaatgatttggagagttctgaaaagttcctcaactttttataaccctaaggtagccagccttcctcttggacaaaactcataaggtatctgtgttcgcttggttgtgagaatacataggatattccaaggggaaaaaaaacaagaagagtctaaatgtgtaggtcaagaaagaggcagagatgaaaaagaaatacaggaataaaaagaaatttgttagtgctgaagagacgaatattgaaaaagaaagtgagaaagaaggatgaaggaatgattcaaatatggaatataaggaggctgaggcaggataattgcttgaactcaggaggcggaggttgcagtgagccaagatcacatcattgcactccagcctgggtgacaggagcaaaactctgtcttaaaaaaaaaaaacaaaaaacaaagaagaagaagatagccagagagagagaaacagcatctataatgtgcattaaaacacaccaaggaggagacggaacttttcggtaagaaagaacccaaggaacaaaggggagctgggaccagatcgtgagaggagggaaaataggctaatggaagaaaggcaatacatgagctggggccaacacttccagggagcagcaagagctctcaccagtgtagtcataacatttggaatgagggtgtgagcaactgcaaattcccatctcccttctcattccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacagtgagttatttgattacctgaaaccctaaagagacagagggaatgtgtgtatgtctgtgtgtgtgtgaaagggctggagggggcaatggggaatgtcactgaacttagtcttgagcagacctcccaaataaccgtggaattctgatgaaggagacgccaagatgagcagatgatatgaaaaagtcacgcatatgagaaaggaagattccacatcaggggtgaaagaggccaaagggtagggccaagtacggaccatgtagaatgtaaaatttcctctgacttggtagcagagaataataaaagcaagaataatggtaagtgaccaaggaatagatttgagggagaaatgaatgttgggtgaaaggtaagaaaagagagaaagggtttgagtcataagggaaaatgaagaaagttctgggaagacaaagagacagggacctcagaggcatctttccctggcactgaaatgctgatgtgcctctgagcatcacattctctgctatgcccaccacccctatagatatgtcgctcttgggacccaaggtgctgctgtttcttgctgcattcatcatcacctctggtgagtcctttattctttgctccctaaaccctcagctcctcagctatacacgtgtgtggcaggagatgggatggaatgaggtcgaagaggaatagcagtagagatgcttggtattgagctctggaattcctattagaagaacagattttgtgttaagaaaaaaagttcaggaatgtgactagacttcagactaggggaaaggcctcccaagaattatgaaactaaggtgcaactaagatacacacaaatgcatattaaccacccaaagagggtcacatatgagtaaacaaattgcaaagcaaaaaagaagctgatatacaaatgcatacacaaacatagaggagggactacctagaaagaaactggacctgggctgggcatggtgggctcacacctatactcctagcactttgggagactgagtggagaggatcactgagaccaacctgggcaacatagtgagatgagttaacctcatctccattaaaaaaaaaaaggaaaaaagaaaaaaagaaactggaccaaatgtaaatcttgaagaagaacagtgggaatacatacactattaccatcatgcatgcaggtatactcacatgcatgcaaaaaatatatgccatactgacacacaagagaaaagtgatcttcacagatttcccagaatctggctagaagactggccacagaaagtgaactttaggctgtaaagatgtcctactctatttttttccctccttcttccgatacagattgagaaaaataattcttctgtcttgttcactagcatagctagcggggaagccgtggggctagaagggctgccaggcctctcagtggagctggacttcattcctggccaggaatgagggtaagagggcagcagggctttgttctcaggaacttgtcttttttttctttttaccaaacaaatgcacagcagtgaaggaacttgtctttctgaagtctttctattcctattggttttgttcatagcactaatggtctcagtaattttatattgagctatataggaataagtcacaaagataatgtataaccatttctccatgattttctgatttgtctcataaaagggttacgaggtatagagctgcagtcactcacatctcttttctcttcctttgctatagactggatacccctgggggtcaatagtcaacgaggaggtaggtgaacccttggatagcggctctgttggggttcttatcaggaaaatttagatgaacagagttaaaaaatccttcctgcttatctatcgctgccaaaaaaaaaaaaaaaagaatatttcctacaacaaagagatgcattgccaaagtgtgagaaataggatcaacttcaccagtttccacaatcctattatcccattcataaaagcttcttgtgtgtgtgtttttaaactactgaaacaccttcccaagacatcctctatgaccatttctgttttcatttttctttacacatctcctatcttactcagaaaatgcttactagtccttacaaaaagcgttccttaattcatgtaacagtggaaaaatgaaagacaggataagaagtcatcttatacccataatcccagcactttgggaggctgaggcaggaggatcgcttgagcccaggagtttgagaccaaactgggcagcacagggagacctcatctctagaaaaaaaaaaaattagcctggcatggtggcgcatgcctgtggtcctagctactcaggaggctgaggcatgagaatggcttgaacccaggaggctgcggttgcagtgagccatgatcatgccattgcactccagcctgggcaacagagtggaactgactaaaaaaaaaaaaaaaaaattagaaaaaaagaagtcatgtcaatcctaggtgaaattgtggcacaactgagcaaaacccaaaaggtattttttggtttttcagctttttaggtaatttttgctcacaccattctctataacaaaaatcccaaaagttgtgacccctagaggaccacttccttcgacttcatgaagaaaactccattctgcctcaaggcattcaacataattataatttatctctttatttctcccatcccaggagagttagaggacagagcgctccagtaggcaacctattaatgggatcatgaaatcaatttagtgggtcacaactggtattaatttttaaaatgaattaagatagaccaaaacaaatataccgggatgcattgcatgtgttttgcaagagtaaagtattatttcatacaactttaataaaacttctcttagttttccatatgtatataccagggtacagtatatttttcttgcagtgggtcctggtacagaagataaaaatacaaaaattttttttctgttgttggtaaaaatacccgaatccccgagtttctgaatctaaatctgaatctaggaaaaaagggcaggaatgtgactagacttcagactaggggaaaggcctcccgagattttagtaccagcaaaactgaaaatcggaattcatttttctgggctgattaggaaccagtcctgtgttaagactttagatgcttttctcgcagacatatcataaggtatgatgaactgtcttgcctggtgtggtggctcatgcctgtaataccaagcactttgggaggttgaggtgggatgatcacttgaggccatgagtttgagatcagcctgggcaatatagtgagacccttttattttttttttttttcgagacagagtttcgctcttgttacccaggctgtagtacaattgcgcgatctcggctcactgcaacctccatctcccaagtacaagtgattctcctgtctcagcctcctaagtagcttggattataggcatgcgccaccacaactggctaattttttgtatttagtagagacagggtttcaccgtgttagtcaggctggtcgcaaactcctgacctcagatgatctgcaggcctcggcctcccaaagtgctgggattacaggtgtgagccactgctgccagcctgagaccctatctcttaaaaaaaaaaaaaaaaaaagccaggtgtggtggtttgctggttgtcctagctactcagaaggctgaggtgaaaggatcgcttgagcccaggagttcgaagctgcaaaggagctatgatggcaccactgtactgcagcctgggcaacagagtgagactctctcaaaaaaagaaaaggaaaagaaaatacgttaattttttttttcagagagaacttcatgaatactagataaagcatttatatggtgatagctcttggaacagttggttaaactgaggtatatgcagaaaagcagtactctgccctgaaatcccagagacagctaggatacattctcaagccctctgttcccccattgctttgctcctgtttctgtgagtggctggactggaatgtagctaggcctctagagaaagggaaccaggaaggattgggctacacccgggagaggctccactcctctcctgcagtctctggaatgattcaggttagtggtttttcaaatatcctgtgggattggaacagacttggattccttttgttaaaagattgttcttccaatcaatgacatcctacttaaaaaaaaaagtgttctgaaagaagaaagcccataatgagtgtgaaaggttaagaggcttttttgtcaagcctgatgaattttttttttggcagagtctcactctgtcccaggctggagtgcagtggcaagatctcagctcactgcaacctccgcctcctgagttcaattcattctcctgcctcagcctcctgagtaattgggactacaggcatgcaccacccatgcccagctaatttttgtatttttagtagagatgggattttaccatgttggccagactggtctcaaactcctgacctcaagtgatacgcatgccttggcctcccaaaatgctgggattacaggcatgaaccatgaagcccagccaaacctgatgaatttctatctggaatttagaaaacaggatgaggtaagcaagggaaattcctatgaaatgctttatttgtatttcaccttttttataattatccataactctgatatgctttataaaaatatttgttcccatcagatttacatctgacatttattaatagaatctgaagttaaaaaaagaagtcaggccgggcatggtggcttatgcctgtaatcccagcacttcgggaggccaaggtggttggatcacctgaggtcaggagctcaagaccagcctggccaacatggtgaaaccctgtctctactaaaaatacaaaaactagtcgggcatggtggcacacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacatttacttttattttttaatttacatataaattatattgtatgtgtttacagtatccaccatgacattttgatagatgtgtataaagtgaaatggttactacagtcaagcaaattctcatatccatatcctcattagtttccttttttgtatgtgtataataagagcacctgaaatttactctcttagcaaacatttaaatatttagcaaacaggccaggtgcagtggctcacacctgtaatcctagcacactgggaggcctaggcgggcagatcacctgaggtcaggagttcaagaccagcctggccaatatggtgaaaccccatctctactaaaaatacagaaattagctgggtgtggtggcgggcgcctgtaatcccagctactctggaggctgaggcagagaattgcttgaacccgggaggcggaggttgcagtgagccgagatcgtgcgccgctgtattccagcctgggcgacagacagagccagactctgtctcaaaaaaaaaaaaaaaaaatatatatatatatatatgtgtgtgtgtatgtgtgtgtgtgtatgtgtgtatatatatgtgtgtgtgtgtatgtgtgtatatatatgtgtgtgtgtgtgtgtgtgtatatatatatatattagccaggcatggtggtatgcgcctgtaatcccagctacttgggaagctgaggtacaaaaattgcttgaacccaagaggcggaggttgcagtgagccgagactggccactcacttcagcctgggtgacagagcgagactcttaaaaaaaaaaaaaacaatactaccttttatgaacactcctaagcatatcagcaaattcatacccaattatatcagaattatgggccgggcgcggtggctcacgcctgtaatcccagcactttgggaggccgaggggggcggttcacgaggtcaggagatcgagaccacggtgaaaccccgtctctactaaaaatacaaaaaattagccgggcgctgtggcgggcgcctgtagtcccagctacttgggaggctgaggcaggagaatgatgtgaacccgggaggcggagcttgcagtgagccgagatcgcgcccctgcactccagcctgggcgacagagcgagactccgtctcaaaaaaaaaaaaaaaaaaagaattatgaatgtcaaaatcacaatgcctttggtatatccgatttcattttaaataagtattgcaaagaagtcatcaatcgtttgtcattattgtaagcagtcaaggaaaaacatttgtgggatactcaactccgctgggcactatgcttcgcaatttaacttactggaagtgcaagggtggcagggagacagagaatctcagaaattgttttctaattttcttttcagacgatgtgactcaagcgactccagaaacattcacagaagatcctagtaagctacacttttgtttgtttgtttgtttgctgttttattggggatagataaaggatcatgtctacataaagaaaaataaagacttcagaagggttggagggtgctctgagctcatgcagagttctgttgtcaccttagatgccagcatctctgtacgcatgcccagtcttactctctcttccatttctttctgcgatagtccctcatctgcccgagtccacaggctttcacttcagcctttcttgcctcctttgagatcatcgtccccttatcctgctttccttagctacttttcctgactgcattttttcattccttgttatgtgtctttgcagatctggtgaatgatcccgctacagatgaaacaggtaagttttaccgcagttaaaaaaaaaatggcatggttcttgttaatattcacaatatttattccagctcttgaattcattctgtgcttttatatttgcttttgttttttgttattgttgtttgtttttgagagggagtctcattctgttgcccaggctggagtgcagtggcacaattttggttcatggcaacccctacttcctgggttcaggggttcaagtggttctcctgccttggcctcctgagtagctgagattataggcacccgacaccatgcctgactaatttttgtatttttagtagagacgggatttcaccatgttggccgagctggtcttgaactcctggcctcagcctcccaaagtgctgggattacaggcatgagccacagcgtccagcctgcttctatctttggatactgaggttgtgagagtgttgttcagtgacagtgctaattttttttttttttttttgagacagagtctagctctgtagcccaggctagagtgcagcagcacaacctcagctcacagcaacctctgcctccagcattcaagtgattctcctgcctcagcctcctgagtagctgggattacaggcgcctgccaccatgctaatttccgtatttttactagagatggggtttcactatattggccaggctggtcttgaactcctgacctcaagtgatccacctgcctcagcctcccaaaattctgagattacaggtgcgagccactgcgccccacccaggactaatattctttaaaaaaatttataattatttaattaattctattcccttatacataaaacacaaagccagacatagtcttccacctgccacggtatctccattctcccttttcttactctgccttgtgtttgcaatttgaagccctcctcatacctgctgttttgtgccttttcagttttggctgttttggctgatattgcaccttccacagatgacttgggtgagttcagatctgggacccccaggtcatcagggccattctaggctttccccagagcccattctggatagtgtgcagctgctgaaggatcctaaaaagacaggatgacagtttatggagcacatatttccagtagttcaattcaaattaatgacattgttgaacacctgacaaacaggaactgtgctaatctttctctcaaagtttcaagacttgatgggtaaaggcaagataaaagtataaacacgttttggaggataaagggtagaagaagtaatgctttgactgaatttttttttttttttttttgagacggattattgctcttgtcgtccaggctgcagtgcaatggcgcgatctccgctcactgcggcctccgcctcctgggttcaagcgattttcctttctcagcctcccaagtggctggaattataggcacctaccaccatgcctggctaattttttgtagttttagtagagatggggtttcgccacgttggccaggcaggtcttgaactcttgacctcaggtgatccacctgcctcggcctcccaaagtgctgggattataggcggctagattattttttaacaaatcattattgaaaacttgctactaggtgccaaggatataaaagtgaacaaaactgattttcttctactagacatcttttgtgtaatatacaagatagacaaataaacagataactttattcagtttcacaaaattcgataatcaggataagcaagagaagctatggaagacacagaaagagttcttgactaggttcggtgctgggggtgagaaaaggttttttgtggagggcacatttgactaagctgcttcctgaaagacaagtaaaagtgaactaagttaatagaagagggaagagcttttaggtaaggaaaacaatataaatcaaaaggtgtagggtggacacgaaaaccaaccagagagacgtttatgcaaggtaagattataattagatttgtgcattggaaggatcacaccccacttccaaaccccctactgtactcccagggcagtgtggaaaactgatttgaccgtgattgatcgcctggaacccggaaaaccagcagggccactgttgcagtgttcccagtaaaagatgctgccctgaatcaaggtagagatagggagaattaaatgtgagctataagggagaggggattgttgagttgacatccagttttctttttcttttttctttttttttttttttgacacagagtcttggtcttgttgcccaggctggagtgcaatagcgcgatcttggctcactgcaacctccgcctcccgggttcaagcaattctcctgcttcagcctcccaagtagctgggattacaggcgcccaccaccaagcctggctaatttttttgtatttttagtggagacggggtttcaacacgttggccagactggtcttgagctcctgacctcaggtgatccaaccaccctggcctcccaaagtgctgggattacaggcatgagccaccacgcccagccatgacatccagttttctagatgtggctattgggtggatggtggtctcattcactgtataacaactagaattagtgaagggaaagataattaagtctgttggatatacattgaatgtgaaagatctttgaaatattcaagaactcttccataaaaaggcagttggatttataggtctggagtttaggagagagatgaggttggaaatacaggtttgggaattatcagcatatacacctgcctagaaaccatgggatagatgagatctcataacacaggtcctagtattctatttgcaacacttccagtgacattttccctggtaactcccctgactagtctattcatctaactccttggcttgttcttcattctgtgaataaggcccatgttaaatttgcccctaggttaggatgactctcattattctttatttatttatttatttatttatttattttgagatggagtctccctctgtcacctaggctggagtgcaatggtacgatcttggctcactgcagcctctgcctcccaggttcaagtgattctcctgcctcagcctcctgagtagctgggattacaggtgcacatcactacacccaactaagttttgtatttttagtagagagggggtttcaccatgttggccaggctggtctcaaactcctgacctcaaataatctacctgccttggcctcccaaagtgctgggattacaggtgtgagccattgtgcccagctgaccctcattattctttacccaacagcttctatcaagagaatttatgatgatgtatctaatctacagaaaataaattttctcttataaggaagagcttgtacaggataataatcttttctctgcttagctctaggaagaagctcctctgggcatgtaactctttgccttgtgttcctactaaatttgcttcttgtcaacaatacagagatactcacaatacaatgaatttctcaactctttagaaaggaaaggagaaaggaaaaaaatcccatcctgcctcctaatgtcttcaattttgtggagcaaatcagctcaataagggttttcttttagaagttgctaagagttattaattcatttgctccctatttatgggcactccaagcaggtcctaagtgaggcagtgtggcagttacagaagtagtaacttctagaattggtaacagtggaataaaatttctgcctttcagcctccctcagtgaaaaaaataccactgcaggtatgattgttgcttgcatgccttcttaagcctttttttcttcctgtggattccttacctccttgttctttggagggtacttggcacatcttctagtttacttccaattatttctcaaagagtattagtgttcttcactcccttactcttttttttaaaaaaatgagcacctgtcataaaagtcaaggggaaagaatggaacaaatgttgcatggtccccaaatagccctctccctaaagtacccttgcacattatgtggtggttagtggattgggaagtgaaatcaatttaacttcaaggactccatattaccacggaggccatggttaaaattgcatttcctaatgtactgataattctgatatatagctagggttgaaaactactggaacagagaaatagcaacctgcctaagaaatctgattctttcagaatgggattatcagcatttctattttattttactattttgttttattttattttatttttctgagatggagtctcactctgtcacccaggctggagtgcagtggcgtgatcttggctcactgcaacctccgcctcccaggttgaagtgattctcccgcctcagcctcccgagtagctgagattacaggcaactgccaccactcctggctaatttttgtattttcagtagagacggggttttaccttgttggccaggctggtctcgaactcctgacttcaggtgatctgcccgcctcgtccccgcaaagtgctggaattacaagcatgagccaccgtgcccagcctattttatatttcataacggacaattctagaaagactttattcctagaagtgctctcagagattattttatccacttctacttccaagtagggaagcgccaaaacttcatttagtcaattccctcttgctgtgtttttggtggacggaaaggatgtagcccaatttataatgattctctgtagagattactctgtatttttttcctactctatctatccttcccaattccttcaatccttcatttatgctgcttctatttggacctccttatttttttgtattgggcttcctcagagtgctgggatgagaaatttacctgcacaaggctctactctgtgcatcggccggttaaacaatgcattcatcagttatgcttcaccaggtaagggatcccagaatgcccaaaaagcatcttccatggtagtgtttctgtgttgataactatttaatgagcacccactatggaattgcaaactttgatggggccaaagtttttagcacaaccctcctagttattgctgaatgtaccaactagaacctggagtatgggctgaagtgtacaaagaacaggcagagtaatagaacttagaagggaaatgaaggtgggcgctggaggaagaagggtcatgagggaaatactggcatgctcaatttattacctgatagaaggagactgaagagaatggcccagctctaaggtagaaaatagtggggaggaatattaagcctgactttaggtagagtgtgcaaagtgtcactaagaagaataactaaaacaatggcctttgcaacaacttggatggagctggaggtcattattctaaatgaagtaactaaacaatgaaaaaccaaatattgtatgttctcgcttataagtgggagctaagctatgaggaggcaaaaacataagaatgatataatggactttggggactcaggggaaagagtgggagaggaatgagggataaaggctacacattgggtacagtgtacactgcttgggtgacgggtgcacccaaatctcagaaatcaccactaaagaacttatccatgtaaccaaaaaccacctgtacaccaaaaactattgaaataaaatttaaaaaacagaagagtaattaataccattccctcccctattttccagttggggggcaaaagtctgaaatacttaagaaaatacagttggggaaaagcagatagggaaagtggggaatatgagagttgaagaggcatcccagacccaggtgagttctcctctcaaggctttcttccatctccttccttgcctatgacactgggacgtctgcagtttacgacgtatgtacatcgtcaacaaggagatctgctctcgtcttgtctgtaaggaacacgaagctatgaaaggtaagatgatgtctggatgtttaatggagagaagcagttatgagaagggtagatagggacatgatattactatatccaaagtctggtactagaggagggcttcaggctacccccttagagtccatcagctcctgctggaagttatctcaaataaacaatctacataaagcagtatgcttgatatacaaacataaccctaagaaaagtacccctagatccctgtcctactagattgtaaccccacagtgtctcctacttagagagctttctgacactctggctattttaaagatcattcactggggttctagggaaaatttcaagtcagccattacagataatagactctgctagtccgcagccatgttcataactaaaaataaaacatacacacgcacatgcactaatttggagacagtaaggtttggatagggcctataaataaaaaatagatgggacatttagaaatcagctatgttataaatagttcaccaattccaagaacaatgaacatttcttactgtgacatttcaggtagaagaaggtagaaagatgttatggggcaattacgagggcccaaaatgtgtggttgtagaccatacatggtggaaacaaagatactctcaccttccccatggccagccccgaacgatggctgtggttggtgaaaacaccacagacaaagccatttctgactcagcagcccgctttgtgctgagttcctgagtaagagctgtagttaacttcgcagaaggaaacttgctgtgtgcccccattggctttgtgcaagccacctgcaagggaagcaccttgagattgaggatgggtatttgggactctaggcactttcaagtatctcaagggacttcctaaagttagctgtttgcccatagtaagcacgtaaatgtatactgaatgattggatctcatttttctatttaatagatccatgattagaagaattggcagctggatatataaaggaaactaacatttactgctcacctgtgctaggtactttgcatacatgatttcattttaatactcagaaatatactgttgaggtaggtattttaattctcattttacagaaagggatagtgaggtttataaaatttaagaaactttctaggaagtggcaaataactaaagtaagtggcagagctggttaaaacccggatctttttctctccaaccttttcactacaccacactgaaaagtcttctctatcccttaaaacaagagcctttgttatcttctgcattctcttcccatgatgttctgcttctcttctagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctggttctttttctcttctatgtttacgaaaaaggcctgaatttatgaacttttattccactttaaaaaatgtgtatcagccgggcgtggtggctcacgcctgtaatcccagcacttttggaggctgaggtgggcggatcacctgaggtcaggagtttgagaccagcctggccaacatgataaaaccctgtctctaagaaagatacaaaaaaattacccaggcatggtggcgggtgcctgtaa

SEQ ID NO: 13942 - DNA, 14684 bp, Human
caaaaaataacatttcagcagagggacctcaagggcagaggaaggagtgtgcgctctttgcgtgagcaagggagagagtggaaggagatgcagccagaggggtgaagcagagcagacggtagaggggcttgtgggccatctcaggctgctggcctatactgagagaatgggaagccatggagggttatgacaggggagtgacatgaccttaaatattccagaaggaatactctagttgccatgtggagaacagactgtaatcgaagaagggggaggcaggaaggccagttgggaagcaaaatgcaataatccaggttgcttggacctggaggtagtgagaagtggtcagtttgtggctatattctggaagcagagataacaggatttgctaatggagtgtgcatggaatttaaaagaaagagaggagctgagagacactctgcccaggttttgccaagcaattggaagaatactgctgtttattgagatgggaaagacggcaagaagagtaggtaaggcagagaacaggggttctgttttagacaggctggaggtgctcagacatccaaatggagattctgagagggaagctggatacacttgtcttgagtttcaagaagtggtctgatagatttgcctgtgtccccacccaaatctcatcttgaattgtagttcccacaattcccacatgtcatgggagggacccagtgggaggtagttgaacaatgggggtgggtctttcccatgctgttctcatgatagtgaataagtctcacaagatctgatggttttataaagggatttccccctgcgtgagctctctcttgcctaccaccatgtaagatgtcccttgctcttctgccatgattgtgaggcctccccagccatgtggaactgtgagtcaactaaacctctttcctttataaattacccagtctcaggcatgtctttattagcagtgtgagaacagacgaatacatggtccaagctagggctattgatttgaaaatcatcaaggtatagatggtatcaaaggcttgaggcaggaagagagaagagaccctagctgcattgcttagcattgcatccctagcacctggcatagtttccattaacagtaggcatgaagtatctactcagtgaataaatagaatgcatatgggctacagtaggagagagaaataaaatctttaatagaccaagttctatgagagcacaaaattaaagtcttttatttgaagatcttagcctgttttccaaattcagtgcagccagttagacactgattctgtctggtgaaacaagcatttttgtattttgggggactgctgctgcttctgactccaaattaaggattttttttttttctaaaaaagatggctcatgcaaaaatcactctttggtgtaaatatctagtcttcaagcaattcttgtaatgcaatcagaaagaaaaaaatccatggtttgggaggcaaaatttttgtgttctaaattctatataactgagttcatttgcttaactgcaaagcaggagctgctagtgcctgtctgtactgaggttcagagagactgtgggaatatgggggaattagaggctatctgaggctcttcaacacaataacccaagaagctatttaaatgctctttaaggtatttacataaatattactattctcattgtgcttttattttgtgttatcatgattataattgaagtgtctactgttactgcctcctgatctttgctagctatggagcatggactgggcttttagagcagcagccccaaaggaacctaaacattaaagcagagctgccctcaatggtttaacctgtgtgactctgcctatgacagccccacccacccatcttcactggatccaaatcaggagcaaggccgttggggtacctggtgggggtgatgctgtcaggggaggagcccaaaagggcaagctcaaatttgaatgtgaagggccaatgcactgtcagactgagacagagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggtaataaatctagtttgctgcctaaagtttaaagtgctttccaataagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaaccctgtttctataacaaaaattagccgggcatggtggcatgtgcctgtggtcccagctactagggggctgaggcaggagaatctttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaaggaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaagtttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccacgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagacctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggttcaattctgttttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttccttttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttgagagtccagaagttatcccatacatctgtaatcaactaatttctcacaagggtgtaaggaccattcaatggagaaaaaatgatcttctcaacaaatggtgctgagctaattggatattacatgcaaaggaatgaatttgagtctctactacacaccatatataaaaattaattaaaaattcatcaaatacctaaatattagagactaatttataaaccgtagagagaaacataggtaaaaatgtttatggctttagattaggcaacagcttcttaattatgacatcaaaagcacaagcaaccaaagacaaaaataaataagttggacttcatcgaaattaaaaatctttgtgcatcaaaggacacttagtaagaaagtgaaaagacaacccacagaagtgggagaaaacacttgcaaatcatatatctgataagggttgtgatattatgatatatatataggtttttgtccatagttcctggcttataaaccccctcacccttgttacagtcatttgttataaggttggatggtttaggcctcagaagcaaaactctctctctcaccttctccagccctcctgtctctggcacctcattcttccctgaggccacatagaaactagaatctctcttccacaaggcggtcaaagaaaccagcacctcctttcccccaaaccagtcataaaacctaaaaatattactctaattccccctcctttccatataagcactggctataaggaaataatctgactgggcatgatggttacgcctgtaatcccagcattatgggaggccgaggcaggcaggtgccctgagccttggagttcaagaccagcctgggcaacacagtgagaccccatctctaaaaaacttagccaggcatggtagcacacatctgtagtcccagctactcttaaggctgtctcaaaaacaaaaaataaacaaaaaactgacctatcttgttggattgtagatcacgagaccctcattccagacagggtcctgcccatatcctgggtgaaggaatgctgcacagagaggccaagaagaatctgaacagacacgccttactgggtttccccagtctatcagcattagatcatatccttttttctttttcttttttgagacagagtctagctctgtcacccaggctggagtgcactggcgcggtttcagctcactacaaccttcgcctcctgggctcaagcaattctactgcctcagcctcccgagtagctgggactacaggtgcctgccaccacgcctggctaatttttgtatttttagtagagatggggattcaccaaattggttaggctggtctcgaactcctgacctcgggtgatctgcccaccttggcctcccaaagtgctggggttacaggcgtgagccactgtggccggccttgatcatacccttttttctaatcacaattttacaggttgtccacgcttcagttatgcctatccaatgaagtctccataaagcccaagaggacagggtttagggagctttcagagagctaaacacaagaaggtaaacaaaaactcacccatgtctacagtgcaggtctacagaaaaatacaaaaacaaaaacaaaaaaaatccaaactcatctgtgtcctgggagggtggcataccagaactcgggggggatagaagtttctgtgctcaggacccttccagaccttgccctatgtatctcttcatctggctgtttatttgtgtcattatcctttgtaataaaccagtaaacataagtatttccctgagttctgtgggcagtcctaatgaattaatcaaacccaacaaaggtcatgggaaccccaacttgaagtaactggtcagcagttccagaggcctggacttgtgactggtgggagggtggggatgatcttgtgggactgaaccctcaacctgtgggatctgaaactatgtccaggtagatagtatctgaattgaactggaagatacccagcttgtgcctgctgca

SEQ ID NO: 13943 - DNA, 29624 bp, Human; identical to SEQ ID NO: 12367

SEQ ID NO: 13944 - DNA, 25111 bp, Human; identical to SEQ ID NO: 12435

SEQ ID NO: 13945 - DNA, 117391 bp, Human
  misc_feature (1)...(117391): n = A,T,C or G
ggattacaattcaacatgagatttggcagggatgcagatccaaaccatatcaatcagtaacctaggaaacttgacggcattttcagtgcccttagctaaactccttaacctatctaagcttaaatttccttatttgataaggaaggaaaataatatttatattatctgtctctcagagttgtgagaagaaatctgacagtactttttatttgtatttatcatcatcatcattattattcattcattgctcaactgcatggacagtacgttgaaaatagtaaattagtatcacctccctaatcacttccccaatgttgttgaaatgtgtcaatatttgaatatatacaaactgagtgatttctacagttaaacctcaagtagagaccaagatcaataatacattaaattttaataacttggattaagtcgtgtttgggttaacgataaatatcaaaagataactattacacctattccagataataaatgtattactttccataatatctggaataggtataatagttatcttttgatagattccttgatggagaatctggtggcaaggggaagttaacgtttttagtaggaaactgagtttttcctttcagaggtcgaagagggaaactggttccctggggccctgaataaggccccagtaaaggcaatattcaataaatacctggtgctggcaatttttaatttggttgagtgatgtttttactcctagttattttgattctaaatgactttatggagatacatgaacatatgtccaaagtctttggacaacacttttcatagctgattatatccgaagcatttaatgttcctgttgaagtgaagagcttgaaatatagggccttttgagactattccaaagcaggtgataaaaacaaaacaaaacaaaaatccaggagcaaaaaacgaaggatcagggtgggtggctcatgattgtaatcctagcagtttgggaggttgaggcagaaggattgcttgaggccaggggttcgagacgagcgagggcaacataatttgatccctgtcgctataaaaaattaaaaagctcagccaggtgtagtgaccgacgcttgtagtcccagttactctggaggctgaggcaggaggatcgcttgactttaggaggtctaggctgcagagacccatgattgtgcccctgtactccaggctgggtaacagtgagatcctgtctcaaacaagcaaacaactcccacccctaaaaaaacgtgcacatgaccttaaaagtgtaggaagattacatgataaggagagtcagagaaaagagaaattaggacaggaaagcactacaagctatgtatgtttattttataattgagtctttaagggtacggagtattcgtactcaacttgtacccccagtgtctagtacgctgcttggtaaacagctggcaatcaagaaatgtttgctaaattttaaatgaattgatgggggcggaacttcagaaagtaaagcctgactcgctttatttctaagaaggcagaggaagtaaaaatctagttttccgtactctgtcccctttttaatccttctctgaatgggtgtccttgattcactgacatttcctaattaaccaagttctgccaagtttcacatgaaacttggggaaccgatttcattcccccagtatcaccctgtggcgccaccttccggagctgtgaggaaactccggacttccccccaacaccgccccctccctccaccctcggtctccgctttctgcgctctgccgcgttggttttcggaggtgtctgggcgcatgcgctttggacgggccgcctagcctaggagagactacaattcccagaagacagtgcgaaagaaaaaaaaaatcccgcggtccgtgggggtgggagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggtgaggcgctctggcggccggcgggcgctggccgggtcgaggacccgccggagtgaccagcccactgggcggggtggggaactgccctgacctcagcggctgccaccaacccgagcccctaccgcagccccaaccccagccccaaccggggacagagcgagtggccgggctgagggagtcgggctgcgatacaggaagtggctgtggtggtggaaaccgatagaaggggagagagaaaatgggcgagggagccgggagcccgccgctgccgcagcccggcgcccccctcgcgtccgcttcccccagggcccggccaccggggtcgcgcgccccccaggtagcctccagtccgcagggctggagtcccggaatacccccgagctgccgccgcgccgcctctctgcgccgggagaggaggtccaggacgggagaggggagaggagagggcagggacgaggctgaagccgcagaagggagaggaccagcggggtgtgtgttgtgtgtcggcggagggtggggtgggggcgattatgtcagtttcagcccccagagggtgtgtcttttatttatttatttatttaaaaaaaatttgtcatgagtcacattacaccgacctcccggaggagaggaggaagcgggtgtggggagtgagggagggcgtttgagagaagttcatcttaaaattcctttaattgaaggtttgtaaatctgtctgcttgtccattttcaagtcgggttttttttatttttttccccctctcatcgttttcacttccgccccaccataatgtattctaagaggttgttagggctgctatcattaattatcaaacacgaattgttcttaactccttggaaaaacggcttaccctcccttctcccaaaagttcttgagctgtaggcttcataagtaacttaaaatagactggtgtcatcgccggttgcttattttctgaggtttctctcttaacaagctaagtaaatgtatagtatgtgaatccaaatacagaaacgaacagaggtagcctctgaactacaacgtaaaaatatctgttattgtaaattagaaaactcttgggactttgtgacagatgcttgtttgttcgtttctctttggatgattggaagtgaattgtgtgtggtagtttgttttgaagatctttaactgtgtaaaccaacagtttgcgctagaaacaaagtagcacagtcctttgtataaatataaaggcaccaggaatgctcttgcttttggtaaggcaaggccaaaacgtgctttgaaaggttagggttattgcaattcagaactaaattgtttatagaaatgtctcccatgtgattataatttttaagaaccgatgtttctgtgttggcaaatgcttcccctctttatttttagagggagatgctgttttcagaatgttttgaatatttctcagttttcatgttagtaacattgtatcttcagtagcactactcggaatttatcttcacaatttttttttcaagctttcactttaggaattctcctgataagtgaacttgttgaatgcctgccacatctactgtatcactttgtgcaaactttatatttagcccttcgaaaaacttttaaaaatctagtagggatgtggatatggtttgcaaatataaaagtgatctcgtagtttatcgatattaaaaataggcaacttttattcaacttaacatgaaaagccttgaaattgaggagaaccttaatttgctgaaagttttaaagatttttgaaagccaaaaggagagcacagtaagtttaatttctcgctttccagaaaagttatgtgttctctgtagaagtcagtagataagtgcttcatacaggggtggctcctttttgttttgcatgttgggaaatctgacaagtatatagtgtggtaactatgtgttggcaactgttagtaactgtaaacgtgttttaacctgtctgtgtactattactttttcaggtagttgtatgttgtaatgctttttttttacccctctctgacccctttcctttactcctcttgctacaatcatgtaactttgaagcactttaaaacttcattgctaatatctctaattaagtcatgttatttttcatacagtctctcactttataaaatgttagtgccatggtgcacgaatagccacagtcagtggccccgttttttttttttttttttttttttttctttttttgtgggggcggggtggggtataatcctaaatctgacaccagtgaggtgttttgttcatattggaaaaaaaaaaaaagaattcacgcaaagcaatgattatctaaataccttagtagcctttatacgttgggctgcatgatccaggccactagttgcctccctaagggactcagacagggtcaggctcagaaagtgatgtggaagttgatgtggtaggtggtgctgctgactttggtgctaagaatggggaatgaataatattagaaatatccattagggtgtctgttgaggtctttctgtatccttcctgtgacctgattgggttatttataactaatactcttcctaaatatatatctcttctcagtgaaagtatgcagttcacgtgtgctttgagaatttttaaataaggtgagctaagttattgcttgggtgatttttgttctgagattcacttttcatttcgtttttctacagtttgaaagtgcagtccagtttagctaaggtgtgtagctgagaaactcttttggctgtggtgcatttaagttcttgcggcagtttattagttctttggttctgttgacttttaactagtaggttgtattattaatagcaaaacatctgaaaagattctactacattaaaaaggacagtttttttctttctttctttttttttttttgagacagacttgctctgtcacccaggctggagtgcagtggtgtgtgaacaccattcactgcagccttgacctcctgggctcaagcagtcctcccacctcagcctcccatgtagctgagaccacaggtatatgcaaggacagggttttaacagttgccatggggtaaataatactaaaaatagaaagtttttttttttttttttttgagacacagtcttgctctgttgctcaggctggagtgcagtgatgccatcatggcttactgcagcctcaacctcctgggctctggagatcctcccacctcagcccccccaggtagctgggactacaggtgcgcaccaccactcccagctaatttctgtatttgttttgtagagatggggttttgccatgttgcctaggctggtctcaaactcctggtctcaagcagtctgcctgccttggcctcccagtgtgccagtattacagacataggccactgcaccttgccagaaagtgttttttttttttttttttttttttttttttgagatggagtctcgctctattgcctgggctggagtgcaatggtgcgatcttggctcactgcaacctccacctcctgggttcaagcgattctcctgcctcagcctctcaagtagctgggattataggtgcccaccaccacgcttggctaattttttgtgtttttagcagaggcagggtttcatcatgttggccaggctggtctcgaactcctgaccttaggtgatctgccctcctcggcctcccaaagtgttgggattataggtgtgagccaccatgcctggctgaaagtgtttttatatagtcatttatgtagacatacagaagagacttttccatattcctttactatgaccagattgaatttttcatgccaaggacagtgcttaatttgaacacacatgtttagccagttctctgtgctctaccttagagttagttcatactgcctttgttatgggaactattctgggaaataggaaggaaagccgagtgaaaaggagtagaaactgcttaagaaggtttgtcaggatgcagattggtaggttgggggtaaggacagaaaagtcttcatacagcttaactttaaaatttaattttattttttgtctggatttctaccaggagctttatttgggttaacaagtatgttctaaagcctaggagtatgaaggggatatcatcccagtatgttactgtgagctactcacttcagcttgctttcctcctcctgtgacatttgcttcattagcacatttaatctcagaaggtgggtaatttttgagcaggatccgtttggagtaggtaaaagctaacatttctgatactgtacactttatgccagtttacaaactgtgtcagttttttttttttttttttttttttttttttgagtaacagatggacagttagaggttccgaggtattaaatacccaacctaaagttcagtagcttgtatgaggtggggcctggaatcaaacccagattttctcgattccaaatcccaaattccatctaattaatcctgaatgggtttttttttttttttctttagacagagccttactctgtcacccaggctggagtgcagtggcatgatctcagctcgctgcaacctccaagcaattctcctgcctcagcctcctgagtagctgggaatacaggtgcatgccactgcacccagctaatttttgcatttttagtagagacagggtctcaccatgttggccaggctgatctcgaactctggcctcaggtgatccactgtcctcagtctcccatggagttgggattacaggtgtgagccaccatgcccagcccagaatggggttctttttttttttttttttttttgagatggagtcttgctctgtcacccaggctggagtgcggtggcacgatctcagctcactgcaatctccgcctcctgggttcaagtgattttcctaccccagcctcccgagtagttgagattacaggtgcccaccaccatgcctggctaatttttgtatttttagtagagacggagtttcaccatattggccaggctggtctcaaactcctgacctcgggtgatccacccgccttggcctcccaaagtgctgggattacaggtgtgagccaccgcacccggccctaaacagggttcttatggcaacataggggataaaaacaatgtgcgcagagggtaatagagaagggtagagggtaatataattgcctctatttattgaatacgtactccattgcagtctctgctggttggttttgtattatctttaatccttacaaactcgccacgacagacagtgctgtcttacatatgaggaaattaggactcataaaagttaagttttgtttagtcatagagttagtaattggcagtcaggacttccttctgactctggcagactccataggctgtgctcttttcatatcatactgttttcacatgaaagaatctagaactcaaaactggttcaggaataccgtggaataaacagaatagactggtattgggcaagcctgggaacctaacaactctttaccattgtttccaggttgtgaatataagaagagatatgtttgtaatttagggacttgcctatatcaccaaaagatggtaactttggcatttgaagtgttcaactacaggttaagtatcctttattcaaaatgcttgggaccagaaatgtttcagatttttttttgaattttggaatgtttgcattatatacttactggttgagcctccctaatctgaaaatctgaaatccagaatagtctaatgagcatttatttttgtgtcatgttgatgctcaagaagttttgggttttggatttccagattagggatactgaacctgtataggaattacaggctagcttttcactgagctccctggatccttttttcttttcctgcatccttgcctgtcttttttctattgttagtctgtgttgcaattgtgctaagaaattttgaagaagcatttgtagagattaacaaaaaatatgtggaaatattctgggtagatgtgatttctatacaaaccaggtttggggaaaaacagtcaaagtgattcaggagatgaggatagactggaatggttagaattcctagaattgcactttgaagtgtgagtaaaacagtgactagcaaagttagagatgtaggttggaaatgtaaatgtatttaacagaaggttagataattttatggaagatcctcagttaattgttaaatcgacccataccatgtcattacatgtttattcatgctgttgtgtcaaggtgatacagggctgggtagagcaggatctgacctagcatatcagttctttttttttcttttctttcctttttttttttcttctttcacaccaagtctgtgaacccagcatatcagttcttatgaaagtccatatcacatatatcagttcttgctaatactctcaaggtgagaatactgcatatttttaggactatataatatttgcaaatttgtattaaaactaatgtcttctcttttttcttttgtggctttaatactaataacagctttatatgtagtacttctgactagtcctggtctgtttagaacctcaattttagcatgcttctgtcttttggagagttttcttagaaaattattgaaataatctcttaggatacttgcaaatttttcttgtgtgcttctgcgttctccagttgattctgatagctcaggaatgctaatagtccttgtggaaaggagatatttaggcaactggggatctgctgtgtgaccatttacagtaaccttatttatattcagtgaaattatgtcctaagaattaagacagttaacagtcaaaaatatgttagccagaaaggaagagtgttcatattgggacaagaggttggatcaaactctaggatattgtgcagatataaatctataaaacccatgaaaatagtgttggcatgaaaagtaaggtaaaggctgggcgtggtggctcacacctgtaatcccagcactttgggaggatgaggcgggcggatcatgaggtcagaagatcgagaccatcctggctaacatggtgaaaccccgtctctactaaaaatacagaaacaaagttagctgggtgtggtggcgggcatctgtagtcccagctacctgggaggctgaggcggctgaatggcgtgaacccggaggcggagcttgcagtgagctgagattgtgccactgaactccagcctggcagcctgggtgacagagcgagactccgtctcaaaaaaaaaaaaaaaaaaaagtaaggtaaaattgatagttaatgctaattttgaagcatttacaaagttttgattgggaggttgtatatttttcctaatatcatcttgtgttgattgtaatatttattgaaattatggtttgattgtagaagaaataatagtcaaaccccagaactacaaactttgtagatcttaatatttactaagacatcatgttagaaaaaagggattttttttaaaaaaaaaaagggcattgttgagaaataagacaataggaaagtagcaattactggattttttttttttttttttttgagatggagtctcgctctgtcacccaggccggagtgcagtggtgtgatctcggctcactgcaagctccgcctcccgggttcacgccatcgattttgtttttaaaggaaatagttgacgtggtcattttaacagtaaatatccatcccttagaatggagacttgagatttgactactgtgtgtcaatccaaataagtacttttaactttggatctactaattttctccatctacaaaataaaactttctcagacatagttggtagtgaacccgtgtttatgaagaaaatctgttaatgagggaccacacccagctaattttttgtaatttttgtagagatgggattttgccgtgttgcccaggtttgtcctgaactcctggactcaagtgatcctcctgccttggcctcccgaagtgttgggattacaggcgtgagccaccatgcccgaccagcaaaaacacatttttgaaaaacttcaatttacctttaattcactcatttcctgaatgctttatcattaatttttattaataatttctacattctttgacaaaattgtatttggtacattttatttttccttctatggaaaggcaagtgtggcactttttcagaacccatgggaaattaatgccctccacttaaacatcagaaatgtatatattatatcatatagaaaaagatgtttcctactacgtcaaatattagcaacttaagagttgtaacaacagatgcttattttattttatttttttgagacagagtttcgttcttgttgcccaggctagagtataatggcacaatctctgctcacctcaacttctgcctcctgggttcaatcaattctcctgcctcggcatcctgagtagctgggattacagggatgcgccaccacgcctggctaattttgtatttttagtagagacagggtttctccatgttggtcaggctggtctcgaactcccaacctcaggtgatccacccatctcggcctcccaaaatgttgggattacaggcgtgagccaccgtgctcggcccagattcttattttaataaggcaatatagagaaaagagtacatgggtgccattttatttttaatttttatgagggttggggtctcctatgttccccagctgtcctcgtaattctggggtcaagcgatcctcccatctcagcctcctgagtagctgggtctacagactttccccccaagcccctcccaccatgctcagctcatgggtgtcattttaaaattgattattactcaaaagtgcgccctcaacatagttaggcaatcccactagataacctcgccagtttgttcttccacttaccacaaactattttaatttttttctccctttttgaaatctgaccctttcctttcttgtcttttggttcatagagaaaatagacttcatcatataagacctataatttcttaccactgcatctccaaacctgctatcctcgctcaccctattctactcctttttataatggaagagagacattcttcctcctagctaaagtcctaactgtgggtcatatcctgtcctgcctttttgtaaaccttatgctcctgataagtttatacctcctctctttactgaatttgtgctttcacaattgaaacatttcagatctctgtcgtacttgaaaactcttttgacttcatatactcatctagtaactgacctatctctcctttatggattaactagttttattacactattgtcagctagctgcagtggctcaagtctgtaatcccagttacttgggaggttgaggtgggaggattgcttgagcccaggagtttgagatcagcttgggtaacaaagcaagaccctgtctcaaaaaaaaaaaaaaaaaaaaaaaaaaattagcttagtctgtagtcccagctacttggcagactgaggtgggaggatcacttgagcccaggagtttgaggctgcagtgagctatggttgcgccactgcactccagcctgggcaacagtgaaaccctgtcttttaaaataaaaacaaaaaaccaagcattttcctccatctcccacttttcattcactctttaacctgttctatttccactgctctctgaatgctaataacctccatgttgcaaaattctttcccattttagttctcatgtgctttttttctctgcatcattttgcatggttggtttttcctactttttttgagaagttaatcctttggcttctctgatagacctttctttcatgcttttcctattactctctggcccattattctctgttactattaagtattaaagtggcttcatttgggctcttttctacacatctcacctcaagctgttttatttattcccatctaaatctctagattagatctttcttctgttgaggtttagattcatatatctaataacctacttgacccctccgcttgtttgaatcacaggtgcctcagacataagatgctagcaactgaactcaacaccttcctctaaacctatcactaccaaccacccactcactgaaaacctgggcatcattcttttcttttctttttttttttttttttgagacggagtctcactctgttgcccaggctggagtgcaatagcgcggtcttggctcactgcaacctctgcctcccaggttcaggcaattctcctgccttagcctcttgagtagttgggactacaggcatgtgccaccacacctggctaatttttgtatttttagtaaggacagggtttcaccgtgttggccaggctggtcttgaactgctgacctcgtgatctgcctgccttggcctcccaaagtgctgggattacaggcgtgagccaccacacctggccgagaacgttttttaggcgggttctatctgttagcatttactgtactaaaactaaaactgagcagtttaaaacattcatttaaagggatatctaatgtgtttattattaacataaataatgttttatgaaaaatgtaaccttagttttccaaaacaaaaatgtttagggcaagagtaacattattttacattattgcatctcagtgaaaaataaatggcaacaaaattcttatatctgcttctgcagttaatctgttcattttgttttggttgaagtatatgaaggaaatctgtcctcacacagttgtgtagtggaaaaagggggactattgtaataggctgtgcacataattgtggatgattttctttgatacaacaacaaaacttggtagatggtagtttcttaaaggttagttacagtgtggactctgaaactatatcaataaatattttatactccattactttaaaatacattgcataggccatttggaaaatatttttcactgagttatgcagaccttctgaatgttgacacatttcattatacaatgtgaaaaaattgcaatcactaatattaacacagatctcactagaagaattttcaagtattgcaaagcttgcaagttcacattgatggattcaagttttccaagatcccagtttttgcttgaaagcttgaattttattattggcaacaaatattaccagttattttccttgaagtattaggcttactttattcatttttaggaaaatgtctgccaaatgctcaagtctaaataatcttagtttacctatcagttgtttttgaagtaataatggtgttccatgaacaattggcttattcagcttgcaaataaactgcacaagtgctttttcctaacaggagccatcatacttagtatgtagcagaagtactgtatgtgtacttccattttgtcgtatacaatattaaaagacattttctcaagggtcaagatttaatagaattaataaattttcctgcttcatcaagaacattttaaagtgaaaccggcttttttaaacctttttctttttttttctgtggatggttggcagtaaagaacacaatgagtactagtatcgtctgtgacattgccttgattacctctaagaggctattgtaattttatttacctttgtttttgtaccttcaattcaaatgtcaactcaggaaagaaagcaaataacattagtagtattataaaaataatttagacctcgtggaccccctgtaaaggtcttaggaatcctcaggggtctgcagaacacactagacaacatttgggatagatgattggttcagtagacttaataccttccttttgtgctaatgggagtctgaattttaaatatcattgtatactactatgtatattgagcatccctgactaatgtagttgccattaaaataaaaaatgtaaagtttcttatggagaaagtcttggccgggcgtggtggctcatgcctgtaatcccagcactttgggaggccaaggtgagtgggtcacctgaggtcaggagttcgagaccagcctggccaacatggtgaaatcccgtctctactaaaaatacaaaaattagctgggcgtggtggcacatgcctgtaatcccagctacttgggagactgaggcaggagaatcactggaacctgggaggcagaggttgcagtgagctgagatggtaccattgcactccagcctgggtgatagagcgagactctgtctcaaaaaaaaaaaaaaaaaaaaagcctcttcttatattgcatactgtgctaattattttggttcttaatatttgggtcttactgctctgtacaattcacctttcactagtactgattttgaaactgatttgctgctaaaagtttcataaatctgttatcttcaaatttcataccaaaaatttagtaatttgttgatatgaatttatttgattcataggcggttttaaaattaaatgatttttaggaagtagtgagaaataatatttttaattttaaaatgatataacaatcattcatttctaatttgagtatgttccaaattagatgtgaagaaatctcttgttattatccatggcatgtatcactttggtactaatatatttacatcttcttcttcttcttcttcttttttttttttttttttttttgagacagggtctcgctctgttgcccaggttctggagtgcagtggcacgattactgttcactacagccttgaaatcctgggctcaggtcatcctcccacctcagcctcccaaatagctggaattacaggtgtgccaccgtgcccagctaattttttgggtattttttatagagacagggttttggcatgtggtccagtctggtcttgaactcctgagctcaagcaatcctcctgactcggcctcccaacgtagcaatcctcctgactcggcctcccaacatgtgagcctcccaggtgtgagccaccaggtctggcccaacatcttaaaaaataagaataacccaactgaagtgggagaaaaggacaaaaaacagagggtacactttttgttttagttgtttctctggcattttcccccttttattatatacattttatgttttccatgaaaaaaggctttgcatttatcttttcctctgttaaataatatctcttttaaaaggtttgagaagcctattttttttcagttccatcttcccttaaaattaataataatcaaattttgcttgttttttttaaagacagggtctctctctgttgctcaggctgtagtacagtggtgcgatctcagctcactgcagcctcaacctcctgggctcaagcaatcctcccacctcacctcccaagtagctgggactacaggtgtgcaccatcacgcttggctaatttttgttatttttttgttaaggacagggtttcaccatgttttccaggctggtcttgaactcctggggtcaggggatctgcctaccttgacctcccaaagagttaagattaccggcgtgagccaccatgcctggtcctcagagtttgctttgaatagtgggaagacaaactggtgataactcttattcttttagaataatcagataataccataaagatcccaaagaaaactggcaaaattgtataggctcccaagttggaaccacaggagttccaaaaggaatgcacagtaaaatgaaatatatttataattatatgtattgtgcttcttagtatgacagagtatattagtttgtcacatactcagttattctgcgactttttacacgtattatgtgtcagactgttttgtcaatcagatacagtttctaccctcaagtgattttatagttggcctcctccattaatcaaataactcaaactataataaattacatctagggaaggtacatgtgacatgaaagtatacatcaggtgctgccacctagcttggtgtgtcatagaagtaatgttggagttgagatctgaagggtgaatatatgttaaccgagaacatttgggggaagggaaaacagtgtctctgtggaggggagagcagcatgtgtacaggctcaaaggtaagagtgaaggcagagtgattttgaacaagttacacacttgtgtacttcagagtaaacagagtcatctgtgaagaggtaggtaggtaccagataaggattttgatctttttttttgtctgaggctgatgagaaggcattgaaagttttaagcaaggctgggcgcagtggctcctgcctgtaatcccagcactttgggaggccaaggtgggcccatcgcttgaggtcaggaatttgagaccagtctggccaacatggtgaaaccccgtctctactaaaaatacaaacattagccagacatggtggtgcttgcctgtagtcccagccactcaggaggctgaggcaggagaatcacttgaacctgggaggcggaggttgcagcgagctgagagcacgccactgcactccagcctgggcaacagagtgagactctgcctcaagaaaaaaaaaaaaaaagaaaagagaaagaaagttttcagcaatgggatgatataatttttactttttatgaaggttactcttgtttagagtggagaacagattggaaggaggattgactacagattggaaggagttcagaacagattggagggtggctagtctagaggtgatggtagcaattggtgatggtttttctaaaatcttttttttttttttgagacggagtctcactctgtcgcccaaactggagtgcagtggtgtgatctcagctcactgcaacctctacctcccaggttcaagcaagtctctctgcctcagcctcagtagctgggattacaggtacccaccaccgtgcctggctactttttgtatttttttgtagagacggggtttcaccatgttggccaggctggtattgaactcctgacctcaggtgctctgcctgcctcggcctcccaaagtgctgggattacaggcatgagccactgtgcttgtccattttttctaaaatcttcagtgcctgaactcatcatggtagactgtgactattatttttcttttctaaaaagaggagtatttgaggctattgggatttgttgaactgaaatagagaaagattcattcaacaaatagttaattgcctactctatggaagactgtctgttaggtattatgatgtggtggtatgatgtctatattattattattatttttgagacagagtttcgctcttgttgtccaggatggagtgcaatggcacgatcttggttcactgcaacctccacctcccgggttcaagtgattttcctgtctcagcctcccaagtagctgggattacaggcacatgccaccatacccagctagtatttgtagctttagtagagatggggtttcatcatattggtcaggctggtctcgaactcctgacctcaggtgatccgcccgcctcagcctcccaaagtgctgcgattataggtgtgagccatcatgccctgctttgtgtctatattatttataagctatgtagaaatcactgaaaagccttaaatctaagaaaaagaaaattggtctatagtatgtatagttaaatgaggaaatgttctgtatggaagaaaaataattgttatttttgaaagggttttgattttagtttgggcagtcagaagtttgcttatggaaagagaatatgtcaagcagctttttttttttttaaagcatttaggtaatatgttcctataaaagggtcaatacagttgtattaaaagtcaaacctaaaatgtctcttcttcttctccccatactgctattatcctctcccctcaaactgtatgcttgttttctgcctttccagtttttgtacaaaggatgtgctttgggaagattcatcttacattggtacgggatggattggagaagggagagactggatggacagtgaccagttagaggactgtcacatttgtctcactgtaaagagtatttcatgaattgagatagctgtagtaagattgaaaaggaagataagaatcagcaagccttggtgaaggagatatgggtggctgcgggaaaaggagaacccaaagaaggcttatttaaccggtatctattttcccctagcataaagctaatgcgcctacagaaggtaatttgcagtcacagaagtgaatctatagaccccctctttttcagctgttagtacacagttggtttctgacactttccagcttttactcctccacaattgaattgattggcagagcagtgggttggagaataggaataaagcttgactgctagctggctgcgtgggcagaacagggaagggaagagggaagaggagaggaaagggattccagtttctctggctatatactgttgtggcatgaggtgcatgtcttttgatgttaattttgatgttctatcataaccttctgcattacagattgttggtatttttatatgtgtagtctttataaatttcaaatacatatgacgtgggttgaaaatgatctctttttgaaaggaacttttagagagaattctaaggaacagtagtgtttgggggttctcaggcaaagtttctcctaaagaatgagtttagccgagtcattaatttaaagagttgaggggaagggggattgggaggcaagggatatatataggtagtaggaacagaaagatagcaaggcatgtttgggagagctgtgagtagtgtcaagtgccagggaaggtggaggagatgaagtcttagtcaaaaacatacttgaactgctgtcactaaactgtagaagatcggatcagtgtttcccagatttgaaaatagaaaccgtgttttaaatttaacactggtaagatgaaattgtgcttttgctatgtcctgacatattctgttcatttgtctagacacgtttggcataatcaacagaaaccactggatgagtggttaaatataagataaatgagttataggtctgaatcaatcacttttgtatgagctaattgtcataacttggggactgcttgtatgagtggctttattgttagtgtttattaatgtcttgtggtatatagagctattttttttttcaactcaattgggtatttcttccacccatcctacctctcctaccttgccccactaccacaaagaagaagaagaaaggcagcatggtactatctctatgaaaatcctgccactctcatttttgctttttgggtgaggaggtacggtgctgcaaggtgggaagaatgtgtgatatattaatatttacatcactgaggagaattgcaatacattccttttatagtcacatggaagttttaggaaaagctttgcttccccatatatatatatatnnnnnnnnnnnnnnnnnnnnttgcttctacatatatatatatatatattttttttttttttttttttttgagacggagtcttgctatgtcataaaggctggagtgtggtggcatgatctcagctcactacaacctccgcctccaaggttcaagcgattctcctgcctcagcctcccaagtatctggggactacaggtgcatgccaccacaccccggctaattttgtattttttagtggagacagggtttcactgtgttggccaggctggtcttgaactcctgacctcaggtgatctgcccacctcatccttccagagtgctgggattacaggtgtaagccaccatgctggaccccaccaagatattttgacctatggatactataaatcatataatcttttttcctttatctttgtggattcatgcaaaagccagagccaaacttgtggctctaatttattatttatttatttactttttaagatggagtcttgctctgtcgcccaggctggagtgcagtggctagatcttggttcactgcagcctcctcctcccgggttcaagcagttctcctgcctcagcttcccgagtagctgggactataggtgcacaccaccatgcccggctaatttttatatttttagtagaggtgaggtttcaccatgttggccaggatggtttgatctcctgaccttgtgatccaccctcctcggcctcctaaagtgctgggattacaggcgtgagccactgcgcctagcctcttgtggctctaatttattatgtagtactctgtggtctgtatattaatgtcttgcctttatcttttatattatatggtaaaaccctgatttttgtattttgaattttcttgtttaattgtacacatttttgtactggtatatcaatagctaatggcctctccccagaccaatgaaattggcatctttttagggggagagggttagattgggtctcaggctctggaattttttaaaaagctcaccagatagtgctggtgtccagctagaattttctttttggattccacactaaaagcttaggccataaaagcaaaaataaataaatggaatgacgtcaaactgaaaagcttcttcaaaacaaaggaaacaatcaacaaaatgtaacaacctatggtctgggaaaacatatttgcaaaccatttatctgataagggattaatatctaaaattcatgaagaactcatataattcaataatagaaaaataatctgattagaaaatgggcaaaagacttgaacagatgttttttcaaagaagacataaggatggctgacaggtatatgaaaaggtactcaacagcattagccatgcagaaatgcagatcaaaaccactgtgggcgtcacctcacaccccttagggtggctgtcataaaaaagtgaagtgataacaaatgttggcgagggtgtggagaaaatggaccccttgtacactgttggtgggagtgtggattggtacagccatgatggaaaatagtatggaggttgctaaagaaatgaaaaatagaagtactatatgacccagcaattccttatcgggcatatacctaaaggaagtgagatcaccttataaagatatctgcactcccatgttcattgcagtgttatttacattagccaagctgtggaaacaacctgaatgtccactgatagatgaatggataaagaacatgtgatatgcatatataatggaatattattcagccttaaaatgcagatactgccatttgccacaacatggatgacctggaggcagtatgctgagtgaaataagccagacacaggaagaaaaatattgcatgatctcatatgtggaatcttaaaaaaaataaaaaaaaagagtcaaatatacagagtgaataaaagagtgggttaccaggagcaagtgggtggggaatgggaaatgtaggtgaggggtaagaaaatagcaagtatgtaggatgaaagagcctagagatctaatgtgtaacatgtagctaataagaggactgtagctaataaaattgtactatatttggaattcctgctaaatgaatagatttttagctgtccttgccacaaaaacaaaccaaaaaaaaaaaaaaaaaggtaactatgtgggttgatatatatgttaatttgcttcactgcagtaaccattttgctttctatatgaatcccataacatcatgttgtatgctttaaatatatacaataaaatttatttaaaaaatgaaataaaatatatggttgatataaaaagaataaaagctcaccaggtagtgctgatgtccacctagagttgagaatcacttttctagagcaagagtgggcaggtgtttcctgtaaagggccagatagtaaatattttaggctttgcatgccatatggtctgacacaattactcaactctgctattgtagtaagaaaaccatagatgatatgtaaggaatggatgtggctatgttttagtaaaatgttatttgcaaaaatggggagaagtatttggcctgagcagggacatagtttcttgatctttgttatacagcctgaattttaattactatgctagaatctaatggtagtggttgatgatggaccaaaactgtattggtgtggcccatatactgaggtgaatgcctttttaaaaatgcttttgtatcctgttaattggtgtttagatttctaagtgattaaattacctatttgcctgggatctgatgtgataatttattaataaattattattttttgtctcttgtttctgtgtgaacagaatatccctttgttcacatctcagattttttggaatagcagtagcatagaaaattcaattgattacagtagagattaattgatacttacagttttgtaagttttatactcttccagaatagattaagaaattaggatacacgtaatttgtcaggtagtgtcatactggtcctgatttttgatttggaaaatgtgattaatgaatcactaggctggagatagctaagactattctgtgaaactgtgttgtaagctggtttaagtgagtgtcttagtctgtttgtgttgctacaaaggaatacttcaggctgggtaatttatttgacttgtggttctgcagaccgtataagaagcatggtgccaacatctgcttctgatgagtgcttcaagttgcttctacttgtagctgaagggaagggagctgacatttgcagagatcacttggcaagaagcaaggtggggaggtgctagacccttttaaacaaccagccctttggaagtagtagagcaagaatttacctgaggaccccaagccattcatgagggatcctcccccataacccagacacctcccattaggatccacctccagcattggggatcatatttcaacatgaggtttgaggggacaaacatctaaactacagcagtgaggaaatacaatcgatggaaggacaaggtacttttgctagtattcatagaatcttgaatttgttttttttgtttttgtttttgttttttttgatacaggatctctctatgtcaccccggctggagtgcagtcgtgtgatcatagctcactgtggtcccaaagtcctgggttccagcagttcccttgccttagccttccaagttgttgggactacaggcacgtgctaccatttttgccatctttaccatctttaaagtgcaaactttaaagatttatttatttttattttttctgtagagacatggttttgctgtgttgctgtgtctgctctcaaactcctggcctcaggtaatcctcctaccttgacctcccaacgcattgggattacaggtgtgagccaccaagcctggcatgtttttttttttttttaaacagaagtacttctttttctcaagtcagttaagggtggtgctgattgtgacagtgttaactaccaccctacctagtagtttgttaaaagatgcattatactgcttaagtaatttcctagtaaagttacctttttttccccttatttttgtttttgagacagggtcctgctctgtcgcccaggctggagtgcagtggcatgatctcggctcactgcagcctcaacctcctgggctcaagcagtcctcccacctcagcctccccagtagctaggactataggctcatgccaccatgcctggctaatttttatatttttgtagagatgaggttttgccatgttctccaggctagtctcgaactccttagctcaagcaatccactttcctcagcttcccaaagtgctgggattacaggtgtcagccaccatacctggctagttaaatttatttgggcatgaattaaagatgtggttttgtcacttcagtgaaggataacctagaaacgtgttaaatgtttaatttttgtttcttccatttatagaaccctatgtgtagaacatcaattgtttcatagatcaaaaacatgctcagttatcctgagaacatttactttctcagtctccgctctttaccctcccagtgaattaaaattcatgcggtatgcagagtagttaatgatgacttggagtggttcatcatagaggccacattagaattatactttgttcatttttagaattataaatggaggcagtgtggcatagtggcagaccgtggtctttgggagacgtagcggttctattcttcctagcagtgttatcttgggcaagttatttaaccactacaaatttctttttcctcattgtttgctaggctaagtgggatatttcacttaaagatgtctttcttgtttatgtgtcacagaatacatattgcaacagaatccttgtctccttttttgtggcctctgatttccacaatctagtttataaaactgcagctgaagtgatgtttctaaagcctgaaactagtcatattttttcttcctaaaaattctttagtgtttccccactagacttacaatgaaatccacattccctaaaatgctctcaagggcctatagtatttctggagccttgtggtatattcccccattgggtctactgtcgtaggcttactcacctttaaacagatactgttcatttcattctgcttggaaccctgtcctctgctccttcctcttccctttccctaaactgattctgatgtttagaacattaggtaaaatgaagttcccatacctcaggtgcatgtgaaagattaagagttggccgggtgcggtggctcatgcctgtaatcccagcacttcgggaggctgaggtgggtggatcacgaggtcaggagttccagaccagcttggccaagatggtgaaaccctgtctctactaaaaatacaaaaattagctgggtgtggtggcggtcacctgtaatcctagctactcaggaggctgaggcattagaatcgcttgaacgcaggagatggaggttgcagtgagctgagattgtgctactgtactctagcctgggtgacagagcaagactctctctcaaaaaaaaaaaaagtaataagattaagagttgtgtaaagatcagtatcagtgagctttcattagtgccttcatctgtgaaaccaagatacctgcttaggttactatgtgaaaatgctttgaaaactaagctgggtgtggtggctcatgcctctaatctcagcactttgggaggccaaggcaggtggatcacttgaggcctggaatttgagaccagcctgggcaacatgaggaaaccctgtctctactaaagatacaaaaattagctgggtgtggtggcacacacctgtaatcccagctactgaagaggccgaggcatgtgaattgcttgaaactgggaggcagaattgcagtaagctgagatggattgcaccactgcactctagcctgggcagcagagtgagactctgtttcaaaaacaaaaacaccagaaaaagaaaattaaatactaattatatgtaactgttaacagtattgccgtcaagtatttgtaagaagacatcatttcctaatgtttgaagttaaagattattctaattgtgaatagaattgtgtccccctgccatccttatgttgaagcctcaaacccgtctcccccaccatgtgactgtgttggagctagggcctttaaggaggtgaatatggttaaatgaggtcataaggctggagccctgatcccatagagctagggtacttataaaagaggaaatgacaacagagattggtctctctctgccatgtgaggacacagcgagaaggtggctgtctgcaagccaagaagaaatcccttgctagaaccagaacctactggaaccttgattgtggacttcctggccttcagaactgtgagaaaatacatttctcttgttgaagccatgcagtctgtggtattttgttaatggcagcccaagccgactgtatatttaatacagtttaaaatataattgccttgtgggaaaggcaaactagagtgatttctcaggtaacattttaatgagtaacataaccagctataaattactggactagtttagaaaacagcctcagtaatttgagaattactttagtagatcttttgtctgtgtaactagggggtattattataaattgttactttctggttcagccaagaccctttttatgaaagtactttctcctcccatataaaagttaaatcatttagggtgtatttggctataagtaatacaactcagttaacttaaacagtaaggagcatttattatttcatgtaacaaattccaaggtaggaatttagggttagagttagggttaattcttcagctcagtatcatcaaggattcacattctttacattttcaccctcagttttggtggggtggtagggaggtactattagccttattcttagtttcctggtatctgcaagatggttgcaacagaaatgttacgcggctattgtggatcatttggaaaatgtcacaagagggaaaggatgaaaacataaatcactcataatccaactatttacatgcctatcttctcattgtctggcatattagtttgtacaggtactaattatatcagacaaaattaggtcacactgtttacacaaatacatgttgtcggtttccactaagatactatcaagaggtcaggcgtagtggctcacgtctgtaatcccagcactttgggaggctgaggcaggtggattgcctgaggtcaggagttcgagaccaggctggctaacatggtgaaaccctgtctctactaaaaatacaaaaaatagccaggtgtggtggcgcacgcctgtagtcccagctactcgggaggctgaggcaggagaatcgcttgaacctgggaggtggaggttgcattgagctgagattgcgccactacactgcagcctgggtgacagagcaagactgtgtctcaaaaaaacaaaaaacaaacaacaaaaaaagatactatcaagagaattatccatgtcattaaaattctcagtaaaaataggctgggcacagtggctcatgcttgtaatcctagcagtttaggaggctgaggcaggaggattctttgagttcaggagttcgagaccagcctgggcaacatggtgagaccccaactttacaaaaaatgcaaaaaaagttagccagacatggtggcatgcgcctgtagtgccagctacttgggaggatcccttgagcccaggatttcaaggctgcagtgagccataattgagccactgcactctagcctggacccagtctcaaaaaaaaaaaaaaaatattagtaaaaatatttttttcccttcaagtaatggttgttgaaaaagttggatacagaaaaatagaatattaaaaattacccatatctcacaactcagaaataaccactcatgtatcaatatatttccttttagaacatttgtgtgtgtgtgtgtgtgtgtatttaaaattaggtatagaataattttttttttttcctttggagacagggtctaactctttcaccgaggctgaaatgcagtggtgtgatcatggcttactgcagcctcaaccttctgggcttaagtgatccttccatcttagcctcccaagtagctgggaccacaggtgtgcaccaccacaccctgctaatttttaaattttttgtagagacgaggtcttgctgtgctgctcaggctggtcttgaactcctgaactcaagtgatcctcccacttgggcctcacaaattgctggaattacaggtgtgtgccattgtgcctgactaattttagttttttgaggaatcttcatattgttcttcataatgactgtactaatttacatttcaaccaacagggtatgggtattcccctttctccatgtcctctctagcatcttttattgcctgtctttttgatataagccattttaactgggggtgagatgatattgcattgtgggtttttttttttttttttttttttttttgaggtagaatcttgctcagttgcccacattggagtgcagtggcactgcagcctctgcctctcggttcaggtgattgtcatgcctcagcctcttgagtagctgggattacaggtgagtgccaccacacctgactaatttttgtatttttagtagagatgggatttcaccatgttggccaggctgttctcaaagtcctgacctcaagtgatttgcccgcctcggcctcccaaagtgctgggattacaggcatgagctactgtgcccggcttaatttttgtatttttagtagagacagggtttcactatgttacctaggctggtctcgaactcctgacctcaggtgatccgcctgccttggcctcccaaagtgctgggattacaggcgtgagccaccgtgcctggtctgttgcattgtggttttgatttgtgtttctctgattaatgatgttgaatattttttcacatacctgtttgccattcgtatgtcttcttttgtgtgtgtgtgtgtgtgtgtgtgtgtgtgtgtgtgtgtttgtgttttgtatgtcttgagaagtatctgtccagatcttttgccattttccttttggattatttgtttttttgccattgcattgtatgagctccttatatattctggttgttggtcctgtgtcagatggatagtttgcaaatattttcttccatctatgggttgtcgttttactttgttgattgtttcctttcttgtgcaggagctttttagctttatgtaattccatttgactttgctttgttgcctgtgctttttgaggttgtcatttttattgactagatgatattccagtatattaattttttttcttttttgtatttttgagatggaatctcgctctgtcgcccaggctggagtgcagtggcgtggtctcagctcactgcaacctccaccttccgggttcaagcgattctcctgcctcaccctcctgagtagctgggattacaggcgtgtaccaccacgcccggctaatttttgtttttttagcagagctggggtttcaccatgttggccaggctggtctcaaaactcctgacctcaggtgatccacccactttggccttccaaagtgctggattacaggcatgagccactgtgcccggccccagtatattaattttttaataatttgtcattggctatttagatctcttctagtttttttggtgttgtaaataaaggtggcatgaatatccttgaacatacagattttttgcatttggccatttatgtcttttgggtgaatttcttgtaatgaagtgtgtgtgtgtgtgtgtgtataaatattgtgatatacattatctgattgtattttttttagtagtacgtgagagtatttgcccaagctatattcttgatcatcatggctcttgctatataattccttttaagaagaattaaaattatatgagaagataacttgttaacatggaaggagttaatggaaggaagcaaatgttttggactaatagagctattttctattagtaatacttaagtatataacagattatgtgttgaaatgtagttctttctagagctggggtttttcaggttttgcattaagactgtttttgaaatgtaagccttgtagtatggtgtaggatggtaaaagagtttggggaaagcgtcattgtcttaggctatagctgtggtaaaacttaaaatttcagaggctaattatctagttattgggaataccctggggatacagattgaatcgaaaaggcttaaaaatattctacattatagttaaacttggaattctgtatactgagtaagtatgctagcagttgattgttctgtgtagctctcccgttaaagaagagagtatgccccaactggcattcctgtcagtcacaactgtgtgacaccacaggcagcagaggcttccctagatgttgctgggaatgaatgggcttccagacctcttagtagttgcttaagtgggaggtggtagggaggggctgtgttaaagcttataatgaaaggtctcaacctgaattgtcatgcaaaaaatttattttttttgctggatacttgccataacctggtaggatttctttttagttttcacttttattggaataggcgttctgctggagaaaattagatccttttagtggtagctaggcattgcatatatgtatgccctagtccccatgactctgtacttaatagattatttgtcagtaatgaaccagcatttggcccatgtgctcttttttcccatgatcctctcatctctccccacagagtgatatggatttcttcctggaaggtttctcaggtctcaaaccaaccagcccgtttgttggccttcagcaaagtagatgttagtttttgtgtacttcatagtgtataaaattattcctgcaacaggtattaaaacctgagatttaaaatcctttccattggtgttaacatacattatttatttatttattttattttattttattttttgagatggagtctcactttgtcacccaggctggagtgcagtgacgtgatctcggttcactgcaagctccgcctcctgggttcacgccattcttctgcctcagcctcccaggtagttgggactacaggcgcccgccaccattcccagctaatttttttgtattttttaatagagatagggtttcattgtgttagccaggatggtcttgatctcctgacctcgtgatccgcccgccttggcctcccaaagtgctgggattacaggagtgagccactgcgcccggccaacatactttattttttaaaaggccgttaaattgagaagtgtttcttatatactgtatttcatgaattctagtaactgcccctcccctacttagtatctctgaaattgggaaacactttacaagtaatcatgtccttaaaaagtcatcagccagtcagcggtcatggcatatttgtcattgtttgtgcttatgtgaatttggttgtttttccttgtggcttaactggattattgcacccgtaaccttttgaacaacaaaccatttaaggaccatttgaggataggatagaagccaagtttttgttgtaaaacatttttttgacatcttctggtaaaatcaataaattagcttcatcagcgtttgcagaattggtgttggcagcttggaagaaaatgatgggaagaaaactctggaaatagctgtgcaacgttattttagatgttccattatttgtaaggggaagttcacagcatcagctattaatatatagtattcttgacacaatgttcaatctgaatctaatcatgaggaaacaatcagatgaatccaggttgtaggatttttttacaagatacctggatttaaaaaataatttctatgttttgaaaggagaaaagggtcaggattgggagtgtgttctgtatttaaggatatgaaatagaaatatgactgttaacagctatgaacaatctttgattagatcttagatcatatggaataaaataaaacatacgtaaagaggtttttttttcctttgagacagagtctcgctttgtcgcccaggctggagtgcagtggcactatctcggctcactgcaagctccgcctcctgggtccaagtgattcttacgcctcagcctcccgagtagctgggattacaggtgcctgcgaccactcctggctaatttttgtatttttagtagagatggggtttcaccatgctggccagtctggtcttgaactcctgaccttaagccatccacctgcctgggcctcccaaactgctgggattacagatgtgaaccaccatgcccagccacatgttttgtattttttttttttggaagttggagaaatttgggtataggtttggattagagataagttaaaagctataaaagacaaatatgttgtgacagatgtgacatttctagaaggaatgggaggagagttaaagacatggaaacaaaatggtagaaaacttaaaaaaatgcacatgggacccttgttttgttatctaagtggggttattagactgttatcagtcccagcaactcaggaggctgaggtgggaggatcagttgaacccaggagatcaaggctgcagtgaactatgatcgtgccactgcattccagccttgggtacagagaaagacactgtctttaaaattaaaaaaatgggcaaaatatttgaacattttatcaatgaagaaatggatgctgcacaagcacttgaaaacattatgatttgatagcaaaatggaaattaaaaccataatgagataccactatatacctactagaatatttaaaattaaaaagactgaccataccaagtgttggcaaggatgtggagcactagaattttcataagtttctagtgagaatgccaaataatgttgtttctgtttctttgtaaaatagtttggtagttttgtttttttttttttttttaaaggagacagggtcttgttctgttgctcaggcttggagtgtagtggtgcaatcacagctcattgcagcctcaacctccctggcccaactgatcctcccacctcaagctcccaagtagctgggaccacaggcataagccaccaggcctatctgattttttatttttgtagagacagggtgtcactatgttgctcaggctggtctcgaactcctgagcttaagcagtcctctcgccatgacctcccaaaatgctgagattacagtcatgagcccccatgcccaactggtagtttcttacaatgttaaatatacacttaacttaccatgtgactcagcagttgtatctttaggtattacccaaaagaaatgaaaacatacctccacacaagaccttctactcaaatattcatagtagcccagaactggaaacaacccaaatgtccatcagctgataaatggagaaacaaattatgatacatccataaaatagaacactacttagcggtaacaaggatgaatcttaagggcattctgctaagtggaagaagccagatacagaagactgtagctttcaattctatttatatgaaactctagaaaaggcaaaactgttgtgacagaaaggaagtcagtggtttccagggtccggaggatggggagggagttatgagggaaatgttctttatcatggtggttatactactgtacccatttatcaaagcacattgaattgtacactgaaaatttttaaattttaatgtatgcatttcgtacttaatattaatgctgacctcccttcctcatccaagaaaaaaatgaggtgatccatagcatcctacaaaagtcgctagtgactttttggtttgtttttatctttttaatattgttatgaagtcttaaatgtaaacattttgtgtgtttcattccattgaagttatgatcctcattgatccttacattgagtccttttgacatgaccctagaaaattcctccgtggcttttttgttttgttgtttatttattaaaattgacatataaaaattgtgtatatttatgatgtacaatattttttgaaatgtgcatacattgtggaatgtctaagttaagctaattaacatacattgcctcacaaagtttctttttgtggtgagaaccttaaaatttactctcagcaattttcaagtatacaataagttattattaactatagtcaccaaattgtaaccaggtaccttttgatacacagcctgttttaggtgcatcactatacggattataggtggtgctccatggctgctagacagtctttattcttagatcttttcattggacagagctgggatattatgatgtgataaatacattttaggtttaaactggtgctttttttttttttttgagacagaatctcgctctgtcacctaggttggagtgcagtggcgcgatctgggctcactgcaagctccgtctcccaggttcacgccattctcctgcctcagcctcccgagtagctgggactacaggcgcctgccactgcgcccggctaattttttgtatttttagtagagatggggtttcaccgtgttagccaggatggtctcgatctcctgagctcgtgatccgcccgccttggcctcccaaagtgctgggattacaggcgtgagccaccgcgcccggctaaactggtgcttttagtttaaatctagaactaaaggattctttcttaacctggattttcttatgtcaaaatctattttgaaccatgccccaaatttcagttctcagtgacataattaatgatttgctatatcccaccctatgcaaataacagtatcggtaataatttcagtattaacaccagcaataaagagactaaaaacaatttcagtttttccttcccctctttcaattacttttattctaatggtaaatcctattaagaatgtacaatcgaattactgtgctttgaagccacttgtagagtggtttctctctggtttaggccactaattggatgcacagttaggctcatttgattaatttacctttactttggggtaattcctttttaaatttaaattttattttataattgtgtgaattatttacaggcatgcttctctttattgtgctttgctttactgcgctttgcagactgcgtgttttacaaattgaaggtttctggcaaccttgcatcgagcaagtgttggtgccgtttttctaagggcatgtgcttactttgcatgtctctgtcatattttggtaattcttaaaatatttcaaacctttttattattactgtatctgttatggtgatattcgatgttattactgtaatcgttttggggcaccacaaactgcactcatgtgagatggtgaacttagtaattgttgtatgttctgactgtaccaccaactgaccattccttctgtctctccctctctttgggcctccctattgcctgagatgcaacaatattgaaattgggccaattcataaccctatgttggcctctaagtgttcaagtgaaagaattgcgtgtttctcatttaaaataaaaaactactaatgggagcttagcgaggaaggcaagtcaaaagctgagataggccaaacgttaagcctcttgctgcaaactttagctaagttgtgaatgcaaaggaaaagttcttgaaggacattaaaagggctagtccactgaacacatgaatcataagaaagagaaaagctggccgggtgcggtggctcacgcctgtaatcccagcactttgggaggctgaggtgggtggaatcacaagggacaggagttcaagaccagcctggccagcatggcaaaaccctgtctctactaaaaatacaaaaaatacctgggcatggtggcttatgcctgtagtcccagctacttgggaagctgaggcaggagaattgcttgaacccagcaggcagagtttgcagtgagccgagatcactccattgcactccagcctgagtgacagagcaagactccatctcaaaaaaaaaaaaaaacaaaaaacagaaagtgaaaagccttattgctgatagggagaaagttttagtggtctggatagaaggtcaaaccaggctgggcgtggtggctcacacctgtaattcccctgcattttgggaggcggaggtggatggatcacaaggtcaggagatcgagaccatcctggctaacatggtgaaaccctatctctactaaaaatacaaataattatccaggtgtggtggcaggcacctatagtgccagctgcttgggaggctgaggcaggagaatggcatgaacctgggagaaggagcttgcggtgagccgagatcacgccactgcactccagcctgggcgacagagtgagactctgtctcgagataaaaaaaaagaaggtcaaaccaggccgggcacggtggctcacgcctgtaatccttgcactttgggaggccgaggctggtggatcatgaggtcaggagatcaagaccagcctggacaacatgatgaaatcctgtctctactaaaaatacaaaaaattaggcaggcatggtggctcgtgcctgtagtcccagctacttgggaggctgaggcaggagaatctcttgaacctgggaggtggaagttgcagtaagccaagattgtgccactgcactccagcctgagcaacagagcgagactccgtctcaaaaaagaaaaaaaaaaaaaatcaaactagccacaatattcccttaagccaaagcctaattcagaacaaggccctaactgttcagttctgtgaaggctgagagaggtgaggtgagaaagctatagaagaaaagttggaagccagcgggttcatgaggtttaaggaaagcagccatctctataacgtgaaagtgcaaggtaaagcagcaagtgctgatgtagaagctgcagcaagttacccagaagatctagctaagattatcgaaggttgctacacttaatatcagattttccatgtagacgaaacagtcttctattgggagaagatgccgtctagggcttttacagggagagaggagaagcccatgcctggccttcaaaggctaggctgactctcttgttaggggctaatgcagctggtgactttaagttgaatccagtgctcatttgccatgctgaaaatcctaaggccctttagaattatgctgaatctgctctgcttgtgctctttaaccagaacaaccaagcctggatgacagcatatctgtttacagcatggtttatggaatcttttaagccaactgttgagacctgctcggataaaaagattccattcaaaatattactgctcattgacagtgcacctagtcatctaagatggtgatgtataaggagattaatgttgttttcatgcctgctaacacatacttattttgcagccccatagagtaattttgactttccaatcttactatttaagaaatacattttgtaaggctatagctgccttagatagtgattcctctgatgaacttgggaaaagtaaattgaaaactttctggaaaggattcaccattctggatgccattaggaacattagtaattcatgggaggaggtcagaatatcaacattaacaggattttggaagaagttgattccagccctcatggatgatgctgaggggttcaagacttcagtggaggaagtaactgcagatatggtgggaacagcaagagaactaatgagaattagaattggagcccgaagaagtggctgcaatctcacaagaaaacttgaatggatgagttgttccttataggtgaacaaaggaaatagtttcttgagatagaatctactcctgctgaagacgctgtgaaccttgttgaaatgacaacaaaggatttggaatattacataaatttagttgataaagcatcggtagtgcttgaaaggattgactcattaaaattttatttacttatttatttttgagacagagttttgctcttgttgcccaggttggagtacggtggcacggtctcagctcactgccacctctggctcctgggctcaagcgattctcctgcctcagcctcccaagtagctgggattacaggcacataccaccatgccaagctattttttgtatttttagtagagacagggtttcaccatgttgaccaggctgatctcgaactcctgacctcaggtaatcctcccgcctcagcctcccaaagtgctgggattacaggcgtgagccatggcacccggccaaaaaaaatttttttttcagagacagggtctcactgtgttgcccaggctgtcctcaaactcttgggcttaagcaattctcctgcctcagtctcccaactggccaggattgcaggtacaagccgccaccacacccaggcttgatttcagttttgaaagaagttctactgagggtaaaatgctatcaaatatcgcatgccatagagaaatcttgttaaaacaaaagtcaatagatgcagcaaatttcattgttgtcttattttaagaaattgccccagctaccccaaccttcaaaaatcccaccctgatcagtcagcagccatcaatatggaggcaaagccctccaccagcacacaaatattaggactctctgaaggctctgaagatggttagcattctgttttaagcaataaagtatttttaattaaggcatgtacctagtttttttagacatagtactatcgcacatttaatagactacagcataatataaacataacttttatatatacactgtctctagccaaaaccgcagtatctttgcagtgtgcctgtatgtagttccaaagagaaatctgtgaaacaagatatgcttaagggattctatctactgtccatgttttctctatcctatttattacctctcctcctgtatgtgattttttttttaatgccaaggtttgtttttcctttaaaaaaacatgcattttcatatttccctctgttaagaagtagcatattatacacattttttcccacattttttttttcaccttagcaatattctggagatcatggagtcatggtaacagagaaattccttgaattccttgtccttattatggcagtataatactctattgtgtggagatattatagcttattcaaacagtctcctattgatagttatatgggttgtttccagtcttctgctattatagatagtgctgcagtgaataactgtgtacatatggttttgtatttttgccagtgattttttgagatacattcctaaaagtgagcttactgggtcagaaagtaaatctgtgtgtaatattgctggatatcacttaccagtgcatcagagttttttctcacagctttgctgagtgtcttgtcagacttttgtatatttgtcatttgggtgaatgagaaatagtatctcatattggtttgcacttgcatttctttcctataatgagtgaggttgaacatcttttcagtggttaagagtggttccattgcttttttggtgagctttctgttagatctctgttccattttttttttctgtgtagaactggaagggacgtgagaccattttgtttagtctctgagttcatgacactgatacctggagaaataaatgattttcctgaagttgtaggtagctaggatagcctttttttttttcatttttagattatatgttagtgatatttactctttgtggtgtaagttgttgattccccttcttacccacctacagtttgtcaccttttaaccttgctcctctttgaggagttcttgccttctgagttatctataggagtttgggaagaaggggtgggtaaggaattggagcacataagattcacagtagtttttgtggggcatgataggcttgaatcatcatagataacaaggaagttggatttccgatggtggttagtggacacaggaatataaggcagattggatttagtccatttcattgtaagtggattgggagcttgaggctgacagtaaagtccttatgatgtaatgcagtgaattggtgatggaaagggtctaggcaaggagaaccagttggtgcagtgtgtctctgatactgtgactacagttagtggcccctttagtggatgagctactcaggagagagtggttcccagctggcacatagggatttctgccatggcttaattcagtagtatcctgagactatcatattggtacagtgagtttttttttattgaatttctctagtaaaataatataactttgcctttctatagaatatatatttaatgaatgttaatctaaataagtatttgttgtttttgttcttatttcaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacaggtaacagcttataaaatgctttaaattcaatttaaaaaaaactacagcatatgccaaagaagtaaatagcctgcatgtatggatttctgactcatcttactggtgataatcattaacactgttttagtttggtaaacctgctgtttttcttttagtcctttttttatcatgataaggtaaacataacataaaattgaccattttaaccatttttaagtgtataattcagtagcattaagtacattcacattgtacaactgtcaccactgtcctactgttaagagcttttctgacgtaaagttatttgtacataaagaacagaatttttataagttttgacacacatgtatacccatgtgaccatcaacacattcaagataatgaaccatcccctttccccctgccaaatttcttcattctcctacgtaatccctccctcttgtcccttgtccttagggtttctgtccctagagattagtttacattttctaaatttttatataaatggaatcatatagtatttactatttttttttttggtctggcatgttttactatggataattattttgagattcattcatgtttttgcatgtaaaagtagttcactcttttattgctgagtagtttctattgttacacattttgtttatgtgttcacatgttgatggaaatctgggttgtttttaggttttggctattacaaatcctatgaaaacatttgtatgcaaatctttgtgtggtcatatgcttttatttcttttgggtaagtacctctgtgcagaatggagaggtcatgtggtaggtgtctgtttcactttagaagaacctaccaaattgtttttcaaagtggttataccacttagtcttagtttgctgagtgttcttatcaggaatgggtggtgaattttatcaaacgcttctttgcatttgttgaaatgatcatatatatgtgtgtgtatgtatatatatatatgtctattaatatggtgaattacattggtttgtgtgtgtattaggaatttttgtttctgtactcttgagtgctgttgggctgtggttttcttgtaatgcctttgtctggttttggtgtcagtgtaatgctggttttattgactgtaatgggcagtattccatctggacctggagtgttcctggtgaaaaggattttaactacatatttaatttcctttgtggatacaagcctattctgtttatttgtttttccttgagtgagctttttatctttctaggaatttagctatttcacctaaattgacagatttatttgcataaaacatttataataatcctcctgctttgtttttttttttttttgagacaagagtcttgctctgttgcccaggctggagtgcaatggcgtgatcttggctctctgcatccttcgcctcctgggtccaagcaattctcctgcctcagcctcccaagtagctagaattacaggcgctcgccaccacgcctggctaattttttgtatttttagtagagacggggttttgccatgttggccaggctggtcttgaattcctgatctcaagtgatccacccaccttggcctcccaaagtgttgggattacatgcttgagcgacagcaccctgcctaatctcttattttaaaaatatctgtagaatctataataatttcacattgctcattcttcatattggtaattggtgtcatctttcttttttaaactaatcattatggctagtttaccaactttatcgatattaaaaacatctttggccttattaattttctatgtttttgttttctgttgcattgatttccattctgatctttattatttctttttcttttccttaccttgggattgatttgctcttattttatacttttttttttttttttagatggagtcttgctctgatgcccaggctggtgtgcagtggcatgatctcggctcactgcaacctccatctttcaggttcaagcctttcttgtgccttacctttctgagtagctgggattacaggtgcacctcaccacgcccagtgaacttttttgtatttttagtagaggcagggtttcaccatgttggccaggctggtctcaaactcctgggctcaagtgatctgcctgccttggcctcccgaagtgctaggatcgcaggtgtgagccaccacacccagccttattttatactttattaaggcgaaagccaatgccatttaatttacttgaaaccccttactctttttnnnnnnnnnnnnnnnnnnnncatatcatttgctaagttaattttaaattgacttaaacttactggtgaattcactgatcaactgttcttttcaagtatttcttttagaaatgtccttgctttgataaattttatgttctaaaaaagttaatttgatttttagaatcacatctttcaaaacaaaagaaacaaaaactcccacacgattctaaggctggttatgggtaacattaaaaatgacacactaggcctggggcagtggctcacacctgtaaccctagcactttgggaggccgaggtgggtggatcatgaggtcaggagttcaagaccagcctggccaagatggtgaaaccctgtctctactaaaaatacaaaaattagccgggcgtggtggcgggcacctgtaatcccagctactcactcaggaggctgaggcaaattacttcaacctgggaggcggaggttgcagtgagccgagatcgcgccactgtactccagcctgggtgacagagcaaaactctatctcaaaaaaaaaaaaaaaaagtgcattagctgtatctcatacatttagatatgttatgctttcattttcatttagctgaatataatttctaagtttgcttttttatttctttctgacccaggggttattggaaatgtgttgcttagtttgcaagtattttcgggttttgcaaggatatttctgctgttgatttttctaatttaatttcttactggtcagaaaaatacacctcatttgatttttttttcattaagtagctttcccccgcagctttattgagttataattgacacaaaaatcatatatatttaagatgtacaatgtgatgttttgatatacatatacattgtgaaatgattaccactatcaagctgactagcatatctatcacctcacacagctactttttttgtgtgtggcgagagcatttaagatttcctcttttagcaaatttcaagtctacaaccctatattattaactatagtcatcatgctgtacattagatctccagaacttattcatcctgcatagctgaaactttgtaccctttgagcaacagctccccatttcccttaccccctagtctctgacaactaccattctactctctgcttcagtgagctttgatttttttagattccacatctgaaaaagggagatcattcagggtttgtctgtctgcgcctagcttatttcacttactgtaaggtcctacaggttcatctgttgtgtcatgttgcaaataacagaattttcttttttaaggctgaataataggaattgtagtctgtttaaataaatgtatatgtatatcccccccatattttcctattcatccattgatagacacctagattgatgctgtgtcttggctattctgaataatactttatatgctgtgagtcctttcatatttattaagaattgttatatatcccagaatatgctctgtcttggtaaatgttttgtgtgcatttgagaagaatgtgtatttttctctggtcaggtggaatgtctataaatctcattaagtcaagttggttgataatattcaattcttctgtatctttactgattctatctaattgttttatcaattattaaggaaggtaaattgaaatctccaactataattctgaatgtctatttttctttgcattttagtcttttttctgttacgtattttgaagtgatactatattaggtacacaaatgctttggcttgttaggtccacttgatgaatagaccctttatctttgtaaagcctctttttatcttgggtagtattcttcagaaatctgctttgtctgatatgaatacaaccattccagctttccttttatcctctttttctgcctccttgtgtgttaatggagtgaattttttttggggggggtgctgatttggtgtaacactttgttctgcttctctcttttattatttcattcatgtttgccttagggcttctggtaaacatctttaaactttttaatatcacttgaaggtagactatgctattacttcaggagtatgtttaagactttgtaatagttgattccacttctctcctgtcttagggctgttggtgtcatgcactttcttttttcttttattgagacggagtctcgctctgtcacccaggctggagtacagtggtgcgatctcggctcactgcaacctctgcctcccacgtgcaagcaattctctgtctcagcctcccgagtgagtagctgggattatgggtgcccgccaccatgcccggctaatttttgtatttttagtagagacagggtttcaccatcttggccaggttggtcttgaacccctgacctcgtgatccacccacctcggtctcccagagtactgggattacagattacaggtataagtcgccacgcctggcttgtgtcacgcattttctttttgtgtatgttttaaaccccacaatgctttgctcttttttttttttttttttgtgacggggtctcgctttgttgtccaggctggagtgcagtggcgtgatcttgcctcactgcaacctttgcccctgccttcccccaccccaccttcccagtttcaagtgattcttatgtctcagcctactgagtagctaggattacaggtgcatgccagctaatttttgtatttttagtagagacggggtttcaccatgttggccaggttggtttcaaactcctgacctcaagtgatctgcctgccttggcctcctaaagtgctgggattacagacatgagccactgtgcctagccattatttttgttttgaaaagcaactagctttgaatgagatttaatatgaggaaattaattcctttatatttacccatagttattatttctgatcagaaaatatacattatatgatttgagtcctttcaaatttgttaggaagtttttttttttttttttttttttttttttttttttgagatggagtcttgctctgtctcccaagctggagtgcagtggcaccatcttggctcactgcaacctctgcctcctgggttcaagccatcctcctgcctcagcctcccgggtagctgggacttcgggcatgcgccaccatgctcagctatttttttttgtagttttagtagagatgggatttcaccatgctggccaggctggtctcaaactcctgacctcaagtgatctgcctgcctcggcctcccaaagtgctgggattacagacatgagccaccgtgcccggccaggaattgttttatagcccagagttttggtggtttttattcccttggaatactttagcatgaagtgttgctctattctgctggtgatgagttctttcagcttttgtatatctaaaagagatttttgctttttatccctgtttattattgtggcagaatatgcataagataaaattgatcattcaaccatttttaagtgtacagtggcattaagtaccttgacattgttttgtaattatcaccaccattcatctccaaaacttctttcctttttccaaactgaaacaatgtacctgttaagcactaactctccatccgcaagtgatcctcccacctcagcttcttgagtagctgggactacggacatgtgccattgtgcccagcttattttcatgtttggtggtatcctgttgcctttttagattttaggacaaaattgatatagattggaactttgctaaaataattttttttgtagaacagaatctagtgtagagtgattcatgctggttcttgaggacttgcacaatgtctggcaaatgactggtttgcagtgtttactgaattaaaataaatctcttggccggacatggtggcctgtaatcccagcactttgggaggctgaggtgagtggatcatttgaggtcaggagtttgagaccagcctggccaacatggtgaaaccccgtctctactaaaaatacaaaaattaggcgggcgtgctagcaggcacctgtaatcccacctactcaggaggctaaggcaggagaatcgcctcaactcgggaggcagaagttgcagtgagctgagatcccaccagtgtacctcagcctgggcgacagagtaagactccgtcacacacacacacacacacacacacacacacacacaaagtctttgcaaaattacttaggaaaaatataatagaacctagtttttagttgattcttatacatggattataaccagaggatcactgtacattttatgtataggcagtgattattttgcatggttattggagattataaaaaatggtgatgcatgctcaaggtatacaaaacaatcttactagtcaatgggtaaaattatggttgttctgtgatctgtaaaattttttgtcaaaacattaaaatctctctttttgttataaatgaatagagaaatgaaaaaaaagttatgctaatgtttagtataccataatgtaaaacattcgaggtattgagaattaaagggttttatttcttaagaaagtagtttgaatagtgcttgctaccttctcactgtgtaagttgttatgaagcacacatttttttctgtgccttggcaaattgtcattctcctttctctgggtggatcagctcctctcaacattttatcctttggattttaaatgttgtgaaatatcttctagagtttctttaacataaagtttttatgggtatcattttatctgtagtatcttcttccctttcttctcagccactttgttcatttatgttaatacatttgccttcatgatattcttctggctgcatatctgtagtctcctgaatggcagcaatgttagcattcctgtatgcattatttctgttttaatcccatttacattcaattcgaatttcacctctatctagcattatcacttttcatgtatttgctgcagtttcatctttgttggccagttctctctttgatacccagttttgtaaaatgtcacaatggcttatcatttaggggacaaggaagcagcacaactatgtactttgtagtctgtggataaacttaatatcagatgtacagagaccattcaccaataaactttgaaacaaagacacgattggtaaccagtaatgatgctcatctgttacttatgtggacttcagacctagcagcgaagtttctgctttgtgcgattatttatagttcttgtggtaactgaaatttatttatttttatgtttttatgagacagaatcctgttctgttgctcaggctggagtgcagtggcacagtcatagttcactgcagctttgaactcctgggctcaaatgatcctcccgcctcagcctcctgagtagctgggaccacagatgcacaccaccatacccagctaatttttttgggtggtgaggtagagatgggatcttgctgtgttgcccaggctggtcttaaattccttgcttcaagtgatctttccaccttggccttccaaagtgctggcactacaggtgtgaaccactgcacctgaatgtaactgaaatttaaattgtgtagttggaggactggtgttaactaaaatatggtaactgaaattcatgcgtatcagaactgtgcaaaacaactgcctatattttgttttttcagtaacaaaacattttcaaattatttttcttctttatttaattatgaatattctctgtgttctgctgagcttactgaattcaattctcattctttggaagatgtcttaattcatacagatgtagttatttcagtagatttaaaaataaagctgttaatactatcaattgacttactgaatcataaaaaaattaaggtgactaggtaaatgaagcttttgtaattctgtaaattacattgaattacttggaactcttaaatgcagctgaaatctaattggctaaatttacataaaaacaggcttttggggggggcatttattcttaattggggaattaaaaagagtatttccttgctcttccaaattgctattcttaaaacattgtttaagtaaatgcattgtagtgaaagaaatttttttttaaatctctcagagctttatgagggatttacatctgtcataccttggctgttgagtggtgtgtttttagttaaaattctgctttataatctcttaatacagcatagattatgtgccaattaggacataatctcaaaatttagaattcagagcttgtttgagttttcagtttcaaaaaatttttaaactaaaacaaacaaaaatcatctccaattctatcaggacttggataaactaaaccttaattatttcaggaaagagtccctttcctttcagtgtggagcttttaactttctgtttgtgtgttgacatgttttagatttataaagttttctattttaacaattttatcccccatttttcctgtcttagattaagttaccaaatattagtagctttccttggtgaagtaattactgataagtcctttctgtaaccaatattcacttcttattttgtaaatttttaaaagattcttatagtgatatttcttatgacacagtagtcatctaaaggtgccagtcacttttcctggaaaatataggaagtaatactaggagaaagtgtgcaactgttaaattctttcacatcaccaactttttcacaattaaagtatttgctttgtagagtgcttagcaatgtccattatgatttcttttttccattggcaattttgggcttccctcacatcatggaagttagaactggaagggacatgagatcatttggtttattctctgatgttatagtttgtgacactgatgcccaaaaaaataaatgatttgcctgaagtcgtaggtagctagtataacattagaaatcaaaagatgggcatcttgactcatagatgatccactgattttctcttctgtactacaatgcctccaatttgtaatcagagtcttcaaaatttaggaattggatgaattgccccatccagtctatttctacagtgggctcacaaaaccttatataacaaaccttcaaagtaactgcatcttttaggagactgtttagttttatataggcaaaaacctagttactgtgggcactggggaggtagggcgggtacctagaatggaaacactaactgagtcagtgctctggtttctcagatgttttgttaggaaccttttacatcttaaattattgaggatctacgtgggctttggattcattgggtagatcttccagtatttatcatatcagatattcaaacaaatttaaaaagtatttaactcatttaacaataaaagaaatccactgttagtacaaataacattttaatgaaaaaaactgttatccaaaacaaataaatttatgagaagagtggcattgttttacatttctgaaaatgtctttaaaatgtttggtagacgatcactgggttctcatgtctgcttcttcattcactctgttgtgatttgttgtttgggttgaagtatgtgaagaaattttgcttcacaaaaatatgtagttagaaaagacaggatcttggggacttcaggagtctttagatcagtcagagaactattgctttatgtggttattacagtttagttcctatagattatgtattgcgaatattatatgcaggccatcatgctcccattttaaaagaatcacccaatttgataatacatccccacctgtagtttcttttggctctccgtcatacattttttgtttcatccttactgactgactacttggtgatatttttggtgccattatccccattatgaaggggcttcttcagattcctaatggactgttggtatttatcttagatttcctcagccagtttcttaaaggtgtttcatgatttttttttttttggcggggggatggaatcttgctctgtggcccaggctggagtgcagtgtcgtgatcttgacccattgcaacctccgcctcctggattcaagtgattctcctgcctcagcctcccaagtagctaggattacaggtgtgcaccaccacacctaggtcatttttgtatttttcttagagacggggtttcaccatgttgaccaggctggtcttgaactcctgacctcaagtgatccacctgccttggcctcccaaagtgctgagattacaggcatgagccaccacgtctggccatttcatgaattttaacatcaagcatggtactcttctttggcacttactggctgagttgtgtgtccccccgccaacaaatttatattttgaagtcataactcccagtccctcagagtgtgactgtatttggagatggggtctttgaagaggtaattaagttaaaatgaggttacagaataggccctagtccagtatgactggtattcttgaaagaagagggtgaagacgcaaagagaagatggccatctgtaagtcaaggagaaaggccctgagaagaattcagtcctggtaacatgttgatcttggacttgtagcttcctgagtcgtgagaaagtaaatttcctagccacttacctgtggtactttgttatggcagtcctagcaaactaatatagccctcttatgttgtcattagcactatcacttttatacttttttccagctattatggatataaactttcaccagaaccttcaatattgacagaaagatataatgtagattgataagtgtcatttgtcattcaaaatcagaaaagcatgacatgtacagtccttgcccagtggctaaggagcattcattagcactcacttgatatggctgatttactgtgagaaaagtatgttaatggtactagtcagtactctggtgggtttgtatgcacatctagtatttctaagatgaaccatgctatgctgtattgagtaatgcccccaaaagatatccctaatccctgagaatgtggatgttaccttctggcagaaggggctttttgcaagtataaattaaagatcttgagatgggaagattatcctggattatgcagtgggccataaatgtaatcacagatgtcctgataagagggaggcagaggaggatttgacatagaagagcagaaggtggtgtggaaacaggagcagagattagaatgatgtggcgataagtcaaggaatgctggtagtcaccataatctcgaagaggcaagtgaacaccccctcctgagccttctcagggagcctgtccctgctcactcttggatttgatcctgtaagattttgttcagatttctggccaccagaactgttaagaggataaatttctgctaaaaactttatacaaatctttgcataaatttatacaaatttatacaaatctttgcataaatttatacaaatctttgcataaatttatacaaatttatacaaatctttgtcagagattggttcttcatgaaatagattaaaattggaattttaaaaggatgttataaaattgtataatattcttaacatcataaggaaaacacgaaaaatttctcaagtttcctgccaaagtcctattatgaaatagtattttttatcttcagctttactgttttaagactgatacctaaccaaaacagttgctaattttcctgttgtaaatattgaggaccaatagtaaaatgatttagagcaaatttcctaactccccttctttggaaggaggacaccttttattatttcagattaattaagcatgcttgctttaattatagttattaacacggtaaatttatagaggagcaagctatagtagagatacactaatatagaatatagattcttctctgaatgtaaatacatgctacagaacacatacattcttatttgggggctagagtgacaaagccttatcttggcactaaattttagctcagtattatctaaaataaaattttcttaattattacattgataaacatttgtttcaaaattattctacagggattcttaatagcacctagcagagagcctggtactactatgagcttacttataaccttagttatagtaagttacttcatgttaattgcagaaatttatgaattttaatatattttagatatctgaaatttttgaaattaaataaaagatactctaaaatataccagtgatttctgatagcattaggttttcttcctttgtattttctttccttctccttcctcctctctccctcttcccctttttctttctttccctacccccttacttttttccttcctttaacatttcctgccaaggaaacacattttggctaaaatataatttgtatcagttaatttttttttttttaaaagaacaggtgtactaaactctcccagactattagttgttggtgtggtaaccagaccttcatgccatcagacgagttaatctagtgcaggggtccgtaaactgtgatccatgagccacatctagtccttccccctccatttttataaataaagttttattggaacatagctgtgttcctttgtttacatattgttacggctgcttttgctgacacatggcaaagttgagtcgttacgacagaagccatatggcctgcaaagtcttaaagatgtactctctgattgtgtccagaaaaagtttgccgatccctgaggtgttataaaaacatttacttcaaaaaatttaaaaagtgttcatgggatttaacaccggtttctctatttatagtaagtaacatttttttttaagataatttttctggaggtggatttgctgaaattccttaaggagccagaaattttgaagagtggggctggtgcagattgcatgatgatacaagttgtacatgtttatggcttcattcctaccatatccccagcatatagggttagcttgcgtaagatatgatggaagaagttctgttaggggtttggtattctgacaccagtggggtactgcagtactgttctgacactgatcacacagagttagtgcagaccacacaagggaagggctcagttccagaagtctgccttcatttcaggtgctagtggcaagtagggtccccattctacccatacttatggccaactagctacaaatctggggagtttcccacaacccctctcagggttgataatttactggaatgattcaaagatttcagggaaacactacccatatgattacgattttatttaatggatacagatcaggaccagccaaatgaagagacacacagggcaaggtctgggagtttccaaacatagagcttccatgccctcttcttgtggaatcagggcatgctaccctccttgctcatcagcgtgttcaccatccagggagctccaccaggcaagctccaccaggcttcagtgtctagagttttatcagggctagtgctgttttctcacagtttttggtttatgcagaaagaaaagtaacattaattagtgtccatatgtattataagttaatgaattgttgtcaggtaaggcttatatattgattctaatatttccccccttttttatgtgaaaatgaaagtttatagtaatatttttgttttatttttattttatttatttatttatttggacatagggtctcgctctgtcacctagattggtgtgcaatggtgtgatcatagctcactgtatcctcaaactccctggctcaagggatccgcccacccagcctcccgagtagctaggactgcagatgcatgccaccgtgcttggctggttttttcatctttttgtagagatggggtctcactatgtttcccagggtggtctcgaactcttgggttcaagtgatccttctatcttggtgtcccaaagtgtagggattactgtgaggactagtaattttttttttttttttgagataagtctcactctgtcgcccagtctggagtgcagtggcacaatctcggctcactgcaacctccgcctcccgggttcaagtgattctcgtgcctcagcctcccgagtagctaggattaaaggcgcccaccaccatgctcggctaatttttgtatttttggtagagacgaggtttcaccatgttggccaggctggtctcaaactcctgacctcaggtgatccgcctgcctcggcctcccaaagtgctgggattacaggcgtgagccaccgtgcccggccagttgttttttttaaatgtccttattggccaataaaattggcagcaatactttgtacttctctttctgtgtctgtctgtctccccgtcctttattacctttcccccttctcccctactcctttgctttgtctgtctgcctcccctccctgtcccctccccctttcttctggaatcttttaaaaacaatttattaatctgtgaaatccatagttagaataacccagactgttccatctcccagttaccttttttgttgttgttgttgagacggggtctcattttgtcacccaggctggagtgcagtggcatgatctcggctcactgcaacctctgcctcctgcgttcaagcgattctcctgcctcagcctcctgagtagctgagattacaggcacgtgccaccatgcccggctaattttttgtattttttgcagaaatggggtctcaccatgttggccaggctggtcttgaactcctgacctcaggtgatctacctgcctccgcctcccaaagtgctgggacccagttatgttcttttaacacatgcatacacaccaacccgccatcccacccctgagtgaacaaagaatgaaacttgaaccatcacccttatggggtcagaatattatttatttttaggatagagaataggggcaatgctatggatttagtttctgttccaggagtaaaccaaccaaacattcttcctgtggtaataacagaatagttcctatcaaatgagtcttcttacagataacttaaactctgaacaaaatataaaaaacaaagagtacctgaagaacaactaatagcagaccgaaactacagataagagattgttattatacacttttaaaaatgaaatagccctggttggtttgctacttttttgtgtttttttgaacagagtctcgtgacgcccaggctggagtgcaatggtgcgatctcagctcactgcaacctctgcctcctgggttcaagcaattcttctgccccagcctcccgagtagctgggactacagtcatgcaccaccacgcccagctaatttttgtatttttaatagaggcggggtttcaccattttggccaggctggcctccaactcctgacctcaagtgatccatccaccttggcctcccaaagtgctgggattacaaacgtgagccaccatgcccggctgggtttgctatttttgtagctagttttgcaccatgctagacagctaaaactcagttaggaaactgcatatagcttgtgacccagagggcagagttcatggtgaccacaacagctggaaagtgagtggaaagagagacctgaagggaaagagccccaaattttgtgttaaaactttgcctgtattacaggctgagctgtgtgtggagcgaactgcatgcaactcagccaaggataaaagaactgaacaaagatttcagctgctgcccatcttggaggagaaagtttgcgatttaagtcaagctaagtttagtatcaacttttttttttgaggccgggtctcactcttgtcgcccaagctggaatgcagtggtgtgattatggttcactgcagccttgtcttcctaggctcaggtgaagcctcctcctcccacctcagcctcccaagtagctgggactacaggcatgcaccaccacacctggctaatttttcgtattttttgtagagatggggtttcaccatgttgcccagacctgtgtcgaattcccgggctcaagcgatccaccaccttctgcctccaaaagtgctgggattacaggcgtgagccactgtgcctggcctactgtaaacattttttgtttgttttttcttttctacttctttatctttttaatttttctgcccttgaaaatcaaaacattttttaaaggactatagcagaatctagagtttctgtaaggtatcatttaccacatataaaatgtaatctaaaattaccatacttaggaagaaccatgaaaacatggccaatattcaagaaaaaaagataatcaattgagataaaacttgcaattacatgcatgttggacaaatgatgatttcttatgtgtgacaacttgtggattcagggacttaaaactttttgtagtcaaagggaattttaggatactgattctagtctaattcattgtttttctcatgtatctaaggtctaactggcacttaccagtttgttagcctcttgcactgatattactcattttctttccttcttggtgtgctgcttcccctgtaaggtgttaacttgtttggtgtatatgattcaaggaccaggagatagaaaccattctaactatcttaaatataaatttactctccacaaataagttccagaactcaaaaactgatctgctggggaagctataaccactgatggtgccacaggaattactgagtttaagaacgttatgcaagggtttcaggccatggcttagaaagctgctgccattgttgctgcctcaactgcctcttgacacccacaaacctggtgactgggcattgaacttggagtccagctgttgtttccagtgcggttgcctgtaaacatccaaacagttggagaatggacactggagcatcaatttggaaaaaaaccttatttcttgacttactttgccaataggaaatgtaaagtggtaataagagatctccacttcactttcagtttccaaatcccatgaaagtattttattgatagatcagaaattgtatccagaagcctggtggtgagaacaactggacaatgttgattttagctttttagcttctgcagtgcaagcagatattcttggggcaaggatcaggagggtagaatgaagattgaatgagctggttttacagcatggcttgaaggaataacagttgaattgggtcttaaaggaagcctgttcatttatcatgttgatacggagtatagatgcattccagtctgaggtaatggcattagagaaagacatgcatggttttttcagggtgattagaatgtagggtatgatttctgcaatgaggaaagtacctggagatcaatttgcaaaaacctaaagttctaaattatagcttattttcctttgatttggtttcattgctgaggctaattgtgttgtgctaggggagtagctggtatcctttggcttcttctctgcttcttgtatctgctgggtgctggaattacacagctcctgagtcagagcaatatgcttagcagaaataagcatcagtcttcctgaaccatcagatggcagactgacgtgatatgccctgaatcaaaggaaaggcagtatcttttggaaattggagactctgttctttgcttttagggtaaacagctggcaatcctgcttctgttcaatatgctttttggagaaatgaatcacctaagcctgcattctgcctcaaataatctgtatttgtggggttaaggaagcaaatcttcagtccctccctgttgatcacaaagtgtgggtgaaaccatttctttgttgtgtcctaaaatatgacaacggagtgttctcattaaccttagaataaaaactaccttttttttttttttttaaataaaaagtgactttggaactgtccttgagcttgagtataaacagctagtttgggagtctccttccaaatttcatgttcttttggttgtctgtaagccgttcactcaccaggctactgctcagacctctgaagtctgagtcttcacagtagcctaatcttgctttaaagtctggaaatggatttttacttcctatagttcagataccatagcatggcataaaagtctcattgatgtggtctcttcaactctcctatttctgccatgcccagcttcttgaagtgttgcagacacagctgtaaatttgtgcgtctttgtttttccaattatgtgtttgtcttacctggaattcagtttgtcctgtttctgttctgcctaataggaacaccgtctgaggtcttcactaatcagctcaggatagagttactggccctctctttgttttataccttctaacttattccttcttttacattgatttttgggtatatgtttgtgttccttaccttactctttaaagataaggaccatgttttattcatctctgtatctttattacatagtaactggcatttacatagtttgataaggatatggaaagaataagacagtgtggtgtattttggagtcataaagacctgtgtttgaagccatgttctgtcactgtgtgatttttcctacctacctttttgagtttagttatctcatatgcagaatttggacaatagtgctaaccttggagattaaataaggaattgcttataaagcatttacctttacatagtgttggcattattagtcatcatatctgtcatcccttttttctcttatattcaatctctcttgtgttcccacttcgaataaacatttaacatgtgtatgtcttcccatcttaagttttcctaaccatgccttttgatatattgcctttctctgttgtcagtttacaaccaagttcttgaatctgctgtttcctggcagcttcttccttcaaacatatgtatgcctcaatccattgtgatttttttttttttttttaaatagagccttgctctgtcacccaggctggagtgcagtggtgcgatctaagctcactgcaacctctgtctcccgggttcaagagattcttgtgcctcagcctcccaagtagctgggactacagacatgcaccacgacgactggctaatttttgtagttttagtaaagacagggttttgccatgttggccaagctggtctcaaagtcctgaccccaggtgatctgcttgcctcagcctcccaaagtgctgggattacagacatgagccaccacacccagccgatctattgtatttgactttgtttccttccactccctggacattgcttttgcagagtcatcaattatatttgttcttaatataatagaattttttttttttatttcatcctttgtactacatagcagaatttttttttacttcatcctttgtactacataccaggtttgtaattatgtttatttgtatgcgtacttatttaatggctattctttcttttgaggttaagtttaatgatgacaggaaccttatctgttttgtatatcactgtatccctagtatcttcaatagggcctggcaaggagttgatcctcaagtctcttaaattttcagtgtgtcactttagaaaatctgtagttctttgcaaatagggcacgatgtcaattttatttttagaaagattctccattttgaagcagaatggatacactctagtgtaaaatttcaattatcaattatttggttcagaatgttaaacagatgacttaatgtgatcactaaacatttttgcctgcctgtttcctgaaaaagtcaaaatttgggaaattgaaaaggataacgtagattagaatttgtgtaataatttagtattactggtgtttgcattgttctctacatttccactctgccttgcaattcttgtgaaatgaccaggcaagagctatttaaccaagaaataggagagcaaatggacttcagccattaaaaaatccctgtacctgttacttttattaaaaacccacacccatttctgtcagatgaggtcatgtcaattcttaaactttgcctttagcctaaaggtaaagggaagggaagcatggtataaaagattgatcttatttccccttgctgctctagttttcttcttttccctttttttccctcatattctgtgcttcaaacatcctaatttatttactcttctggaagtgtatgtttgtagtgctagtccctttgcctggaatgtctgtctcccctatttcttctgcctaactcttgctcattgtttaggcttcgtcttaattgtctctgcctaatggaaaccttttccttgctcccagaacactaggtttgatttttcctagtacttctatatatactcctgcatgacagatagcttctgtttgatcttcctgatctatgctttcctttttctctcctgttctgtgcccggtaggcttacttgtatggattttgtcaatcagtatctgtgacttggatcacagttcagctagtgtagaaaacaggtagattggaagcagtgagaaaggccaattcagaatatttatttccctggtttcttcgctgtgaggttaccttgggttggcagtgtccggacacaggtactgcctcctccaggtggtcttctctgtgtgactttctgttccacattgttgtaatctctcccaccccttgccatttggatttagaagtactgctcctgctgttagcgctacttcctatatttaccatgttttcccctttcccctcatcactccattgtgtttacttcctttgtatgtaaatgctctgtgaatgattgtcattgatttattgtattagtttttgattggaagtctagctagtatatccccaacatgtattatttgtgatactgccttctctctctcaaacaattgcctgtttttgcctttgccctcattttaggtaaacaggagcctcagtcggtgaaattctaaagcactctacccactttagataggacagtgctgttttagtttatattatatattgagagtctctgtaagacttgatttgaaattagggttgaataataaaaaaggtttgaaaattagtgactacaagggaaaaaatcctaaattacttttaatggcatttaaaggttctttaaaggtctggcatctggcgcctgccttaattttttgccttgtcctaactcttcttagacttttaacttccagggataacaaatgttctctcccatgttagtgtcttgacatatgttattacagacatgcatcacctagctaatgcccactcttcgtttagttcttattaacctaacttttttaaaagggtggttttcccctgtttctcctttctgacctgtttcctgtcagcaaacatgctattaggagtctctgttaactatttttgtggcatcctatactttcccttcatagcatttattatttgaattatatagctatttgtctgattgttcggtatgtgccttccataggaggtctattatggtcattgctctattcccattgtctagcatgcatgcatgcatttatccaacaaataacagggaaggatgttagagtggaaggataatcacatcatctctttggaggagtatgatgcagaatttagggccattagaattctttacttcagttaatgaaaaatcagtgtatctttttagagaaattttattggattgcaagttacaggcataggacaaaagagctttttattttgaacagtttgagaataacttgctggtatgatgctctcattgcccctaaatactgtagtgtgtattttcttttttcctttttttttttgagacaagttctggtcctatcgcctaggctggactgcagtggcgtgatcttggctcaccgcaacctctgcgtcccgggctcaagtcatcctgccacctcagcctcctaagtagttgggactgcaggtgcataccaccacgcctggctaatttttgtattttttgtagagacagggttttgccatattgcccaggctggtctcaaacttgtgagctcaagtgatccgcctgccttggcctccaaagtgctgggattataggtatgagccaccgtgcccggccacgatggtgtgtattttctagaaacaaatacattttactgcatcaccgtattacgctcatcaaagtcgggtgattaccactgatacattgctaccatctaatcaacaaattccattcaagtatgccagttgttccagtagtttcataggaaaggatccagttcagaaacattaaatgtcatgtctccttcatcttcctcagtctggcacagttcctcagtcttctcttgacctcatctgaccttgatcctttgttttttgagatggagttttgctcttgttgcccaggctggagtgcaatggcacaatctcggctcaccgcagcctctgcctcctgggttcaagtgattctcccgcctcagcctccccagtagctgggattgcaggcgtgtgccaccatgtctggctaattttgtatttttagtagagatggggtttctccatgttggtaaggctggtctcgaactcccgacctcccaaagtgctgggatgacaggcgtcagccactgtgcctggccccttgattttttctttttgaggcaaggtcctggtctgtcacccaggcagcagtgtaatggtcctgtcatggctcgttgcatcctccacctcctgggctcaaatgatcctcctgccttatttttttgttttattttatagagatgagttctcactatgtttcccaggctggtctcaaactggagggttcaaccatcctcccaccttggcctaccaaagtactggaattataggtgtgagccaccgtgcgcggctgaccttgatactttggaaaatttatagccagttgttttgtagaatgtgtctccgtatgggtatgtgtaatgcttccttgtgattagattcaggagttttgtttttgtttttgagacacagtctcactctttcccccaggctggagtgcagtggcgcgatcttggcccactgcaacctctgcctccagggttcaagcgattctcctgcctcagcctcttgagtagctgtgactgtaggcacacgccaccatgcccggctaattttttgtatttttagtagagacggggtttcaccatgttggccaggctggtcttgaactcctgacctcaggtgatacacctaggttggcctcccaaagtgttgggattacaggcttgagccactgcgcccggcccgattcaggtgatatattaaggatgactttttgaaggcagtagtttcctatttaaaagctgctcccactgtcttaattttttttttttttttttacgtttttgtggtttatattgtaaaattgttttccaagtgtttttagttttgtgtctttagaatctgtgataatatggaaatctagaggaagcctgtagagaacttggcatgcccatcaagatgtgatgtccctaaaaatattttgaaagagagcagcaaaatgtactgtcagaggaatttttttcaattaattgggaataattgattttgctataatttgtcattaagatcatttctaattgaaaaattctttgggttttgaattgcaaatggtacttgaacttctaacgcataaataagtatatttaattatggcagaacttatttctaaaatagccttcttggttaaaacaaattgtacacatttcatctctcagttttagctctgaaatgatttgaaaatccaaacgaaggcagtcagaatcactgttctaagcctatttttagattttttccccttcagttggtttcctttctagccacctgcagttttatgtgcagttgcacgtgctcattttttctaatttcccccctcccccgaagcttggcaagcagcttctttattgcttttggtttgttctttttgaagagcacagtgtaaattataaagccttcattgagtatttaaatgtattttaaaatatttttgagaaaatgcagcataattatggaatacaggacactctgcctctaagaatcttttctgattatagttctcgatattatattaatatactatatattaatatgcagaatatatcttttttattcttgcagtttttttctgtttttaaagatttgtctggatgacagagctttgggagatggaactggaaaaaagctaaaaaaattgcctcttctaagaaatcatataactggattcacaaaaatacagtgatacttattttaataggagtactattgaatttacatttaatgtagttaatgatatatttgaattcaaatgaaacaacatcattttgtgttttctacttatgtcatctgttctgtctcttttttctcctttctttcttttggattaacttccttcggagatttgttacatgtgtacatgctgactcctgcttgtggtgaatttttttccttatgtgttttgtaaatttgtgttgtaagcttattttaagatctcatgtgttgagatctctgtgccacttaagggatataccattgataagctaagctgaaggtatattccctgttctgctaagtgttctaggatgccgtcagtccaggactatttatactttttgaacctgaaaacttcatggaaatgtgtatactttctagaacattccccaaccccacctcagtgtgtgcgccttagtttcctatagttgctgtaacaaatcaccgcaaatttagtggcttataacatatctttattatcttacagttctggaggtcagaagtttgaaatgggtttcactgagctaaaattaatatgtggatagggctgtgttccttctagaagcactaggggagcatctgttcccttgccttttttcagcttctagaggccacctgcacttttggcgcatgaccccttcatccatctttaagtcaccaatggccagttgagtctttttcgtatggcatcactgatcagtactgaccctctggcctccctctttggcttgtaaggaccctcgtgatttcatttgattcaccccccccaatactggatagcaccccgtctcaagattcttaatcacatctgcaaagtcccttttgctatatcagttctaacttcccaccttcagcaagcccaaagggtattttaattttgtccccatgtggcataaaagtacaagctcctttgctagaggccaaaaagctactacagagtagctgcagccttgttcatgttttctgctctgaatttttgtcctctctttttcctagtctccctggattttctttactctctttagttttggactgtgaattttaaaaagatgctttcatagcatctttaaatcaagcatttttaggtagtttctagtgggagagatttcaggttatctaatgtgccatattgctctagttggcattgcttatattagtaaggtaataatgactttaacaagacataaagtctgttactttgttttcctattatcctttaatttaaaatgcttttaatgtcaatcaaaacccctcagtgaatctcatctttgaaaagtcagttaattgtgattaaaactcagtttcttcatatgaacattccgttctactctgatatcgacaagccatgctttttttctttaatctgaacagcatgtcttggtttacagctctgaccccactattcagccagatcaggtttttcctaccatgccttgccttccttcttgactgtctgctgagattctccctcatttttacattttctgtgtttctgcttatctcatttgagctaaaggcatatagatactcttctgtaccaagctgttatctttggacttcattttacaactccctcccttcctccctgtgataatatgtgaatgtgattaaaaaccagtcacatactacctaagggattacaatgacaagcggaattcagtgcaatcccttcctatccctagtcgtgctttctagagcacttatagagtgcatattgtataccaggctttttacataaatgaacacctatgaattaattcattcttataacaacctcattttacagatgaagaaattgatacacaaagagcttaggcaacttgttcaggataatacatctattaaatggcatcatttgaaccaggcagtctggttttagaatctacttgttatcactatgctatactgtccttagttttagactaaaaattactttcctttagacttaaaaaataaattttactgtgtatatttgaggtttacaacatgacgttatggcaggggtccccaacccctgagctactggcctgtactagtccgtggcttgtcaggaaccgggctgcatagcaggaggtgagcagagggccagcgaacattactgcctcctgtcagattagctgtggcattagattctcacaggagcgcaaaccctattgtgaaccttatgtccaagggacctaagttgcatgctccttatgagaatctaatgcctgatgatctgaggtagaacagtttaatcccaaaaccattcgcctgtctccccagtgcgtggaaaattgtcttccacaaaaccggtccctggtgccaaaaaggggactgctgtgttatggaatacatatagacagtaaattagttactatagtgaagcagataaacacatctgtcatttcacatagttacttttgttaagtgatgagcacctaaaatctacttatttaatgaaaatccttaatacagtcatgcttgcttaatgacaaggaaatgttctgagaaatgtattcctaggccattttgttgtgtgaacatcatagagtgtacttacgcaaacctagatagtacagcctactgtatacctaggccctatggtacagcctgttgctcctaggctacaaacctgtacagcatgttactgtcctcagtcctgtaggcaattggaacacagtggtatttgtgtatccaagcatgtctaaacatagaaaaggtacaataaaaatacagtattataatcttatggaactattgttattatgtggtgtgatatatatgtggtccattgttgaccaaaatgttatgtgacacatgactgtacaatacagttttattaactgtagtcctcgtgttgtacatggatctctaaacttattctgaatatctgctattttgtatcttttgacccacagctccctctcctttccccccaaaataaccatggtaaccactgtttcattctctatttctgtgtatttgagctcttttattttattttttgagactgggtctcactccgtcacccaggctggagtgcagtgacacaatcatggctcattgcagcttagacctacgaagcttttgagctcttttattttattttttgagactgggtctcactctgtcaccaggctggagtttctccgtattgccttggttatttaggatttttgtggctctgtatggattttaggattgttttttctatttcagtggaggatgccattagaattttgatagggattgggttaaatctgtatattgctttgggtagtatggctgttttaacaatattaattattcctatctatgaacatgggatatctgtccatttatttgtgtcttcagtttctttcatcagtgtattatagttttcagtgtacaaatctttaaccttctcggttaaatttactcctaagtatttttttttggatgctatcataaatggaattgttttcttaatttccttttcatctgggttattgtgtgtagaaatgttactgatttttgtatgttgattttgtattctttaactttactgaattcattagttctagcagtgtttttatcttttctgtgggatctttggggttttctgtatttaggaacatgtcatttgcaaatagagataattttactacttcctttctgatttaaatgcctgtttatttctttttcttgtttgatggctcttgctagtacttctagtactgtgttaaataaatttttttattttagaagtcaacatattttaaaggaaatagttcatttcttctcccttccaatattgtcattgagatgtcttatgtgtcactgattgcagatcctttgtatattcttatctttttctctctggaaacttttggcatatttaatctctactgtggtgctttgaaatttcacagttatgtaacttggtatggtgtttttggtttttttttttttttgagacagtctcgctctgtcgcccaggctggagtgcagtggtgcgatcttggctcactgcaatctccgcctccttggttcaagcaattcttgtacctcagcctcccgagtagctgggattacaggcgtgcgccaccatgcctggctaagttttgtatttttagtggaggcaggatttcgccatgttggccaggctggtctcaaactcctggcctcaagcaatccgcccaactcagcctcccaaagtgctgggattacaggcatgagccaccactcctggccctaagtaacaacttctaatgtctaagattgctaagatgagttgtatttattattggctataagctttttctagtttcatatcatcaggtaaactcagttaaaaacttgaataagaactgggaaacaataataataataaaaagctaacatatattgatttttctacatgccagacactgttgaaaatccattctatatattgcttcatttaatccttacagtaactgtgtgaagttgataactgtttttttgcttgtttttacatctcgtatgtatggtaaggaaactgagggcataggatggttaagtaacttacccatgtgcacacagttagtaaatggtacaaccacctattaaatccacacagtttggttcctgaactcaactcttagtcattagactgtacttcctgacatatgtagagaattttattttacttattttttatttattgagacatggtcttgttttgtcacccagtttggaatgtagtggcatgatcactgtttactgcagcttcaacctccttaagcaattctcctgcctcctgtgtagctggaactacaggcgtgagccaccatgcctggctaatgtatttatttttattatttttatttttatttattttggagacagggttgctcaggctggagtacagtggcacgatcttggctcaatgcaacctctgcatcctgggttcaagggattctcctgccttagcctctcgagtagctgggactacaggcgcacatgtcatgcccggctaatttttatattttttggtagagatggcgtttcaccatgttggccaggctggtcttgaactcctgacctcaagtgatccacccaccttggcctcccaaagtggtgggattataggcgtgaaccactgcacccggcccttgcctggctaattaaaaacaatttattttttgtagacacagggtctcactatgttgcccaggctggagaattttaaatatatcatctttttaagaagggagagacactcatgaaatattaaaacaaatgttagttgttaggtaagaagtagtaggttgaagaattaagttcaaattcatgacctggtgcttagaagatcaactgtgatctaatgttctattaaaagctcatatttagcttagattctagtttggataaaaaatgattatcactaaattaggcaaaaaagtttcctttttgaggtgggtatgtaattaccacatagagtatttagtagtttgtcttatataattaagcaggcgaggaggagacagaaaaatgtcatgggaagtactaaaaaattagacgtgggccagaatgttagtgacagattcagtttttcccaggccaaaatatttcagaataattctgatccaagtggtttttgtttttccaccagagtctgattttgcagctcatcttttctaaatagatctattttatggtgtgtatatgggtcattctgaatcaagttaacttcgaagttgattgggaccttgtttcaagcttattgaacaaagatctgtaacacagaattttgggcataaggccatttccagagtctggtccaaataagcaataacagacaaagattgtctctttcttggctgaaggcttcctctgtgcagcttgtctcaggactctcttcttctgccctttttatacccctctcctttctctattcagggcaaaaatattttgattttcattctgtagttattttttagcaaacatttattgtgtttttacttatgtacaaggttctttgcttaaaacctataatgcccttcctgtagtagcagtggcagttgtgaggatgatagtaggccttctgagatgatattgtagaaaatccatggaacgttaagtagtgttgctatgtcatacttctttcctgcctggctttctgtcttttgatgattaagaaggatttttctggaagatctttaaaagaagcatatgtgttatttttatttcctccagagtgacaagggagaggaaaaagaacaaaatgaaaacctatttctatacagcagtttaaaataatcatatcttaaaagataattttaaaatcttgtctgcttatggagtttgtcattttatttctacattttagaaaatgttttcctctctaaatataattgcttttagaatattttaatgtttcctttagaacatttgtttaccacacaattaattttatttattcaattcccaatctacttatttttataaaagccttgcttgaccatttaaaaagaagttttcaaatttggtctcctaatttccataatcttttcttcaactcttaattagagtagagttcaacttacttttattcatactattttagcttttctctcatctcggagaaggtgttgtgttttcatgcctcttttccctggcttatgctgtcccctgtgcttggattttgacctttttccccactctccttttttctctttcacctgccagttatggctggcaaaaatgaggtttctttcatggagtcttttgatgttgcttcaggaatattaatcattcttttctgtatgctatttgtgtgtaattaaagacaaaaattacacttattcaaaagaataaatgtaatatatgttatgcatatataataaatcagacatctctgaatccatcgttaaaactaaaaactagaaaatgaccaattctgtttcttttctctgtatacttctcaccaaccacaaaagggatgtttatcattcccttgcactaaacatttttttaaatcgcatgtatgtgtatcactaaacaattattgtttaattttgcttgtgtttgggcttataacaatggattcatcctgtatgtagtctagcatggcttgctttttttattcagcattataatttctaagatttatccgtattacatatacatagttcattcattagtagtttgttcattctcattatatagtgtataatatttcaagtataaatatgccatttatttgcatttaaatgtaaaggatctggaattagttttttcctatggtttgaggtagggatccattttcagtgtttttttctatatggcaaaatagttgctctactcaaataaaacattcttcttactgtgctatcactgtaagataccaagtttccttataagcatgattttttttctgaattctctcttctgttgtattggtccatttatttaaccctgtaagaaccctactatcttctttactatggcttcgtatctcaataggcaagttaccctcctcccttctagtttttcttttagaccatgtcttagccattctttcccctttgccctcccatataaatttagaacctttaaaatctctgttggcatttttattggaatgcattgaagctgtagatcagtttggaaagacttggcatcaaggtaacatgggatagaagggggacaatcgggtgtatgtgtggttgtgagtagatgggggtgtgttgtatctggctttgaagaccatttaagtttttttccaggtttttctttcaaactcctatctcactgtttccttatttcttatttataacttgaagtaaaatataattggataggggagagagcttttagggttttattcagggtgttctagtaatttttactttgaatatttctcttgattatgttatgttccatattgcctttagtctctctcacaactcttgatatgatttttgcttgtcataatgagtctgccaaaagagttttccacttgtattatattcgctctgttttgttttttttttttttttttgagacggaatcttactcttacctgggctgtagtgcagtggtgtgattgtggctcactgcagccttgacctcttgggctcaggtgatcctcccacctcagactcctgagtagctgggactgcaagtgtgtgccaccatgcccagcaaatttttttgcattttttgtagagatggggtttcaccatgttgcctaggctagtctcgaattcctggactcaaatgatccatcctccttggcctcccaaagggctgggattataggtgtgagtcactgagcacagccagtattagctctgtattatgcctcttgcattacccaaattcagaggccttgtttgcttttattggactaactagaactatgtcatttttaccagcccattgcagtacagtttcattttatgtgataaaaatacaacataagtggtcacttctgcagcacgtacactaaaattggaacaatacagagaggattagcatggcccctgtgcaaggatgacatgcaaattcatgaagtgttccacatttttctgacaaaggtctaatatccagcttctataaggaacttaaaagaaaaaaaaacaaccccattaaaaagtgggcaaaggacttgaacagagaacagacacttctcagaagacatacatgtgcggccaacaatcatttgaaaaaaaattcaacatcactgaccattaaagaaatgcaaataaaaaccacaatgagctaccatctcataccagtcagaatggctattattaaaaattcaaaaaaataacagatgctggcgaggttgtggagaaaaaggaatgcttttacactgctggtgggaatgtaaattagttcaaccattgtggaagacagtgtggtgaatcctcaaagacctagagacagaaataccatttgacccagcaatcccattactgggtgtatacccaaaggaatataaattattctgttataaagacacatgcacatgtatgttcactgtagcactattcacaatagcaaagacggaatcaatctaaatgtcccatcagtgatagactggataaagaaaatgtgtggtacgtatacaccatggaatactatgcagccatcaaaaaagaatgagatcatgtcttttgcagggacatggatggagctggaggccattatccttagcaaagtaatgcaggaacagaaaaccaaatactgcatgttctcacttatatgtaggagctaaatgatgagaacatatggacacatagaggggaacagtgcacactggggcctactggagggtgaaaggtgggaagagggagaggaccaggaaaaacctaatggatactaggcttaatacctgggggatgaaataatctgtacaacaaacacccatgacacatgtttacttatgcaacaaactaacacatcttacatatgtacccctgaacttaaaagttaaaaaaaacataaaatattaataaaatacagaaaatcccttttaaaatgtgaagatttccttcacattaaaaattttgtgaaccactgcgtaatttcaaaactgaaaaggggattaaacagtttcttttattgtcatttgatgtttagtcaggaaacggaaacaccatcatttgttatacgtcttgaattttgtgagctttgaattatataaaacatatgtaattcaaatgtgtgtatgtattcatgctttaaaaggtgattccccctgtacatgttcatttttttggttacttccaaatttgttccatgtatattctattttgattttgtctcttctccttcaggtgctgatgcatcaagcatggtcttcatttattgacaacttgtctttgggtttttatcttttctctagttagtacttttgatacccctacctctaagatccactttcttttttctttttccttttccctggtgtcctggtgcttgaggatagaactggcagacgggaagctgcatggctccaaagacatgccaagggggccagagctcttccctttgcctctgtacataacagggagtgggactacaagttcctgccaagaaaatgaggatccacttttttttttttctcaaatgaattttagcatttgtttacgttggaatcagttgagttttcaaactgctggtatcttttttttttttttttttttttttgagacggagtctcgctctgttgcccaggctggagtgcagtggcgtgatcttggctcactgcaagctctgcctcccaggttcatgccattctcctgcctcagcctcccgagtagctgggactacaggcgtccgccaaccacgcccagctaattttttgtatttttagtagagacggggtttcactgtgttagccaggatagtctcgatctcctgacctcgtgatccgcccacctcggcgtcccaaagtgctgggattacaggcgtgagccactgcacccggcctcaaactgctggtatcttaatgtttattagactggctttgaggagttcttaaaaattgtattgccagtggcaaaactggagatttgaacctaaatcacattcatcatatttcaaatacataatgtgttacattcatgttttcatattaatattttagaaatgctttatcttaattgcagagttgtagattgggtagtttgataaataagattcagatttattattttttagtacttttttgtatcaagcaatgttagagtttctaatatgctattcccattttatataagctgtgttagtccgttttcacattgctgataaagacatacctgaaactgggaagaaaaagaggttcagttgggcttatagttccacatggctggggaggcctaagaatcatgccgggaggcaaaatgcccttcttacacgacggcagcaagagaaaatgagaaggatgcaaaagtggaaacccctgattaaaccatcagatctcgtgagacttattcactaccacgagaacagtatgagggaaaccgaccccgtgattaaaattatctcccactatgtccctcccacaacacgtgagaattatgggagtacaattcaagatgagatttgggtggggacacagagccaaaccttatcataagcaaaatgaaattttagttaattaaaacttgcataaaatgttatatccaataagcaaaagagttagtattcaaacataattttctaatttcaagattgcacgctttttttttttttttaaccagtgggtctaaggattgctatagggtactctcctgggccatctagttcttctcaactggggttactctgattttgactctcatatattaagactaaaagcttattgttttttaatgtcagactgctgcttttgctatgtaaagttgaagaaaaatgtatgaaagtaaggaaattcaagtatgagaaagaattagtctcgctgaaaaagctaactctcgcttggtgaacatatgcatgctgttgttatacaaatgttccaaacctgttcccttttttttgctcaccctgccatatggagggttgtgctttgctggacatgttgtgttttggacttctatgattcagaattgagagaatggagagggagtagaccagagtagaatttttcaagtaatttgaaatcgtgtcctgaataattctgcagtgtgtgagtgaagtaggaagggtgaaaaaaggatgattttaaggaggagagttgtggattccatgatgtttgagaaaaatagggaaagaacaagacattttgaattaatttttcccttgaggactggggaccatgtgggatgctcttttaatagggtttaaacaggtgagatgtacacatttttcattttgttttctcaagtttacttcttttgtaaagatctccatggttacaccatagagagcagactggaaaaaggccagactgggtacaagtggaccaattagaagactgttgcaatagccaaggtgagagatgatagtagattgagtaggattaaagtgttagaaacagatttctggtatttaaaggtagatgtgacaggatttagtaaaattaaacatgaagtaaatgctagatgtctgacttacataaaccaatagagaattgaagtaggagcattgaaataggattgaggagcctgtgtgtttgattttgaacacgttcactttaaggtaccattgaaatatctgagagaatgtcagttttatacacgaacctatagcttagaggagggttcttgaatagataaagaaaagtttgtgtgtatatatggtaatttaagcctgaatgtggatgagtttgccgaggggtcataaagaggaaaatgaactgggagacactgtctgtaacgtgaccttagaaaggagacagagaatgagtgttcgggagagttagaaacaaacctaggtaaatactggtccatcttttccaactcccattgaaatctcaatattttcccttctatggagttagggattcctcaacttaattctgtgctgagcagaactgagctaaaatttgtactagtgctggacctattagaaaagggaggagtttaaaagatgtgtagagaggcggggcatggtggctcatgcctgtaatcccagcactttaggaggccgaggcgggcaaatcacttgaagtcaagtcaggagtttgagaccagcctggccaacatggtgaagccccgtctctacaaaacatacaaaaataagccgggtgtgggggcacatgcctgtagtcccagctactcgggagtcatgagacatgagaatcgcttgaacctgggaggcagagggcgcagtgagccgagatcgcaccactgaactccagcctaggcgacagagcaagaccctgtcaaaaaaaaaaaaagtgtagagaggcattctacaaaaatggggctctttacgttttgtaacatcaatgaatcaatgattgtatcagataatcctcagaattacttggggatgggggtggtcagaatatgtgaattgtttcactataaaaacagttttttcaagaattgtgaagagtcagattttgccctccatgcaagctaaaatctttcctagatgctggtagaagacagaagacttctggaccagagacataggactttattactgatgagaataactggaggcagagtgttagcatttgtgccagtttgccaagcccactgctccacagaggaaggtgaaaggggccgagtgatggcatgtggtgatgcctctcctgtaatgcactgcactctgttacaggagagggaccaccagtttagggaacccaaactttgataataggtagtaagccttgtaagcctacctgaacttcaccctggagggagatgacttttttttttttttcccagacagagtctgactctgtcgcccaggctagagtgcagtggcttgatcttggttcactgcaacctccatctcctgggttcaagcgattctcatgcctcagcacccccgcaagtaactgagactacaggcatgtgccaccgtgcccggctaatttttgtatttctagtaaagacggaatttcaccatgttggccaggctggtctctaactcctgacctcaggtgatctgccctactcggcctcccaaagtgctgggattacaggcatgagccaccacacccaactggagatgatatctttattgtactagacagcaaacaaacctgccttttactcctgagggagacactgtttcttgatccctcaagaccattccttatataatacaaacatatgtagcaagttggtatggaacaaaatgagtcagtccctctactcacaacaggtacagaaacatgaaagactcaagtataattgccttccaacagtattcacccttcatttctataccttcttggcttctggtaagatttctttcccatgattatgcaacttcatttgtcactctgattaatcttaccgacagaggctgggaccagatccattcagtttttcttataacacatttcattacagttactgtcaacaggatagcaggatgaggccagactgcaatattgacttcaattatgctccccagggtccaagacccagccaacagaacaaatgcaataaacctttagggtctacctaagagagccaggtggctttctctttgtttctgtgctgactttactcttggcccaaggcattaatctagttactgcagaatatagagcacagatttggccttggtctacaaagaggaagcgtagggctattcttctatctgtaacaatcctggatagtgattttagaccgtcctgaatgcctctaggcccaaggtgatgtcattgattgcttcagctaaagtcgggaacaaatttcaaataaagttttctaattggatgactcccattatagtgatttttcccttggtgtgcaagtcatcacattttctgaagggaggcaatgcccgacttccaaacaagaaatactcccaaggactgtgtgtgcctataaagaatgtgttgtttatattgtcctacttctccccgctccccccattcccccccacctccccagttatgtgggacctacttttaagtcagacggcacaggctgacagtttctccaatgtggcctccctgatggctggtaagccttagggttccaagtacagtatgaatacttctctagtactggtttgtggagagatggcctgaaggcagtcagtccaatctgtcctgtttattatctgtgccaccaactcaatggcattcatctgtcccttgaaatgactgtcccttgaaaagatgcctaaagttatggacaggtgtttcacgtgggagatttgggagcttggaccatcctctgctgcttctgagagactgtgcagttaaggagaatgatgattgagtagtgatcaaagttgtgtggtggggtaggggcagacccagttgtcagttaaatttgaggttttgcacatttgcagagaaatgtcctttgtgagggatgattctaaaagacggatcactaatgtcccccctttttccttacttccccgcatctaaggtgttttccccacaggtgccagacagggttgttgtacccctttgactgccacaaaatcagtgtgtcccattccagtagctagctttaccttttttccagtcatctctgactcaaacccagaccttttgtctggaagggccaggtgcaagagtgacaaagggcccttttattaaacttacagagacccttttatgtctcctacttttgtccacatgagccactctaggggaagcagtgtacttaactaagtggtcattattatttaagaccaaagaaatccagcaagaaaatccagatcgtcaattccaggtggctgaacctgaattaagtttataccaaagacctccttttggctgggttgccacccagagagtagaccaatcaagccagcctgggatttccattagaggaaagaaagaagcatcatgtttaggaatggtcagggtggaatcccaagtggccaggagatgttctcttcctggagacagccacattcagtgaccaaactgctgtactcctgtgtagaccaggaggaggtgacagaggtatactcagaaatcttttgagttgattaaaattttttttaaaattgtggcaaaatacatatatgatcaccatcttaaccattttaagtgtgcagttcagtggtgttaagtatagttacaatgttgagcaaccaataatctctaggactctttttatcttgtagaaattaaaccctatacccattaaacaagtgtcctttgagctttcctcccccaggcaaacactatctccattttctgtctttatgaatttgactgctctagtacctcatataaatggaatcatacaatatttgtctttttgtgactggcgtatttcactcaataatgtcctcaaggttcatccatattgtagcatgtgtcagaagttccttcattgttaagtctaaatactattctattgtatgtatatatcacattttgtgcatccattgatctgttgatggattgttgggttactttcatcttttggctgttgtgaataaagctgctaggtgaccctgctttgaattcttttgagtatatacctataattggaattgctggttatgtgctaattctgtttttaattttgtgaggaatcactatactatgtttcagagtgactgcaagtgcacaagggctccagtttctccacatcctgatttttttgatagtaaccatcattatggatgtgaggttgtgtcacattgtggttttgatttgcattgccctaatgataagtggtattgagtgtcttttcatgtgcttattggccatttgcctgtcttttttttttttttttgagacagagtctcactctgtcgccaggctggagtgcagtggcataatctcagctcactgcagcctctgactccctggttcaagcgtttctcctgcctcagcctcccgagtagctgggactacaggcacacaccaccatgcccagctaatgtttgtatttttggtagagatggggtttcaccatgttggccaggatggtctccatctcctgaccttgtgatctgcccgcctcggcctcccaaagtgttgggattacaggcgtgagccactgtgcctggcctctatttgcctgtcttctttggagaaatgtctagtcaagtcttttgcccatttttgagtcgggtttttttttttgttgttgttgaggttttttgagctgatttttgataaggctgttgcagtactaagcgatataagatgctgtggatggtagactgtcacctaccttgactaacagctcattgttgagtgacttttgtgataaaaggtgtacctattgtcagattgcaaatgatgtggaaagtaaaaataggacacagattagtgtcaaggaccacggtactgtggctggagtcagctgattgaactggaatagcagtaccagaccctggaaaagtgtcatcagcagtgagaccccactgatagcctgaagaaggttgtctgatgcaaccaatctgccagtagcatgtgatgtggttcctctcaccatgagacaaatgagtccttttccaggactcataagtctaggatgaggtggcagcctctgcatcaggaacatagagtcttttactttgtatccactctatgatgatagatatgttgctgtgtctggtatgatgatggatccagcagcagtggtagcagtcttaaccgtgcagcttgatcagtggcttgattataattggtctcatcagacaatggacccttactgtaaacatctatattagtgacccagatggtttgatcagcaactacaattgatctccatggtttttggacagtcttaaatatgtcattctgtagttttccaagtggctgactaaatacctaggcagttggtaatagcctgatagtcagtaaaaatataacaaggttttcaaggggaatattggccagatctgtgagaatgtccttgagttttgcccgtggaacaaagcaaccacacccattttcagttctgtatcatgggcactggagtttacagcccactaggcaccacagcgtctcagcttagttgaatcatcagtgaaacaggcccaggcatttagggaacctctgtgaatcaagggcctcactgagctagcagatttggtttaggtggcagaatgtaagatcagactttctcaaagggagaagctgctactttttcatgtaaagctgagatgccctaggggccagactggctgcattcttgaatattaccagttccatgtgatgacagaggcttgttgggcctttcccaccttattagtcattgcatttgagttgactcattcccaaatgggaatcttttcaaaagaggcatacctagtagctacgtcagggaggcattgaatccaaacccaagagtcacctgaagaggttgttcctcttgccagagggtctagtcaggaaagtcatctgtgcacagacttgtactcaaacaggtcataaggattgtggggccccaaacctactaatgcctttctacatgggctattcgcagtgagcataatctccctggagcttatgagccctcacagttcaggcctgtaaaatatcaataccactatacactcagaagtggaagctacaaacagtagtacattgaatggtccaaagagccccacccaaaaggtcacagtagcttcccttccctactttgaaccctacccagacctcagcagttggaagctggtaacttattcttccacaggatgggtatgaaggtgccttgggctcctgtatccaacagagccataaaatgttgagtctgtgctctccccaaagttatgtagcctacccaggtgtgtgtggtctttagtctcctttgggaacttggagaacttggccccactcctaatcatctttcttcataaagcagctgaggttgagggatgagggaggctgggagagagtagctttgcaccagtgaacaagagacatttgctttcagttttgagtggtgctatagctgtgtgctgatcagtccaataaacctgcagtaattttggtgctaccaaaaccctgtattctgtgcaagatcgttattgcttgagcccaggagttcgagaccagcctgggcaacatcgtgagacctcgtctctactaaatattatatttaaaaaattagcctggcatggtgggatacacctgttatcccagctgctcaggaggctgaggtcagaggattgcttgagtgcaagaatttgaagattgcagtgagccgtgattgttccactgcactccagcctgggtgacagagcgagaccttgtcttacacacacacaaaaggtcatcattatggatggtatccatttctgtttgggaacaccttgatcgaacaactatagctttgttgctttctgatgggggaaatgggttttataccctttggctgacgggcttgatctgcacaatggcatcattttttagaagtctgccttaatgtaggctctttactgctccattgttaagataatgtcaagattatatctcttaaattcttgcttgatttcaatactagggctactggagttttctaaggctgcaggactgacagcaagaattatctagattctttgagctagtttctgattcttcagtgaattaccttgatccgcattttaaacccaatctagtacagtaggagtctgtagactggttggtgtccaagggagtttgtctcagggaaatttccctgagagtttcaaaggtttcttgtagtggacggttataccaccagaaaatgctgaggccctttccagttatcttgaaaggatttaatgttgacaaggtagactgcggtaggagctgagcactaagatagccagcaaaatgccattcttctttaacaaccattacatgcctgagcaatgtaactacatgcccctcctcttccaagcaaactagccaaagttctaaagatttgtttggctctgcctacaatggttgcaccttttcttactttcaaactcagtgtagatgtatgtctctgtaactgtcgtccaaaggaaacagaaccttatgtgcccctgtctccctcttctagacaaatcttagtctggaagatttcatgaagcagacctgctgaggctgactgtcagcttgataaggaagtcctcctatctgcaggagtgttgacaataaccaaggcatcattcaggctgttgtctttgaatctgcctacttcctggtacttatcctgaaacttcctcttcatttcagcctcattcacaggcactaaagtggaggatcattcattgcctggttgaccatacaatttggacaacatgttggttaatgattctcgtggacttttctcaatttctactaactggtctttccttccatttctagaaagttttgtccccatcagcattctttttcattgccaaaactatagaaaattatgatggtcctgagatttatccttgttaactaatgagttagcctaccacaatttcatgggttctgttggaagacatgagactcctgggtcagagacaaaggacatcattactcatggcaatagtagtagccagagtgtcggcatttgtgctagaaaacagccccagtttccatagggtactgcaaagagccaggtgatgcctgcatacacagttgtgtacattagagaaaaagtattctcaacttaggggaccacatcttttataatgggcagaaaacctttctcctggaggtctacattaactttattatattggacagtaagcaaatctgcctttgctttctaaggagatgctatattttctaaggctgtttactctataaacatccagaacaaagggagttagtgcatcttctcacaagatgtacagaaatgatagatactcatggagaggtgtctttatctacttggtttggaattgggatagcatttttgattagaagttctttctcgattaaaaagttctgatgaaataagatagaatcataatagatctgattcaagcgtaacattgagctgttcttttccatgggagtacctttttttttttttttctttttcctacttcagttcatatcctggcctcgtctcacctagactgccacaattgccccttaattggtttcactctctgcagtcttgttctttctgtcttcaatacctctgctagtgggatcttcttaaaatgcagaggtgatcatgtcactcaatttaaatttgtcatcagttccttattaagccagattttaagttgttgagcagttgtataattatttctcatgtgctggttactatccagttttaagttggcaactaaattaaaaaaatatttttaaaaagtcttgtagaccagtcctaggtaggctctaccaaacaggtgtctaggctgcttgctgacagtttatatctgctcttaccatttttctctcttaaacctttgtctgcaggatgttattctctctgcctttaatatttttcatatctacctcttgactcctgtttatcctttgtacagagtaggtacagagtaggtacctactctgtaaagccattaaatgaacccttttcaacctagttagttgtcttgttctcagcacctttatagtaattttgaatgaactgtgcatatgtcattatagcacttgcctcattgtgttgtaattacttttttggggggtgtgtggggaggttctgcatcacactgaataaataaagtgtcagctactcataccaggacaactttccctttctacacataccaaatctctctcttttttttgagacagggtctccctctgttgcccaggctggagtgcagtggcataattacagctcactgcagcctcgacctccccggttgaagcaatcctctcacttcatgtccccagtagctgggaccacaggcacatgccaccatgcctggctgttttgtactttttgtagagacagggttttgccatgttgcccaggctgatcttgaactcctgaactcaagcaatccacctgtcttggcctaaagtgctgatattacaggcatgagccaccatgcccggcccacataccaaattgttaggaaagaaaactgctttccagagaattgttttagaatcaaatccattacattagttggtgctttaaaccaccactaaatattctctgcttttagcctagtataatttaatagtattcactggaaaatagacatatggtgtacagccctgtggtctgtcctaaatatggtccagtgtatatggatagcaaacatattatgtcaaataatattttcttgttttgttcaaattaaaatatagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaaggtaagcattttatattacattaacaagctaatttgcatatccagtaaatattttggataggaaatattgtcataaagatgattttaatagattctctttagcagctggcattataattttcatacaatatttaatatgaattttactaaggttggggtgcaattttatcagttgaataggctgtattaaaaagatattaaaattagaaatggttattaagccataaatcctagacaaatattacccatttgtgttgtgaattctatgtctttctttcactactgaacatttaaaaataaaagtctacatgcttttcaaaattactttagaaaataatttataaatacttttatcgtttcatttctaaatatgtatatatatttgtatacctgtgtgtgtatctataatgccagcaacttattaaaaaatgaaaattgtatgtaattttgtcttaatgccccccaatctcccccacaaaaaaacccccaacagattttcaggagagatatgatgtgttgcctgtgttcatttctaagcatgggaaattagctgatcttgaaggatacctgtagtgtgtcagctttttggtatttatgggtcattttgcaagcatttggaatgaccaaaattctttcgctgtctctgctcaggataaactattcctttgaaatttggtagttcctttccaagaggactatttgatttggattctggtcttcagaatattttataagtttttaaggggtcagctagaatcttgaagcttgtcctagctgattgatctgactggtgctgttgctagatctgttacattctggattttctggggttcctggtcgagagaggagtatagctgacagcattgacctttattctgcccctctctgagactattggaatctcctcttcactttttatgtctggaaattgtatgtaaaattggaacacattgcaaatgcagaggtgactgcttgtttatttcttgtgtttttatccagggatgtggctaggattgtataagagctgaaattcagttttaattcaaggtgctttaaactagactgatctctgggattggagtttcgagaatctggggaaaatgtcttttgtgttactatccaccttgggatttaaagaaaaaggatatattcatgcatgcatgtatgtatacatacatacctgtatatgtgcacacacatacttgcacacgcacacactcgcactcacttctccccattttgcctcaccttgattattcttcctaccaaagcaatacatatttattaaaaattttttctgtcattgtcttagtagtgaatatcctccattaccttatccctcaacgagtaattgtgtttaacatttcaaaacatagtacttagctgagtataagatgaatccaaattttacaaggaagttttgggtgagaaaatttaactatttcatcgtatatgtgtaagtgggaggtgtaaacagcataatatatgctgaaagtatatgaatgtgaattttggaaatctgctttctagccataatatggatacattagacacagggttggggggcttggttttttttttagatttttttattgtggtgagatacacataacataaaatgactaactctttttaggtgtatagttctgtgacattaagtacattcacattgttgtgcaggctattttaaaatatatttttggcgagggatgaaggtgcatggtctgtgagaagaatatattttagaagctgattatttggcatatttgtctatagtttgtttctgtgactgaaaaatacacacatacatacaattacttttccccagtagtcttaatgctgctttattttcttagttttgtgttctctctaaaggatcattgttggcttaaatatttccagagcattgtagagatgtgtaaaggtagaaattttggtagtagttaatgaacacatgccaggccaaaattattagaaggaaaagtttaagtttattttaaaattagtgttttgaggatagtgagacattgcttacagctttcgaattatttttgtatcttttgcccacttttctatttagaagtttcttttcttactgacttgtaagaatcctttgttttctgtttgaagagagtagaccctcatatattggcaaatatttactcatattgctgtttggcttttgactttgatgttttctggtatttaagaaataaacatacagaattttaaaaattatatctaaatatattaatatttttcttatcgctactaggcttcatgcttacgattgccatactccaagattaatattccattgcattttcttattttgtgatgtaaattttagtgttttggtatttgtatttaaatatatctgggttttatttaaatagtatttactgtgttaatgcattttatgctatgaaataaacggtacatgttagtttaataggaatttaaaaatatgcaaaatatcccaaagtaaatctggttcgatttttgggaataataataagatatgtataagagaatcccagcatagagaaactaccagaacctattcataaaggagaatgaaaagaagatgatctttgtaagtgagcacaaggtttgagaggaagctagaatagagaaggcttgaatacttagcaaagaaatttacatttattttgatgaacactagtaataattaacagcctggatcataatttacaaaggacttttcatatgtagttggccctttgtatctctaagtttgcatctgtggatttagccaaccttggataaaaaaattccagaaagaaaaagtaaaaaatacgaggacaatacaagagtaaaaaataatacaaataaatacaatataactactatttacataccatttaccttgtattaggtattataagtaattgagagatgatgtaaagtatactggagggtagtgttagttatatgcgtatactacaccagtttatatgagggatttgagcatccttggattttggtatccatgggggtcctggaaccaagcctccttgatataccaagggatgactggattactgtgtgtttgtgtgcttgtttttaagcttcaaaagattatgtgatctaggagttgttagattttattattggtcttaaaagataagcttagatgtgttactttttttggagttttagtttacagtgattcatgaatcgggcagcttcagaccacaggagacatgaagcaggtagaagttcaagaaagcaagacaagcaaaatatttgattggttagaagttaattgtggtttctgattagtaaagttcctagttagaggttagttggaggtttctgattaagtttcttttaattgtgttttggtttgcctaagtaggaacccagaatgctggagccgtctcagcctaatggtctcagcctaatggctttctgattaatttttttaaaacagtgtagaaactaaagctttataatgtttacataggaagatttttttttaatttttattttataaagcagaggagtgagttaagaatcatttcaaagaaagaattggccttggctgggtgcagtggctcatgcctgtaatcttggcactttggtaggctcaggtgggaggatcacttgaggccaggagttcgagaccagcctggccaacatggtgaaaccccgtctcctaaaaatacaaaatttagccaagcatggtggcacacagttttaatcccagctacttgggaggctgaggcaggagactcgcttgaacccgggaggcagaggttgcagtgagccaagattgagccactgcactccatcctgggcaacagagccagcaaaaaaaaaaaaagaattagcattagacatttagtgcctatgacatacaaaactatgatgtacttagaagatagggaggaatcaaagggaatttcaaacagattccaggcaaatggtaaaattactcatccataaaggtaaatgttaaggaaacaaagtgagatttttttaaaaagagacagggtctcactgaagtgcaatagctcaatcacagctcacaactttctaggctcaagtgatcctccctcctcagccatccaagtagctgggactacaggtgtgcgccactatgcctggctaattttttatttttttttttcaagagaaggggtttcgccttgttgcccaggctggtctcaaactcttgggctcaagcagtccacctgccttggcctcccaaagtgttgggagttacaggtgtgagccaccgtgcctagcctgaaatgagatcttaaggaaataaaaaagtttcattttggatatattttggggatatttaaataaaaaattttatagatttctaacaaaaatattagtattttgaggtgtaagatgtagaggttatttcctactaacacttgccaacattgacacatctgcatgtctaataacacttaatagaggaggccgaacttcataagaggttaaagcttataccattgcatagtagcacagagttcaagtagaattttcattcccaatctaattcttcttttattctttccatttgggaccagcttatacttgaatgctaatttttttgtttcttatccacttgaaatgacaaatgaaggaagatatgtggacatatttagaatattttcttggttattttaggatagtatttagtattatgtatatacattataagatatacattgctatgtaagtatatactatacatgtatagtatatatcataatacagatactgaagtatacattagtgtattttatcttcaaggatcctaataatgttatactcaaaatttattctctagatgtgaaatgtcatggttaggtagggtaccagatgttgtttccagatagaagtaagcagtatcattttaaacaaatattgaagtgtaccaaatttctcgcacagtttctataaatgagaatgtatccaaaagacaccaaatctctcctttggatgatttcctttgatactgccttgtggccacctgaaaaatggtagttacttgttgagaatgtcagatgttatttaaaaaaaaaaaaagcttgaagcccccaaatctgtaaaaaattagactctaaaacctgaagatatttttttttagtggcattgtacaagtagtgatgctttaggactacacattgtttcatgttgtgtaggctagtcagctttaatagaagtagcctttaggatcaaaacaacttttcttcaactttgaattttgacttaactggctcagatgaaaacttagaactaaagctacttagaacttcctattagtgttggcctgcacaggattggggttcagaagctaggaatgagagagttttccagaccctgtttgtttatttcttagttagaatctggctaagttatcactgtgcatgatgaatttgtttttaaacatcgagatactaggtccttttttcatttttggaagcaatctgtggttttgaattttaatgtttgcagtttatcactttttaaactatactaccattgaagtaatgaatactcatacttggacattcattatccagtaaagtgttaggtctcatgcaccgatatgttaaaatagcttcacatctaatgtgttatggtgtttgtatttaaatgagcgtatttttaaaatcatctgttactcggttggattagttccataggacaaaatactgacttaaaaaatcattgagcctgcatgagattggaataattaagtggtggtttccttatgaatataattcttttgaaaaatacatgaaacacatgagtatttccccagtacgtatggatctctttttctttacaaagtagttgaaacatggctggaaaaaagcttattaacatgaattgagtaactgtaaatgtaaacctgtcctatcggatataacttacctagcattaatgtctactttttccccccctttttttgccaacgtaaagtggctaaaagccaaggtaagagccattacttatcatttgatccacagtatttcctctgtattgatagaggctgcagagccactaaaatttgaaaactcttcttatgtctgtctgcttttccctgtaggatttatgtagattatttaatactcaagttcagttcaaataagcaacatttagcttggctgtgttaatatatcaatgatatattgacatctgtgtttatataggaacattaattttgctaacatttattgctttgctcatttttcgatagttgccttgctttcattgacttacaattaggaggtttcccagacatcatatgtgactttgttactgaattgttaggatgaagatgatttttcagatgcgtatttgagcaaattgacaagtaagatctatagtttgtgttcatgcacacatttcaaaaattttaggaaacccagtgtttgaatgcagataagtttgatctcagtgaacatgtttaacaataaaataagatattaaatccagtcatctcacctgtatttggctacaatgtgatataaatggcataaaataataggaagaccaagtgcaagtggttccttgactttttaaactgtagtaccaaagtctttattcaaactgtctgggaatccttaattcacattctgatatttaaaaaaaataatacatggtgttaaaacaccaggagaacaatttgatataaaaataaaagcatttctttctacattttagcatggaaataaccagcctgcaagaactggcacactgtcgagaacaaatcctcctactcagaaaccgccaagtcctcccatgtcaggccggggaacactggggtaagaattcaactacattttgcaaaagaattcatatgctaaaggaaaagatgtttctgtgacttaagtaagtgtatgggatccatgccacactaccctctctatgtgacgctaccttttacaaattcattttaattcctattttcctgaacagaatcccaaatgaatctgccagctttgtaatattctctataatctgtactaggaaagtttttatgtatgtataaatggcatgatttatttttttgtcatctaatttttaaaaaatataaatctgacttgtttgttttaaatggaatgattagagtattccaaatggtgcctttgcatgtgtttacagtatctatattgtagaactttgactagtggtctacttttgtgtagtatggcttagtccacagctcttctgtttcgcctattggtgtctgagacttagggactctttactttaggaaagtatgcactttacttgtaactatgcttctgctggtaatcttaggcctcttcacactagagtagctccatgggaaggccagttgggcaagtagaaaagataacagtggcttcttccttcctagttctcagtgtactaaatatagcgaatacttgtcaaagcattatatttctttaaggttgtttttcttaatactggaaatattatattggatttcttattttttggcagaggggttgttcaacaatcagtcttcttttaagaaggtcttagttttcatttttattcattaaaccctctgcccctgaaaaaaaaaatgaagttattaaacagaatagtcgaaatcatttattgagaaagtaatgattagaatgtatatctccatttattgccatattgagatgggaataaattgcagcttcctatgtaaataaatttagcttcctgtttaaagaacagtggcttatgggtgactgtactgagaaaaatgtacattttaaagtttgctattattgagcatttaaaaaattataaccataatttttagaaataaggttaggactttaaattaccctttcctatgtttttcctaggaaaaggtaacaaattttagttttcatgttaaagtaacaaaattcatatatcccagtgaagaatattttttaaaattacaaactttgtcatatatatttttaaatcctggtatacatggtcacaaagggagactcacatatttttgggaaaaatacaattttatcttttttattcattattcctttctccactatgctcctttagacggaatactccttataaaaccctggaacctgttaaacccccaacagttcctaatgactatatgaccagtcctgctaggcttggaagtcagcatagtccaggcaggacagcatctttaaatcagagaccaaggacacacaggtaagcctttaggttgagtatctcaacatctctaaagtgggtgtaactgactggcgacaaactcctatggaggtgctgagtaaaggtgaggtgccactctaatgctaatataaaatgtaaaagttgggggaataatattatatatgttcctgtaagtttgtgttataacttctgttttgttttgtttttttaactttttaaaacatctatttgtactattaatggattgtttgtatttcctccttttgatagaggtacagactctatcagactctacgggttaagactaaagaatttttttctttttttttttgtgacggagttttgctctcgttgcccaggctggagtgtagtggtgcgatctcggctcactgcaacctctgcctcccaggttcaagcgattttcctgcctcagcctcccaagtagctgggattacaggcctgagccaccacgcctggctaattttgagttgagacggggtttctgcatgttggtcaggctggtttccaactcccaacctcaggtgatcctcctgcctcggcctcccaaagtgctgggattacaggtgtgagccactgtgcccagccctaagaatgttttaaaatgctcttttaaaaaaattcaaggcaaaccactcaaatacttttggagaaaagattaaatatcataggaattatacaacgtgatttaaactttcagagattgaaggaaagaagattaagcttaaatctgagggagatttttttaagagaatcagtatactagaatatgttgttataataataatattattattatctttttggagatggagtctagctctgtcacccaggctggagtgcagtgacgcgatctcggctcactgcaacttctaccacccaggcttaagcaattctcctgcctcagcttccagagtagctgggattacaggtgcatgccaccacgcctggctaatttttgtattttagtagagatgaggtttcaccatgttgcccaggctggtctctaactcctgacctcaggtgatccacccacctcggcctcccaaagtgttgggattacaggcatgatccaccgctcctggccttgtatttattatttttaaatgtcctaaaagtcaattacctggtgggtttttaaaaatttagttacagagcataacaagcattcagaaaagtatccacttcagtaagtatacagcttgatgaatggacacacactcatataaccatcacccagatcagaaaatggaacattaccagcaacccagaagcccctcatgctccttcctggttatcgcctcgaccttcttcccccaaaatatagccacttcaatttttgagtgctttataaaaccagataaatttattatataaccaaatttgttttattcttcagttttctctctcacttaataacgtgggcagggaacctctcttttgccttcactcttaggttggtaaatgagagataacttatcaaaatgatttatgggaattccactaaatagggtatatcaagatgcgagatgctaggtaagcggtatttattactattggtgctgttagtaaacaaattgttaagttgatatctgcagttactgtatcaggtcaagttctttgaggaacaaaattgttctctttgttgttattgaactcttggatcaaagtatagtttttctctatagtggaagcatagtttaatcatattcaacaagcagttattaagtgttgtttcattagatactaggcatttgtcaatagggcatagttcttttttcaagagctcattctgttagaacagggatcagcaaactttttctataaagggccagattgtcaatattttaggattcgtgggccatatatatggtttctgatgcaattactcagatctgtcattgtagcacaaaagcagccattgacaatacgtaaatgaatgtggctgtgttccagtaaaactttatttatagcactgacattctaatttcatataattttaatgtgttacaaaatattattcctcttgatttttttaactattaaaaaatataaaaaacattcttaactcacaggtagtaaaaatcaggcaatggaccagttttagcccacaggccataatttgccaaccccttgttggaaaaaagacagtaattgaagaggagcataataagagcataaatattcatatgtctatgatgcagtggtagcacaaagctaagtattgatcacctggcttgagggagttagggaggtcttcacatctaagctatgtctgttttataaatgacttttttctttttcttccattaacatatgataatctaattatagaatgatcatattgcagaagaaaataaaaatcttatccaggcattgcaaatctttgccctttgaatttctgggcttattgagcaaattatgtagattttaaaacataatatggagcctaaggctgcatgtgcacaaatatatgtttttacacatgtacacacattactataaacaactggatggcacaagatcttataccttactagaaacaactagagggagccaggtcctagagctaacaggacagtacatccacaggaagtagaatagcgaggagttggttagagtttatcagtagcaactattccagaatgtccacactgaaacttcactattgtctttctttgtcgttatgcttattttccagaaaatttccctatgttatcacctttctttgagatgagaggaagtttcatattaattttagactagaacggagtacccttttaatttacttccacatcatttgtactttctcttttgttgtatctattacattaccttttcatgtcagttttcccattatgaacttcagatggtgtagttcatgactgcattgttcactgctcttcatagcaggttttgaataaacaattgttgactcgtactataagattttgttggtgataaatatttcaacagagatggttttaagtactgtgttatcattatattggttccagataggttgagaagtagaggaaaccatttcaaatattaggattaagatttgtgatgaataacttaaaaatttcttgttacacacacacccccacccacctgcacccaccaaccctcccattgcctaccactttccctcccactctccctcccactctccctccctccctccctctctcctttcccttcctccctccctccttcccttcccctcttcctcaggttctgcatccccagagtaaggcagtctcgggttgaaaatacagtattcatgggatgcagaacctgtagataaggaaaaccaatgtttcatgtccactggttctgtagggccaactgcaggacttgaacatccatgggttttggtatccaagggggctcttgaaaccagtcctccaaggatactgagggatgactatatgacataaaaggagtatttagtggccttgggtgattacagtttttttttaaatatgtctctagaattggtttttcacagtttttttttttcttttcagtggaagtagtggaggaagtggaagtcgagaaaacagtggtagcagtagtattggcattcccattgctgtgcctacaccttcgccacccactattggaccaggtgtgttatttattaatctatgtttaatacatgataatatttatgagctttattgtggaaggctgaaataaattagtcatattgagtaaaattattaattaaatttgtgatcgttgctagaataaaggctgataacaaagttaacaatatttttagattgcttttcacaaagtctttaggatttcaccagctgtttctccttatatatactgcatattaagtagttttgttaaataactttttgttggccattttgctttagaaatatattcattcctcagtgtccatgggggattggttccaaggtcccctgcggataccaaaatgcatggatgctcaagtcctttctataaactggtgtagtatttgcatataacctacacacatcctctcatattctttaaatcatctctagattacttgtaatacctaataaaatattaagtgctacttaaatagttatactgtattgtttagggaatagtgacaagaaaaataagtctgcacatgttcaggacagatgtagccatctatttttttccctgaaatatttttgatctatggttgattgaatccagggatgaggaacccatggatatggagggctgactgtatttgcctcgcatactagtcaagaatgacatttattatttcaagagcaaaccagtattgtacgatactccagctggagaatcagtgtctataaaggtgaattatgtttctaagagttttaatgttgctttacaggccagtatctactctggtgtttgcttattttgtgactttactacatttatctatgatattcaatatatatttcagtaaaatgcaataaatgtaaaataaaattaagataggaaagttacttttagaaagcatgaaaatttaagaaatccttggagagcattgaattagccccttgatttttagtaaatgaaatggagactttttatattgttaaaaatgtatatttttaaagtatgataatgaaaaatgttaggaaagaaattcttagcttttcaagcatatttttgaaaaaggagaaaaagccacttataaacataggcatatttgatagttaaggcaggtataaactcggtagcctctttatgtacaaaattcatactcatttgagcatgctttacatgggggtatcttttttctttttcttcccgatacattgtactttcttgctgtttcaaaatgttgagttttcttttcttgtactctgacctgaattataaactattttattagaaaacatttctgtccctcctccttctggagctccaccagcaccacctctggcaccacttctcccagtgagcactgtgataggtgagattgcatagccattggagccattgaactcactttacataattcataataaactcctctgtgctagtagagtgctggcttttatagttattaggttgcaggtgataatacaaagtttaaagtattaaatctaatatcactaacttctggtgaaaggcttctgcacttatacagtaaacaaatataaaacaactttttctataatatgaaatgcttggtttataaccaacttaatgtgtttttaatttgttgtttgtttagatttttctagtctaatcccccctgccccgcacaagtgaaacttaatttggaactctctggtatatacaacagtcaaaggatcagggtgaaggtggggacaggaggagaaaaattgaaaggcaaacgatatgtgtgggatggggtactctgaggctttcctgtggatcatagtttgaaaaactctgatatggcccagtttttatgacatctcaggatgccatgaaatagttttctcgataaaatgcatttaaattgttcacaagttggggatgactgaactgagcatataaggaattttaaatatattttaaatgtcaatgtaaaaaccattgagtctagaaatacacaatcacagtaatctgggtagaaatggataatgaggtgtttcaaataatgagagctgagtttcaggttaagtgaaataaagctgtctaacaacatcttttccaaacatttgcacataccaaggaaaagggagaaaggaggtagtaaaatgaagaccctaagaatagaaattgttggtagaaaatctgtgagaaaaaaatagcctcaacccaattaataaccagaagaattaaaattaaaaccacagtgagatactattttatatccagcagacaggtaaaaaggtagaagttagctagtaccagtgttggtgaggatgtgtgttggtgaggaaagcaaattgctggtgggagtttattaatgtatacactcacttcagaaagtaatttattgatacctagtcaagttgaacatgtacctaccctagatttatcaatttcatttctacatatttaccctagagcactagttctcaaaatatggttaagggacccctgaggattaccaagatcctttcatgaagtttttgaggtcagagctctattcattatttgtccttttcattctcattctgttataactatacggtagaattttctagaagctgcatgaagtatgataaagtcattgctttgactcctaatgaaatgtgtacttgtgtattcatatgttttaaagatatatcagtttcagtatctaatatggtaattatctacagctataacccatgtcaacaaaaggcttttggggttgtctaagagtggaccctaagaccaaaaagtgtgaaaactgctgtcctagaacagtggttttcagagtgtcatccccagacaatcagtatctgagaattagttagaaatacagattctcaggtcccttctagacctgcttcaatcgggaaactcttgaggatgggagtttctgctgttataatacagcagtctatattataacaagctgtaaggctgggcacagtggctcacgcctctaatcctagcactttgggaggctgaggcaggcggattgcttgatccaggagttcaagaccagcctgggcaacatagcaagacctcatctctgcaaaaaatacaaaaaatttagccgggcatggtgatgcatgcctgtagccccagctacttgggaggctgaggtgggaggatggcttgagcctgggaggtggaggttgcagagagctgagattgtgccactgcgctctagcctgggtgacagagtgagaccccatcttaaacaaaacacaaggcttcaagaagaaatactgatcaatgatgaagtttgagaaccactgtcctagagattcaggaattatatttaggaatgttcgtagcagtagtattgatagcacaaatctcaaaccaaaatgtctaatagtagtagaatggataaataaattatgatatatttacatacaaataaaatagcaaaaatgaatgacattgatatgcatagccacatggatgaatttttgaaaatattatcaaggaaaaagagcaattcaacaatatgtacagattgattccattacaaaagtttataaatttgtaaaaactgtgtgtattgtttaaggttatatatgtgtatgtgtgtgtgtatatatatatatatatatatatatatatatatatatatatatgacaaaaactatttacagaagaaagagaatgtttaacatacaccttgtgggggttggaatccaggagaggagcacacaggaagcctcagtgatcttgttaatattcgatttcttgagctgtatattatttaaatttttttatacacacatgtatgtgtataattcacatgtataacatataattatgcatataagtcacacactctttggcattatttattttatgataaaatgttaaattctaaaataggctcagaattgctaaatgattggcttttgttcttgaatcaccaataaaaataactcgatttctgtacacttttttatacaagccggagaaatgtaaaatccttttacagagatttctattaaaaatggttggctgggagtggtgactcacacctgtaatccagcattttgggaggccaaggtgggaggattgcttgagcccaggacaagaccaccctgggcaacatagtgagactctgtctctacaaaacataaaaaattagatgggtttggtggcactctcctatatccccagctactcaggaggctctggtaggaggattgcttgagtccaggaggttgaggcttcagtgagctgtgatcccaccactgcactccagcctgggcgacagtcagactctttacccaaaataaaaaaataaattaaaaaaaaaacagttaaaggcttactcttttttttttttttttttttttttttttgagatggagtctttctccgtcactcaggctggaatgcagtggtgctgtcttggctcacgcaacctccatctcccgggttcaagtgattctcctgtctcaacctcccgagtagctgggattacaggcatatgcctccatgcccagctaattgttgtatttttagtagacacgggttttcgccatgatggccaggctggtctcaaactcctgacctcaggtgatccgcctgcctcggcctcccaaagtgctgggattacaggcatgagccactgcacctggcccttaaaggcttatttcttggctctctggaaaaacctagctgtccaaaattacttattcacgaaggcttttgaatagacaattatttttaaactgtttctatttagaaaatgagcatgtggatgattcaaataattggtgactgcctatgacttgggagttccaaaatgttagatcagcacttctcttaatgaacaacctctgctgtatggttttatctgataccttgtgtgacctctaagaaggattagacaactgaatgaagataaactaggacgctggctttttacttactctgtcattgtttgttgtttagatggggcaaggaaaataataataatcccaaagttaactttggaaagtatagttaactttagaggctttgaactctattaacattttaaatatgaaacttttgaaatgttgggaaagatgacacttaatacaatgttaagtattaatattttcatcagtttcgatattaactgatgaaaatatatgagcatgctaattttttttttttttttaaaagcagattctttggatgtactatgaaaaagaagccctccaggcatggagaaagagaatagatttgctaaacaaaactaccttaaaatgccatattttatagagtcaaaaaattttctgcttctgtcagttataaaaatttaatagggaaaatgtatgttaatcttaaaactttggagatctacaacaaatctgacattacatgaaagtgctttgaaacgagaaatggcacatttcttaaaaatgattttacttaatatgtattgatactaataactgctaattcaataaaaactcaaaaatattagtaaataaaaatttattgtttaacttggatttggctagatagagacttatcattataagactctatctagccaaatcaaaattctgaaagttttgtcagtggaaaggaagaaatttgtaactcagacatgaatctacttatatctaaagactgatgcttcctacctcacaccatcttttggtacttattttattggaaagacaatttacatataaaagctatgtatttgaaaatgcacaaaaaatttatatatcatattagcaaagtaccatttgggattatggtttttaaaagcttgagaatattacttatttacttttgcagctttccatgcagctgtttttttttctctctgtttttgactttggagataaagttactgatttttatctttacttttctctttattttgtgccttggtcttgaaaaagtaataaatatttcttactgaggccccctcctgctttgttctgccatctaaggtgattacaatgctcaagtctctttgttggttgcctttgactaatgcttttcagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaagtaagcttgtgctttgcaggcatacagcaacagtggagctccttttgaaggaaattatttgaaactgttattcttgccagtgatagacaacaattgaaaaccatgatgtttcatgtttatttttgttttaggatattagtccttgaatcataccattttaagagtaattgtttaccactttctcttccaaaatttagacttaccaagtatacttaactaaatttatcgagacgtgtctatattgagtataccaaaatttaactttaatatgcgattttattacataagtagaactagagaacaaaaacattgcagaaataaactgaatttattggcatgtttgagacagcgtagtaatggtaaaattaaagacacaaacattgtcaaagttttccttcaaattaatataatgaaattgctggctatcacttttaaggtcattaacgtgttcagaaatgagttcaaaaccgattaaaactgtttgtgatgcctgcttaattactctgtctttgaataattctaatggtgggaatttcttttgatttctttctgtttacctcaaattgcacatctcaacactaattgcagtcagtgtttaaaagctggtaagaaaagaaaatagttttagcatataatgttaggaagttagaatagtgtagggtagtcattaatatcactttccatattaagatgttcaatgcaaaaaggaaaaaaaacaaaattagaaatgaacctgttgtccactgtttgcttttagcttaaaaagttgtgcccactgggcatagaatgagacaagctttcctacatggcttttgtggctctttctagagccacatgttatttttgtttatataaaaacacttaatactcagtgaattctccatatttacataggaggttgctttaagttctttttatttataatgaatgacctgtatatgtattttaaagcagagctaggggaaagttttttttttttttttttttttttttgagacagagtttcactcttgtcgcccaggctggagtgcagtggcgcgatctcggtccactgcaacctcaccctcccaggatcaagcgattctcctgcctcagccacctgagtagctgggattacaggcgcctgccactacacctagccaatttttgtatttttagaagggacagcatttcaccatgttggccaggctggtctcgaactcctgatctcaggtgatccacccacctcagcctcccaaagtggtgggattacaggcgtgagccactgaaagttctcattagttttttgtttaaattttaaacataaattatgttatagcaaaaattcctaagaattgaaaaccactttatcagaaatatcaaaattcacaaataatcccaaaatttatatagctttttttccagactaaaatattaaagctactgagaagtgttaaacttcactaaataggattttacctaacatttggtatcaaaaggtagccagtgtctgtctaaatattccagattatctaataattcacttcacttgtttcatcaactttatttttttcatattctgaatttttagatcccatctttttgtgtattatttttcttttccccacttagacatttaatttactctgcaaataggatttttgtgacttttttatataatacatagttttatagttttattttagcaatgcttgtgtggattattttcaaaccgtatactttaattaatgaccacattcttttgaatattggaaagcaaatttggcctcagattttaaataaattattatgttttgtcaaattaattatccttcaatctgagttactgttggtgttgtagtagtagtagtagtagtacgtgaatgtttttagtgttttgatgtgcacattttcccttctgtctaaatgtagtaatgattagtatcttcacagcatagcttttctttttcattacatactaaccagcatggctagttactaagagttgtttctaaacacttttttaggtttgtgagagttttttgttttttaagtcaaaacctctaaccttttatttaggagccttctatagagtattagaatgaaataggattgctttcatagtgaattgaatgttatctttagctatacaatgaatattaatgcacataattgctttgttacttctttgaacactgaacttctttcaaatttttatgcttaccaacagaatttgcatgttggattaattgaaacaaccttttgattaatccttggtaaccaataaattgtttttctctatcaatttagtgttactacttggtgactaccgatagactaaattttgctatctagtcctactgactttttctaagcaatctttggcaattactgtcttgttaaagtgagacaaagtcacaaacatatgaatgtttacttctagtgtatgttataatttttaatacatgagtatttggtattaatttcctgtcaattatgtcatctccacaaatgcatatgaatgtgtttcaagctatccaatgagttgttaaaaattactttaatgcaaagaactacgtattttaacttattggagatcaggtttcctttttcagaacagtgatgaaaaggtcacttttgagatatcccatgaaactctgactgattaacatgatatattcccttgtaaatttaggactgatatttttaaacataaaattgccaacttaaaaaaataacaaccttgttttacaaacaagagtttttcctggagagctgtgtgtgaatttagatatataataagaactgtctttaaaggaaacctgtgattaatatttttattgatatatgaaataaatagctattatatatttgttttatttatttgggtcctaatttacaacattaccttaaagctagacaaacctgttatagctatggcaaagacacaatattctggaaacctatgtaggtatttcattgttacctattttagaagtctttccttagaatttgaaaattttattttactaaagtgaatgtgatggtaaatttaaatcctccccaaacaatgtaacattaggattgaattaagtatatttgttcttttataaaattaattaattggctaagcacaacttggcctttaggtttgcttgtgggaaatgtactccaaggttctgcaggtttttgttttgttttttgttttgttttgtttcatttgcaaactgttctttgcatacttatgtttgtggtccttgtaactgacttctgctttttgtttgtttccttttctttcctttatctgttttacttcccccatactgtgttgttgctaccagtttctattgctccaccccctccccctatgcctcagttgactccacagatacctctcacaggcttcgtggccagggtgcaggaaaacagtaagtttggaaaaactgagctatggaagagtagaggctgtctccttatagcatgcatggctgacgatgagtcatcgttttccttacttttattgagaagctaatcttgaaaataggtgcagacatgttactgaaactgaagagcacggtcttcagttttttctctttgtgtgcatggttactgacccatataaatttcaaagctgcaattttcttatgtctttacatgatcctaaaacaggagatctgatctttacatattcttaaggaaagaataatcaaacacaaaaattcaaattatatggaaacttttagcttctaacagttactagaattagaagacatttttaattctaataaatttatcaagagataggtagatatactgtaagattaaatttaatatgaaattggggcagattttccccccttaatttcaaaattttagggaaagctttgtagcctcagatttttgtacatacatgatattgaacctacgtaaaggttcattgttaggataagattgaatgaccaggaataagtaaattacattcatgctatccatttcagtgtgagtgataagcaatttagcatccttttcacattttggctacatccaggcccacgaagattgttcctgaatatgaaaatcagttaacttttttagatcttctctcgaatgaagttcagggatttttttttgtggggggggagaagttattttggatatatggctttaatcaggatagactagtttatattactgcctgattacttttgaaattccagaagatgtgtaatcctaactgcatgatcacagtgaatcttatataaagtgaaaaataccactattactgaattataatatgctagaaaagctgttgatggtaatgtggtctatttttaatttacttcatttggaccatcaccatgaaaataaatctcaggatggtttgaacaaatgaataacccacttgcccagcctatcctccaagaaaatatattgtggcaaattccattcttcagcttttgctgaccctgttgtgttattctccccattccctccctcctgccagtcaaatatttgtgtacccgatgttacgtgccagactccgggaagaataccagcagtttaagacaaaagccccttccttcaggaaatgtgtgatccaattggcttgttataaaatgttgttttgtaatgttgaaatttctgagtgtaagccatccttactgttaatatgtgtttgaaaaccctaatgtgtgcaaacatttaaaaagatatgaataatcagcctgggcaacatggcaagactgtctgtacaaaaaaataaaaaattagccaggtgtagtggcatgtgcctgtagttccagctaccaggtaggctgaggctggggcatcatttgagtccaggacgtcaaggctgcagtgagccatgatcacactactgcactccagcctagacgtgcaaaaataaatagagtgcaaaaataaataaatgcatggatggatggatagatagatgtgaatcttatttttaaaaataaatgagtaagggtaaactgctggtcattaatgctgcagagtttaaaaacaaggccagtgtaaacttttgaactgccatatcagtaagaattattaggaaataatttaaaatagccataatgaacatcagttttgtgggtccaaagtgactgactagctatttggtaaatcttttctttatatagaaatccagtattagtgtacattattctaggcatgtgtggtctttgctaaagaggctcttggtactatattagttctttttaccaaacatatgaacttgggtcagtcagtgattctccttgtgccacagattccctaactttatttggtttctgttttctttgaaagtgtgttaggaggattggtgttaaaatatgtatcagtactttaaacgttttatgaagtacaaattttatgtgttctcttaaatacccagtttcttatgacactcaaagtgggtgataatgaatgcatgtagcagcctattaataagtatttcagtttaagatatgagcctctaaaaaagtcagcagtgtgtttacatctctttatgattatgcagagaattagattaaccaagacttccttcgccataatttgaagataagacatgtagatttacagcagttggacataaagacaatttcgtgaaaacattaaactaatgtgataaatcaagagtaaatgcaaggtaccaacatacataatttacacattaagccaaattaaggatatgaactatggctgtttgatgtcaggaggggtctgtacccattttcctctcctcaataatattaaaaagttttatagaggaagttatgggcaaagataaaatggatctaggaatgaggcagaaaaattaattgtagacccgtttgataggtgttatagtgagcattaccatatagggtttgttttctaatagccctttcatccctcgagaggataaaatagaaatcacagcattgaagtggttatggaaatagggtcattatctgcaaatattttaaacctggagcccttggttgtatattcagcacattattccaaggagggtagactaaacgtttaaacctatatgacagatagattatggctgatttctttgatcacgtaaatagccccagaaattggcatttgatttagtatgtttgtattatgaacttctcccctgcaggaattatgtaattcctgtatcaatttgtatgaaaacattttcatatgtcttttgaacttttaaagaaatttattgatcagaaatttaagttaagcattaattgggttccagctttgaattctttaaattttaggagcatttttacctgatattatactagttcattgaacagagctctagcctgacattttcccatttccctgtttacacctttgactgtgtaaagcacacacatatatactgaccacgaccatctagagtttgaggtatgagtcatttttattgttttgtttactgtaagttcctttttgtttgttttttttaattacatcttcaacactttatgtttaaatcttaattgttgatgtattcttagaaaatcgaatctttaggatctaggctttccctcatcccgtgcttatgttttactagcaataatgcaaaattttagcttgctttctacattaaaaaactaattatgaatataaacctttttaaaaatactcaattagattttctactggttggggattctttttccattttttcaacttgtaaaatgtaaataacagagtagaaaatctgcacacagaagcagacctaatactaccaactttacttttctcttcatcaaaacaaacaataatcaacaaagaaacaaaaatctgtccacaggagactgaatttttagggaaccaaagctgtttcaagccaaaatcaggggcatgaatgagcagagtgaagagtgatcaaaccattaacgtaatgttactcatatcattactgcagtccaaatgacaaaagtgacatagatttattttagattgttaacatttgtcccgatctgaaccttggaataaggaaactactcctataatccttataaaaagagacattgtctcctaacaccctgcattcattaatttgtagtacttccagatacccttatttttagctcattttgttatttttaaatgattcttgagtagcataaactttaacacaccaagcttttatttctaatcattgcatgttttattatagtgcatgctgtacttaagttagagctttcttaaattctgttaacttataagtttccatctagacttatttttgattcaaatcaatcatatgaatctttttagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaaggtaaggtacagtcattgagttgatgtgaaggaaaataacctaattgtagaaatttagaactataaagaacatctaatccaatgtttctcagccttttaaactgccttaccaaccaagatgatttacttaaaccttacttcctaagttttgtattattcccagtgtacagggggattctttctttgtattttaaataaaagttgcagtgttagatttgctttcaaactacatatgcgttcagctgaagattaacttgctggacggcattttatagatgaaacagctaaggcacaaaaatggagttatatgtaattagtaaagattttaaaagttctgtcaagctctattgattacctttcatatctaaatatggacggtccctgatttatgatggttcactttaggatcttttcaactttatgatggtacaaaaatgatatgcattcagtatgcttctcaacttatgatggagctttgtctggataaacctgttataagtaaaaaaaatacaagttgaaaatgtactttcaatttacaatattttccactaaacagtgggtttattgggacataaccccattgtatgtaagtggaggagcatcggtctttaaaaatatattagtactatcatgagaaaagcctcaattaaggtttcaattaggtgattttataaaacacaagagaaattatcaggattgtatttcatgaaattatgaactactctaaagtctaatttacctatagtacccgatattcactataattatctattaagaaatataggtggggaagaaacaaatcctgtttctagtttttattttttcatccagttctgtgctattttaaaatctgtatttctttttgcagaagtgggaatcaattaaaaataaaatctgtatttctatagagttctgaaaaatgcttgtgatttagttgaacacttttggttgcctttgaaatatatttccttctattgactttactgggttaacggactttaagctagtagatgtagctcttgagaccagcagcattctttcctgcccaagttttggatatgtggcaaaagtaaatttgttttccttttatatttttttattttttgagatggagtcttgctctgtctcccaggctggagtgcagtggtgcaatctcggctcactgcaacttccgcctcccaggttccagcaattctcctgcctcagcctcttaagtagctgggattacaggtgcccgccaccacgcccagctaacttttgtatttttagtagagatggggttttgccatgttggccaggctggtcttgaactcctgacctcaagtgatccgcccatctcagcctccctgtgctgggattaccggcatgagccgagcgtggccttatatttttaaacagtaagtaatttacatattgttaagaaagtcttgaatattctacttgagattcccatataccttcaaatagagagctgttgttacttacgaggatgataaacttgagtgaccttgaattgtgtttttacccatattttcttacttggtgaagccaattaactgtgaaaatgggaccatatttatataagttgacaaatttggaatgatatattgggtaatatatttgatagtagaggaggattaaaaagtatattcccaagaactaggggtgagcacactttgtttggtataaagccagatagtaaatattttaaactttgctggctatacagtctctgtcacaactactcagtcctgctattgtagcgtaaaagcagacatagacaatacatgagtaagtagatgtggccatattgcaataaacctttatttacaaaaattgcgtggtttggatttgtccatgggccattttatacattttggattactttctctttccatagcagtttgcaaaggaagtgaatataggctaagcatccctatctgaaagtcccaaattcaaaatgctccaaaatccaaaatgagttccaacatgatgccgcaagtggaaaattccacacctgacctcacgtgatgggtcacaatcaaaatgcaggcacatgacacagtttattcagtgttcccaagggaaaaataaaattaccttcagactatgtgtataaggtgtatgtgaaacaaaaatgagttttgtgtttagacttgggtcccatctccaagatgtctcattacgcatatgtaaaattccaaaatctgaaaatcccaaatccaaagcagttctgatcccaggcatttcagataagggttactcaacctgtatcttgaactgaaaaaattacagacaccacagaattgcaaagttctctaagtattaattaaaatcctttaaagtaagtaaatattctttaaaaaaaaatctggggacagtcccttaaattagcatgggtccttgaatgagtaggatgtgatttaccttccagtaactgtgttttttcaaattagatagcttggattgttacctggtttactgaatggctatgcagctttctttgcctgataattattttgaaaagccggtgctttgcatatgataggcacttggtatttgaatgaattgaaacatctaataaattctaaaattcagagagctttcttaaagtgattgacagaacctattgatgtattcagtctaatcagattgtcatttggctctaagattaagccaatgatttaagtacatggttggccactgacctacttatattgatagatacaaaaattaagaaatcttcataaaaatagttttgctgtgctatatatttaattgtctttgtcttaaaattcaagtaaattttggatatagtgcactcatgtgatatttcaactgttttttccatagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataagtttgatatcttttaaaatgatttttggttatctgcacatgaagcaaacaaagtgtattccacaaaattctttaggcacagtctggtaagatagctgccagaaagaacagaaagagttgtcatttatctcttgtgagtacaatttctgaaagctgaatgagggcatctctttctggggatggtcgaagtttactgatctctcttattgcttcatggcagtactgctgggcgaggtaggttgtttgttgcacaccatcactctataagatacagaacaaaacagaacagatgcctgtcactgactgaatcagcgttttaacttcctgctataataaatgaacacatagttttgagatcagatgagctgaggattacagttaacagtcaaactacatctctaatgttcttttcccgactcatagtgctaacttcctttaggcctttttctcatattgaagcaaatttttattctattagcatgcaaagcaactagctcatcaatattacatagtcattcgttttcccctaatttttacttattagaatttctcagaagttctatgtacaaagtatctttatacaacatttttaaatgtaaaaaaaacacaagtaaaacttacttaaaaaataaagaataaagacataacaaaatgaaagtacagagggtttatgatgaaaatcagcttcctttcttccaaaggcactcactttatccaatagttttttttttcttttttctttttttttgagacagggtctcactctgtcacccaagctagagtg

SEQ ID NO: 13946 - DNA, 51046 bp, Human
  misc_feature (1)...(51046): n = A,T,C or G
gcacttacctgcataactcagatagtgtttttaacttcctcaactcatgcttggcctagttgggtcaaaagaactacttgtgaattccgtatgtccaattggtaggttactgttttttctcaagagtttagctatacagtaatgttggaagtcttgaggaacttcagctgctgtccctacttagccttgcaatactacggcatcttttcttctttttcttttttttaaagacggagtctcactttgtcacctaggccgaagtgcagtggcacaatctcggctcactgcaacctctgcctcccaggttcaagtgattctcttgcctcagcctcctaagtagttgggattacagaacatgcaccaccatgcccaactaatttttaaatatttagtagagacgggtttcaccatgttggccaggctggtctcaaactcctgacctcaagtgatccacctgcctcggcctcccacagtgctgggattacaggctgagccactgtgcccccgacctacagcatctttttaagagcaatgttttctgttttaatgtggccaagcaatctctaaacgaacatggtctgacaaaattgtgtagtgacatacttgacaactgggtgagcttgagtgtgatacttatttgaccatacggtatttcctctatatgtttccttatctttatatacaaaaaagggcaaatgataatgtcttagtcataggatcaagtacaacccaagtgcttactgctacactctacttggcaaattccaccttatgaatgtttcttaatatataaacctaatctaaaccaagataagctacaggtgcatattaacaatctttactcataaagttttgcatatttttacatactattcttcaagatggaaaaaacaccatcaaactggcttattttcatagatgtctttatatagtctatgatgtcttcattccataaaaaatccacacgattaaatatgaaattaatgtacccagctatgaggctaccgcattctttaacccaagaacaagaaaatacatgaatcagagaactgcaattacctacttgctggtctatttcctcattagagtgaattttttgaggactaaattgcatttctctatctctaatgcttaccccctatctcactggctctgtgtgtttgagtgcatgcgctgaatgtttatatcacttaatttctgttcggaacacgctgtctcttagcaccagtagatctggccttagagctaaggaaagaaggcctttctaacccataaggggtactaatcctgtacagactccaatatctcccgggctgggtacacgcaggttcacacccaggtgtgagcaagattgccaaactatacctataaggcgtttggaggagagagtccaaaagtcacgagacccggctaatttagctactatttcacaacaaccctgatcgtggtcggacttgtttctaggaagatgcgatgggctggaacttccttcaagaacagattgcaaaaggcagccgaccagggcgtgtcaggtcactgccaagggaagcagcagcggaaaccgtcgcctccggcttaggctgcggagcgggaaccccattctctgagttatgtttctgcctaaacacgcagaacaaaagagttcgtggctgcaagggtggcgcgcggtagtatttcttgctaataaaaggtccccacagggacatttttgctatgactgcaggcgtggccagtctccctgcacagcttccgggaagaggtggggataggaggctcgccccggggaaggtcacgctcggggtccccagaccaggtctccgcacgcccctgccccgtcgcctcccgggagcggctgcagtccccgttggctgcagacgggcagacacccgaagtgtccgcgccggcagccggaccgcaagcgaggaagagcgaaccgcgctcccgggcctggccgaagcgcttcctgtgccaggtttccggctccgggtcccgggaggaggatcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggtgaggttgggaggcgcgcgcccggcggggctcagaggtcacggctccaatgacagcagtgggcggaatgaatgggagcggggagcacgtgcgtcgcgacgcgggggcgcgcggggtagctccggggtagctccggggtgggactccggagctgaggggtgcccgcggtgggacggagccgcgcgttggactgaagtaggggcgccctacacggggttgcagaaagcggtgtcctggggaccccgggagcgttttggggggtggagaaagcggtgggatccgtgtcctgggggaagcgcaggagcgatcagattgaccgctgctatatggacaaggttaattaagcctggagagcgactgcagctatttactttggagttagaggaagacagatcttgcctgaaattttagagccaaagtgctcagagctctctccgagaaacggaggatcgaatcggcctcggaatagtccgaaaaggtcttgtggagaatgcagggctggtgctagggtggaccggaccttagttgtccagcagtggcttcgggaggagagcacacctggatggggctggaatgacactggaaggagaaaggcccgaggccgtcaggaggagagaaaccctggagtcatctaaagtcagaatctcagtgatagcccattctttcagggtctcctctgctgcctttgggttccgatctcctttttctccctttctggtcagtttagcccctgtaaatggacactgtgagcccttctgcactttgtaatgattctcagtgtgccatggggtaggcccatgctattagcataaccgtgcaaaatctatggactcactgttacttaagtttatttgaatttagtactcttttaattcagatttggtatactttatgtgtccgtgttctcatcaaacatcatttcccagtatgaagtatataacacttataaatatctactttgtaccaaagtagatgcgtatcacaaattatccaaaacaaggcttgggccaggcgcagtggctcacacctgtaatcccagcactttgggaggctgaggtgggagaatcggttgaggccaggagtttgggaccagcctaggcaacatagcaagactctgtctctataaaaaatagaaaaaattcaccaggtggggtggtgcatgcctgtagttctacctactcaggagcctgagggaggaggattgttcgatcccaggagttcaagattacagtgagctgtttattgtgatagtgccagtgcactccagcctgggcaacagtgtgagaccctatctctaaaaaatctaaagcaaaaaagacgtttggagaccaagtggcagctgggcaactagacaatgctagagagtaaagagaacagaatatggggggtgaggggcacgtgggagaagaggcttagaggaggaaggtaggctttgctgtgatccatttcaggactgttctctccagacttcagatatttctagttccacagaagaagccagtatttgaagagatgggtgcatccaccctcttatgccactacatgcttcttcttcttcttcttttttttttttttttgacacagagtctcactctgtcgcccaggctggagtgcagtggcggaatctcggctcactgcaaactccacctcccaggttcaagcgattctcctgctgcagactcccaagtagctgggattacaggcgtacaccacgacccccagctaatttttgtatttttagtagagacagcatttcaccatgttgcccaggctggtctggaactcctgacctcaagtgatccaccccctcctcggcctcccaaagtgcggggattacaggtgtgagccaccacgcctggcctgacacttctttttaaaaaagtttcttgcccaccaagcaaccttagccagggaaagtgtgcttttctggagagaatatgctttatggcctccccgtctgcatgacgacaaggaggaattctgtggactcatgatgccaagatcatgtatttctgatgtgtgtgtcagtgatgcctttcactatacgttaatatgttagcattctggtgtctgcctcaggcatgtgtattttggttacttcaagtctcttagggcctgatagtccttggggacacagaactacaataactaagccacagggacaaagagcggcaataattaagccacgtcttgctctccaccagagctctactacctcctaatggttgtacattcttctgacttcactagtagtgtgaacaaatattgtaatacaataaaaaccagtgtgcatgtgatcgtgccaaatcacttctcaatatatctttgattttttttttttaatttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcgaattgtaatccccaattacatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacctctttcctataattataaattgcccagtcatgggtaatttctttatagcagtgtgagaatggaccaatacagataattggtaccaaagtagttggcattgatataagatacctgagaatgtggaaattactttggaactgggtaacaagcagaggttggaatagtttggagggctcagaagaacaaaggaagatgtaggaaagtttggaaattcctagagtcttgttgaatggctttgaccaaaatgctgaaagtgatatggatgatgaagtccaggctgaggtggtctcagatggagatgaggagcttcctgggaactgggcaaaggtcactcttgctatgctttagcaaagagactggtggcattttgccccaccctagagatctgtggaactttgagcctgagagagatgatctgaaattggaacttaaatttaaaggggaagcagagcataaacgtttggaaaatttgcagcctgaagatgtgatagaaaagaattttctggggaggaattcaagctggctgcagacatttgcataagtaacaaggagccgaatgttaatagccaagagaatggggaaaatgtctccagagcatgtcagagaccttctctgcagcccctcccatcacaggccaggaggcctaggagggaaaaatggattcatgggctgggcccagggccctgctgctctgtgcaagagcagccttgggacttggtgccctgcttcccagccgtagctaaaaggggccaaggtacagcttgggccattgcttcagagggtataagccccaagccttggtggcttccatgtgctgctgagcctgcaaggtgcacagaagacaacaatttgggaacttctgcctagatttcagaggatgtatggaaatgcctcaatgcccaggcagaagtctgctgaaggggggagaaccctcatggagaacctctgttaggacagtgcagaaaggaaatgtggggttgcagcccccacacggagtccctgctggggcactgcctaatggagctgtgaaaggagggccaccgtgctctagaccccagaatggtaggtccaccaacagcttccaccgtgcacctggaaaagctgcaggcactcaatgccagcccatgagaatagcagtgggggttgaaccctgcaaagccacagaggcagagccacccaagttcttgggagcccaccctttgcatcagtgtgacctagatgtgagacatggagtcaaagatcattttggagctttaagtaatgactgccctgctgggtttggacttgcatgaggcctgtaagccccttcgttttggccaatttctaccatttggaatgggaacatttaaccaatgcctgtacccccattgtatcttggatgtaactaacttgtttttgattttacaggttcataggcggaagggacttgacttgtctcaggtaagactttggacttggacttttgagttaatgctagaatgagttaagacttttgaggactgttcggaaggaatgattggttttgaaaaatgaggatatgagatttgggaggagcaaggggcagaacgatatggttggttctgtgtctctacccaaatctcatctcaaattttaatccccatgtgtcaaaggagggcctatgtggaggtaattggatcctgggggcagattcccccatgctgttcttgttatagcgaattcttatgagatctgatggttttataagtgattggtagttccttctgtgttcattctccttcctgctgcctagtgaagaaggtgccttgctttcccttttccttctgccatgattgtaagtttcttgaggcctccctagccgtttggaactgtgagtcagttacacctctttcttttataaattacccagtcttgggtatttctttatagcaatgtgaaaacgtactaatacacctcgtttctaaaaatcagctacgcattgtggcatgttcctgtagtcccagctactcagtaggctgaggtgggaagatagcttgagcccaggagattgaggctgcagtgagctatgattgcaccactgcactccagcctggaaaaataaaataaaagtaaattcatgagaggcaaggttgactttcagagagtgtgtgagggaaaggtaagaaacaaaatcggaattagaaaatgactgttgcccctctcttttcattcttcactgcttttctgagcacctctcacctccctttgaaaaactgctctaaagtacttttaaagcagaaaatagtagcttgattgaatagatactgtattaaatgtatattgtgtaccaggctctgagctaagagctttacatctgctctctaaattaatctccacctctctccatgagtaggtattatcagaaagacatcacaaggtaacacaaatgttgagatttgaaccgagatctgtcttccaaagtccatgctactaataattgttaggccacttggtggtaaaaagcgtcccctgtattaattagctgtgtaattttaatccttcaacccagattaggggtctataactgaataaccaaaaagttattcagttagaatagttcagttagttattaactaatcatagttatttggtcaagcgcagtgactcacgtctgtaattccagcacttggggaggctgtggcaggaggatacttctaataatagtaactattactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgttgcactgtaattgcctgggatatcatgaaagttcttactggtttaatgaatatgtaatgctgtgggggaaagaatgaaactcaggccaactactttgactggtgtctggcaaagtcaactttcattgtcattttaatatggcgccgggcgcggtggctcacgcctgtaatcccagcactttgggaggccaaggcgggcggatcatgaggtcaggagatcgagaccatcctggctaacacggtgaaaccccatctctactaaaaatacaaaaaattagccaggcgaggtggtgggcgcctgtagtcccagctactcaggaggctgagacaggagaatggcgtgaaccctggggggcggagcctgcagtgagccgagatagcgccactgcactccagcctggacgacagaacgagactccgtctcacaaaaaaaaaaaaaaaaaaatatggctagagcaatacatgttcattagagaagaatcagaaaatatctaccaaaagaaggaataaaacaaaacacccccacaatccgattcattccagaataactacttttaacaccctggtttgtgtgctttcaaactctgttctcccatttccaaaggatgttgaggaacacgaacttaaaatagacagtgtttgtataaatataaattccttccttgctattgaaatcttttttcctctgaccaatcttagttaaatggaaggaaattgttttaaaactaattttcaggtctggaaagatagatatgaatatggaaatggctttctttgggggaagggatggactgaagatggttattattttctccttttttcttatttatgttttctgcaatgacaagtattttgtaataacaaaaggaaactttaaaattattcttcctctaaagtttgcaatctacctgtaaatgggtgattagaagataaagattataattatgggggttttatcatccaatgttacagtttttcaggaatattcttacaagtttcttgacatttttatttatagataccctatattaatcttgtgaagcatttaacatctgcctgtccaaatgtatgtcgtatatcacggtaagtttacagtccatactgcaactactaaaattatccatttttaaatttattattgtttaaaaatttttttttgtagcgatggggagctcactgtgttgcccaggctggtcttgaactgctggcctcaagctatcctcccaccctcaggttcccaaagtgctgggattgcagacataagcacccggcctaaaattattaattatattgcctgtaaatttctattctaaattgtagatctctgcctattcaaaaaacaggaatataataaagtttgagctcaacccagaacacaatgaacatagtttagtttttctttgattttgtgggttctcaaggccctatttataaaagtgatctattgatctgtcatttagcaagaatagaattctgtatgtttttccaaattataatgaccttttcagattcatgattaatttctagcaaatatttgggctgaattttccgtatctgagtctactaaatatatatgtatataaaacttacttgaaaatgaagtcatgtgcatttttgcatgtcccaggtttcatcacacaaccccagacagtaaaacacacagtggtgaaaaatacaccgatcctttcaaactcggttggagagacttgaaaggtctgtatgaggacattagaaaggtgagttttttattctgctgtgatgtaatgttttagcttaccaaaacttactaaaattttattttattttttattcttataattattattattttttgagctggagtctcactctgttgcccaggcttgagtgcagcggtgcaatctaagctcactgcaacccttgcctcccaggttcatgcaattctcctgcctcagcctcctgagtagctgagattataggcatgcgccatcacacctgggtaatttttgtatttttagtgaagacggggttttgctatgttggccaggctggtcttgaactcctgacctcaggtgacctacccgccttggcctcccaaagtgctgggattacaaaaaaacagtgcaggttttcagatctgtacaatgcagtttgcaatcttgattcacgtatggtcaagtttcaaatgtttcttgagaagaatacatatgacccagtgccaggcaatatgaagaatgcaatatgtatttatgtccagaaagaggttatggcagggttgggaacctgaaggaaaaaaatggtccaggtagctcatgcttgtccaatgagttatcccacctttcctcttaaaacccaccacctcccagtgactccagctgtctcttccttatctaattctgaatgtcattgccagtgtgccccaaatatggctttcttcattcaactctttttcctgaaaactttcagtagtttccaacctcacgtggttgggcaccgtggctcgtgcctgtaatcccaccaatttaggaggccaaagcaagaggactgcttaagcccaggagtttgaggctgcagtgagccatgatcccgccattgcactccagcctgagtgagagagcaagacattttttctgtctttagaaaaaaattggctgggcacggtggatcacacctataatcctagcactttgagaggacaccacttcctgtttcacagacagtaggggctgtggaggaagaactccttcagctcctgctctgtcgcaattggccagcttgcctgcgccttctctggcgattgcctgctctcctcccacccgtggaagtcatgtcccttccctctctaggggcagtcccttagccaacctccctagtttcttaggaactcccccagacatggcctctccctctgtctgcaaactttcattggcatggtcttccatatccattgggtgttcagtttcttcacctgcatttttaaaaggcccatccactgacccagtgcttcactccctcccttccctcacagtatcccctgccctctgccttcctccagtgccttcatgttccctccactattgcactggggccccctttccagcctctcctctgaagctggttttgcttgggtcactgatagcttccctgtgctaaatccaatggatgtgttaccagcagcaaatttgtacaggtctgcagcaaccttaattcttgcctcctcagaagaaagaattcgactgaggggcctaaggcagaaggagagacggaggcaagttttagagcaggagagaaagtttattattaagtgtagagtaggaagggaaggaagtaaagtacacttgtaagagggccaagctggtgacctgagagaaagtgtggtttgaccttggaatttgggttttagatgttggcatacttccagggacttgcatcccgatctccccggtttcttcccttggggtgggctgcccgcatgcgcagtggcccgccagtgttggggaggggagcatgctcagtgtgtttaccggagttttgcgcatgctcacgtgaggcattcttcccataccagtcccagttttcctagaaggacatacaccaattaagctctgccattttgcctcttagtgtgcatggttgagccgactcacccaactcccgagatcttattgggaagctgatcaccagtttcaggtttttgtatctattgagagactgccgtcccttggcaccagctgtgaccaattagtattttagcgacacagttaacaactgcttgaccatcacgtgatggtcgccttcctgttgtgggtcggggagccctctcctgccctgctcatgcctgactagctatctactgtaacggacacttcctggttttctgaccattgggcactattgactgtaacccctccttgaaacatggttcccttcactctgcactttgttccccctccttatcctgaggcttttcttcggttcatcacctccagctcacttcctttaattttgccattccctggggttccgtgggccccctcctctctctcttccttatatatctgtgtccatacttacgtctctcaaataatatcactactccaggttgaatcacatctcccacacccaggtagctaactactcaccgggaacgccatggggcggccatgacggtctcaggcttaactcagctgagactctacttttcccccacgagttgtttgttctgctgttttcctgttccttgggaacctgggaagaacccaggacttgtccctctccttcccctctatgtccttctagtctgcctcttgtcagtccccactgccccaggccaggcaattccatgcccctggtcctttcattcgtgctcttctcctccctgtctcagcttccgaggtgacagcttacctgggtgacagcaccacacccatcacactgtgttgtgtcaacggcagtgatcgttttacttctccccatctagaccctgagctccttgtaggcaaggcttgtcttactttacctttgtgacctctgtgtctgttacagtgcctggcactaagtcggtaatttactgaatgaacgatgggcccactttgttgtgttcacctgtgccgagctgaggttcattgactcccactgcatccaggggataaactctgacttagtcttggagtggcagatacaagcgacacacacccgtcagctggaaggctcttgtcctctttgtgaatcagaaccctgtttaggcttctaatcccacatcaaagcccatctcctccatgaaatactcagtttttctagcctgcactgatctcttccttccctgaactttcaatgtatttaatgtacagcattgttcacgctaccactgtattcgtcattgattgtttcatatttgcaaaatgtttctctccccagttcagttgtaggctccttgtaatccggcagcccatgccttatatgggctctatgcgcttacgtgggcctctatgaaccctcaaaatgtcttttgccaaataaaggccaagccagatggactgagccctgtttcttctccttggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatcttttaagctgcgaaccagcccctgttcctttcactgtccagctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacggtggctcacgcctgtaatcccaacactttgggaggccgaggcgggtggatcacctgatgtcaggagtttaagaccagcctggccaacgtggtgaaatcccgtctctactaaaaatacaaaaaattagccaggcattgtggtgggtgcttgtaatcccagctgcttgcggggctgaggcaggagaatcgcatgaacccgggaggcggaggttacaatgagctgagatcgttccattgcactccagtctgggcaacaagagcgaaactccgtctcaaaaaaaaaaagaaatcctgttggctttctgtgcagttttttgatgccattgtgacacagagaaactttatttcaggaactgcttatatcaacatcagaacttaaggaaatgtctgagtactactttgatgggaaagggaaagcctttcgaccaattattgtggcgctaatggcccgagcatgcaatattcatcataacaactcccggtgagctctttttttcattcctttcttgtttttatatttggcaagtctttcttcccggggttacttactgtttcatttcccatttaagaattagcatataccggctgggcatggtggctcatgcctataatcccagcattctgggagcctgaggcgggtggatcgtgagatcaggagtttgagaccagcctggccaacatggtgagaccccgtctctactaaaaatacaaaaaaaattagccgggcgtggtggcaggtgcctgtaatcccagctacttgggaggctgaggcaggagaatcgtttgaatctgggaggcggaggttgcagtgagccgagatcacgccattgcattccatcctgggaacagagcaagactccgtctcaaaaaaaccaaacaaaacaaaaaacatgggggatttttaaaacaaaactttggaggggattttaataaacgatagaaggtatatcttaagaaacagagcacgagggagaaactactacttactgatttttatattttcctttattaagcttttcagttgtccattaaatgttccctactagattacggggagttcttaacttgaggttcacgggagttgtgggatgtctgtaaacaacttgacattgtatgcaaaattttgtgtatatttggattttttggggaaggatttctatggcttacagtttattctcaaagggaagtagggccctgaaaagctcaggaccccgtgtttgttttctctctgaatcttgctaaccatggtgtctgggtagagaaagtaggaatccannnnnnnnnnnnnnnnnnnnttactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgttgcactgtaattgcctgggatatcatgaaagttcttactggtttaatgaatatgtaatgctgtgggggaaagaatgaaactcaggccaactactttgactggtgtctggcaaagtcaactttcattgtcattttaatatggcgccgggcgcagtggctcacgcctgtaatcccagcactttgggaggctgaggcaggcgggtcacgaggtcaggagatcaagaccatcctggctaacacggtgaaaccctgtctctactaaaaatacaaaaaattagctgggcatggtggcacgcacctgtcgtcccagctattccggaggctggggcaagagaatcgcttgaacccgggaggcagaggttgcagtgagccgagatcacgccattgcattccatcctgggaacagagcaagactccgtctcaaaaaaaccaaacaaaacaaaaaacatgggggatttttaaaacaaaactttggaggggattttaataaacgatagaaggtatatcttaagaaacagagcacgagggagaaactactacttactgatttttatattttcctttattaagcttttcagttgtccattaaatgttccctactagattacggggagttcttaacttgaggttcacgggagttgtgggatgtctgtaaacaacttgacattgtatgcaaaattttgtgtatatttggattttttggggaaggatttctatggcttacagtttattctcaaagggaagtagggccctgaaaagctcaggaccccgtgtttgttttctctctgaatcttgctaaccatggtgtctgggtagagaaagtaggaatccacacaacagtagactcagacttgacatgtccagaacacagagttgtggtggatcctgagacttgcccccagatcccccgtcagtgcacgactctgccccagctgctgtaccaggtatggttggtacctgttggccttcatttcttagcctcttcaaggattgccttggctacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccaagggataatcccgaataaacatcctgtcctttaaacttcatctcagagtctgcctcctgcagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgaggctagcctggccaacatggtgaaaccccatctctacaaaaaatataaaaattagccagtcgtggtgacacacacctataaatcccagctactcaggaggctggggcaggagaatcgcttgaacccaggaggtggaggctgcagtgagcagagattgcgccactgcactccagcctaggggagactctgtctcaaaaaaaaaaaaaaagaaaagaaaaagagctttatgatagatttctataaaattgcttcactcactgaatgcagcacagttatagtgtctgcatgtttctcagacaagccaaacctacctagcctgctcagctgcctcattgaagacactgttatcactggcacctggatcttggcaccatccattcctgtgtgaaactcttttagttctaagaagtgaatatcattgccagcaatcaggataacagactacccaaattgtgctgtacagagatctgttgatatcaattttgcaaatagccaatggcattggattacattagtccagttttcaaagctgaactagatgtttagggggtcaaattattagacacagttttcacagtagataacaggttgagagtccaggtgtgataacaatcctgtattcagaggaggtaacttttatagcactataaaaaactaaggaaattaccaaagcctatccctgaaaagactgtaacaaaacagccatttagcactgactggctccagtgattccaaaggtcaggccactaacaactgtagagccattcctggtttctgtgtgttctgtgtcactgagccagccactgctgctgctgtttatgggataggcaagaaggttgctaccaaaggaaatggttttgtctttcacctaggagatggttctgtggatatgtccatagtcactgttaaaacggatctttgaagtacattctacagtaagggacacccattaagctggagattttgatgagcagatggtcatcatttcatgcatgagtgcaaggtcaagcataagaacctcagtgagagcaagagggctgcagggcttgtgaccgtggtgtgtgcaccttgttcagcaccctccatgccaggatgaggctgattctgtctgcaaaggaatcaactcctatacttttttttttttttttgtcttgctctgtcacccaggctggagtgcagtggcacaatctcagctcatttcaacctctgcctcccaggttcaagcgattcttctgcctcagcctcccaagtagctgggattacaggcacacaccatcacgcccagctaatgtttgtatttttagtagagacggggtttcatcatgttggccaggctagtcttaaactcctgacctcaagtgatccgcctgtctccccctcccaaagtgctgagattaaaggcatgagccaccgcgcctgggcactcctacactttccttacccatccccaatttgaaagaactgaatgctggttagtccatagtaccctggaccctatagagaaagctctgcacagagcaacctggataagttgtagatccaggtatcatcataggggtctctctccacatatcccaagattcagaagctcttgtaatttcttcttcagtggcaagcaaataagcaatagtgtgaaccctgcatcatttatgatgcaactttgcagacatccattatatccacagctaaatctgaaaatattcaggggttgctgcttttagataccaattattttctcttgacattaaaatgctaacaaatctatgactgttaggatcaagttaaaaaaattcccactgaagagagacagactttattctgagccttacgtgtttctttaggtttagaaggtgaatgagcagtggctggggaggatggcctagaagttggagctcacaggcttcctccctgcactctgccattccttagattggaggcgcccttgatacagatccctccctacacactgggggtttacttgcaatttaagacttcacattttatattagtatgaacagggaaaatatattttgtaaaaccacatgtaaacctcgtaaaggattcactggtagggtcattgtattattctatctatttttaggtatgtttgaaactcttcattattaaaaaaatttttttggccgggtgcggtggctcacgtaatctcagcactctgggaggccaaggcaggtggatcatgtgaggtcatgagtttgagaccagccttgccaacatggcaaaaccccatctctactaaaaatacaaaaattatctgggcgtggtggcacacgcctgtagtctcagctacctgggaggctcaggcagaagaatcactaaaacaaggaggcgaaggttgcagtgagtcaagattgcgcccctgcactctagcctgggtgaaagagcaagactccatctcaaaaaaaaaaaagataattttttaaatctaatgaaggaggaaagaaaagtcctgacaggcatgctgaatcatagcatactcttgcaggtgtgaagtacagaggacgtagccaactctcaagaccaagggcttcattttccatgctaccttgcctgtcacctctcccagatcctgggaaaatgtgatccactatttcacagtaggaaatagaaatggtgcccagttttttgaaggcttgattcagtttggcattttggagatgtcatcttaaggacagtgtgaggtttttctgtaatctgtgcattttggtcatctgtcccaccctcatgttatggataagcagtggcagcatttcccagatgtaagctgacacacactaaagctgaactggataaaaaatacatcaggtaaaactatggaacatctgaaatatgatgtatattctacgtagaagctgtgttacagtaccaaataacatttcagtttcatcctgatttcatcagtcaacaatttagccatgcaaaatgacattttttattctatttatttatttattcggagacagagtctcgctctaccccccaggctggagtacagtggtgcaagtctcagctcactgcaacctccacctcccaggttcaagcgattctcctgcctcagcctcccaagtagctgggattacaggcacccactaccatgcctggctagtttttgtatttttagtggagacgtggtttcgtcatgttggccaggctggtctcgaactcctgacctcaggtgatcctcccgcctcggcgtcccaaagcgctgggattatgggcatgagccactgcgccaggcgcaaaatgacatttttagatggatatatagtctatgaaatttcaaaatattttaagaaatctttgttgtaataatagcttcagattaccaaaacaactctagtatcttggtgagtgctgccaatttcattgcaacttctcagcaggagccccgtctgctgatgtaatttatcataatggaagtggtgcccaacttctgaatgcatgagaaaggctagaccttacctgttgttttaaggtaaggtctactgctaactagtaggaggtgtctaatttattagactgaaattcacttgcaaaaatattctaaaagccttatattaaaaaaaaactgtaaaagtttatatcttttcctgtgcattcaactcaaagaagatagggcctagtaaatttacctgaaaaatatttaagtattctaatataaaaactgaatctcactgagggattcaggtggcttaaaactcacctgaaccctgaacctctattttctcatttactgaagtttattggggtttttggtttttttgtgtttttttgaaatgaagtctctgtcacccaggctggagtgcagtggcataatctcggctcactgcaacctccacttcccggctcaagtgattctcctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagactacagaagtggtttttatatgctaatttgtccctaccctccactgcttttgttttaatactccccccttagaagaatttgttgtgatctagacatattaagaagttgtaactgaaatattaataaagaatgaggccaggcgtggtggctcacacctgtaatcccagcactttgggaagctgaggtgggtggatcacctgaagtcaggaattcaagaccagcctggtcaacatggtgaaaccccatctctactaaaaatacaaacattagctggatgtggtggtgtgcacatgtaatccaagctacttgggaggctaaggcaggagaatggcttgaacccgggaggcagaggttgtagtgagccgagatcacaccattgcactccagcctgggcaataagagtgaaattccatctcaaaaaaaaaaaaaaaaaaaaggaatgagtagcactgtagacatgatttccaggctgagagcagttgaaagggtctagggtttagttctaaggctgctggtaagaggagccagcgtgacatcatattttaaaattatatgtaaagcaagatcaaaagctttcctcatgctgatttagtgtcgatagttaaattacagcaccttttatgtagttatacttcatttttcattgctttctgccgggtctgaggaattggaatgagcattaccttgtgcagatgttcagattcgatttttaaagaaaaagtcatatttcagaatccctctcccttttttcccctctaagatacaacctgatggtatttgaaaataagcatttggaataagtgcaacatttggttagtgtgtgtttaaatgaggatatgttttaggttccaaatggttatttcgccagtttgattttcttgaaatttagtttttaaaaattgccatagatgatggtggtaataatgattaaaatgaaatgggggacattccctctgaactgtaaaatttatatctgtgtcctgtcttcttgagcctacttatcctatagtttgtgttaaacttgggaaataaaagtttaaatttctaatgagaaggttaaatgtgagttggaagaaagttttacaaacatcttctgttggttactgaggttgtcatactaaacgtttaatttaagacattactacgcggggtgcggtggcttacgcctgtaatccacactttgggaggccaaggcaggcggatcacttgaggtcaggagttcgagaccaacctagccaacatggtgaaaccccatctctactaaaaatataaaatttagctgggtgtggtggtgtatgcctgtagtcccagctactcatggaggctgaagtgggagaatcacttgaacctgggaggcgaaggttgtgagccaatattgcaccactgcactccagcctgggtgacagagcgagaccctgtctcaaaaacaagaaagacagtattaaaagccttgaacattgagacagttgagtctttaaaatacttttaaaaaatgcttctcacctatcttccctatccaccccaaaatttaattgtaaacttataaacttaaacacctgaccaagaacactgttataaagatgattcttcagcccaataagatcagccagacttctgatcgtttactgtttttttggctaatggtacaatttctacttcttcaatggggaattcataaaatgtagttgtggcagggtttctcatacatttgtaaatgtatagaaatggctgtgtggtgaagccagagtttttataccgtttctcttagagaaataacattctttatcctagatccgatgtccagttttcacaagctgattgctgagaaggttctaggcggcgtctgttaaaaagcattgctttctgttaattagacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggtatggttttttggtttttttaaaatctctcttactgaatcacacgcttttcggaccgcatttgtttctcagatttgtctcattaaaaatatgcttgctcaaatgtaatgtggtcttctgaatttcaaaaaagtattcatgtcttgtccaaatacagatatttgataaataaataataaaaaataccatggaaaaataaacttagtatttctaatagaattcctttggttataaggaaagggattttcatgggtgtccaaaaaatgtatttcatgaggaatcatacgttttacttttgggcttagattacccagattcagtttaattttttaaacatttgtataattgagtgctgcatataaatgccaaagcaaacaaataaaactaataaaagaaaaaagaaacctcagagagatactgttctgccatgaaaattctgtcttttgaaatagaagttctgtaattgggtttggttcatatatgtatatattaaagcatatttctatattattagcattgggaatatgggaaacagggacttggtttgaggatgcatagatcctgggttgaaggatgagaataaagttgaacagatgagaatgaaaatgcacaggcatccatcgccatcaccacacacgtgctctacaaacaaaaagtttgtgcaggccaggcgcagtggctcatgcctgtaatcccagcactttgggaggctgaggtgggtggatcacctgaggtcaggagttcgagaccagcctggccaacaaggcaaaaccctgtcactactaaaaaaacacaaaaattagccagtgtacacctgtaatctcagctactcaggaggcttaggcaggagaatcgcttgaacctgggagagggaggttgcagtgagccaatatcacactactgcactccagcctgggcaacagagtgagactccatttcaaaaaaaaaaaaaaagtttgtgcaaacaactaccccaccctcacctccttttctctcatagatttatagtattcctggttcattcctatttaattctccttattaaaagaagagatatatgtatatacacacacacacacacacacacacacacacacacatacatatatatatgtttattgttatcttcacatgctggttttatttgaacataaatgactgttttgaaatcgagtcttgcaatttcatttatatgccttttatttcaaattttagattaaaaggttttacgtcctgttgactaaattctgtacatcagaatgttggccaaaaagcagatggcgtttagatttggagaggatgtgggtaactctatgacccatccctgccgtcagctgtatctgttttcaggcatagccagtcctaaagccttatgtggagccttgggcgggggaagaggatcaagagaacaaatgatggtctccgccttggctagcccctgtgtgtctgcctctgccactggggacctctttctgagggcaggtcaaggacacatgtgccgccttcacctgcctctttcagttctgacagccatctgcttagcacagggctacttgccagttcctacctgtttctgcctctgacccacaactgctatgttaccggtacaaaaccccccacacacagtgccccctcggtgagcccttgttaggcctggcctgggcttcctagcacttctttcctttaactcccacccctggccgtcacagtcctgtggcttccatgtcatatgctggacctttggtctctaggatctccccggccaggtgaagaaggaactaaaggccaaaggatcccgagccttgagctgctaatgatgtaggggctgggtcagggaatgtaagtgggtacctatatatcataatttgtaaaatgactttataggcatatacttacatcaggatgtcttacataatatgtatattatataaagtggtgattaattggtaaacacaatgaacatcactgtttagatactgaagaacctaagacaataagtacctaaatagttatgttgaaaattctgtgaactctagcctttataactaattactacagaatgtaacacttacggccgggtgtggtggctcacgcctgtaatcctagcactttgggaggccgaggcagttggatcacttggggccaggagttcgagaccagcctggccaacatggtgaaaccccatctctagtaaaaatacaaaaatacctgggcgtggtggtgtacgcttgtagtcccagctactcatgaggctgaggtggggggattgcttgaacccaggaggaagagtctgcagtgagccgaggtcatgccactgtactcaagcctgggcaacagagcaagactctttctcaaaaaaaaaaaaaagaatgtaatatatatctttaaatatgcaaattaatgtgatatatagggtgtatttggttatagcatataattcaactatttatgcagtagtttataactagttgctaatacagtgtagacatccatcacagtctaaagaagactggaaatatgttgattgcttagtgttcaatggaaaaacttttttttttttttgtctaggaatgaggggcagtgtcacatagtacaaaaagcatttcacttggagccaaaattctttggtttaatttttattgaaaataacatgtatcgtgccatgctctggggtgtgctcagtactagctgagatgattcctagtctgagctcccactccactccaccctccccactgccctgggagcatagagactagagcatcactgactggtacgcaaggtgtgatggtcgcagcatgcatgggtgttgtacacgcacaaaagggaggcatctgaccagactgagggatcggggggaacttcttagaggtggcatctgaaccaattatgcaaataagtccactcagtgaagaagggggcagaactttttgagcagaaggaacagtaagtggaaaggcacaaaggaagaatgaacatccagtgtagtgaaactgaaggcagctgcattttggtggggctggtgagtgaagctgctctccctctccaggcattgatttcttcaggtgtcaactggggagatggacatggtcatctctgagagccaatacagttcaagtactgtcccaaatctgtaaccgattattagaaactgggaagagtgacatggtcatctctgagagccagtccagttcaaacactgtcccaaatctgtaactgattattacgaactgggaagtgacatggtcatctctgagagccagtccagttcaaacactgttccaaatctgtaactgattgttacggactcctgttgaggaagaagaaggtaaaaaaccctgcatccaagatgagcccccacttccacgaagctcccttccagtcagtttcatcattggctctactgctctgatggatttttcagaacgttctgttttccccctgtctttttctaggctgttcttgctggagatttaattctttctgcagcatctatagctctggcacgaattggaaatacaactgttatatctattttaacccaagttattgaagatttggtgcgtggtacgttgattctgatttttcttctttgttattcaaccctggtgtttagccaggcaataaagccacctctcaaatgactcctttccttctttataggtgaatttcttcagctcgggtcaaaagaaaatgagaatgaaagatttgcacactaccttgagaagacattcaagaagaccgccagcctgatagccaacagttgtaaagcagtatgtacgttctgtctttcttcaagttaaagcctcatagctcttttttgggagctaattttcctagaaaatatttcggtgaagaatcttaaaatagtacccaaaaatcccaagaggttaatgaggaaaagaatgacatccccaaacaatagaggacttctgctgtgttttcatttttgccatcttcttttggtatgcaggcgttgacttttcatcttttcttcccaagaattcaatcaaaataagctttcccgcaccttccccaatctgattgccaaactgtatcattttgaacaatttatcataatttctctaatgattgatatcacacacactctttctgacacttcaccttttagaaatgaagtgctctgttctttaatataatatttactcaggaaaagatatctgttagattgtactagcattctatgaacttttttttgtttttttgttttttgtgtttttttgagacagagtcttttgctgtgtggcccaggctacaaagcagtggtgtgatcttggctcactacaacctccacctcccaggttcaggcaattctcctgcctcagcttccctagtagctgggaccacaggtgtgcgccatcacacccagctaatttttgtatttttcatagggatgggggtttgccatgttggctgggctggtctcaaactcctgccctcaagtgatccacccaccttggccctgcaaagtactgggattacaggcatgagccattgcacctggccaatacattgcacctggccaatccttctaatatttttacatgaaatataaacaagtcctatttcttcagagtacaaattgagtataagccataactgtttttccccttgctttctccctccctccgctgtgcatacacatgtatacattttttttttaatgagtaatacctttaatccgtagacaaatgtgtggtattcatcgttagtccaagaatgaaaagcagtctctccatagaattgtttatctgcccatctctaagcctgacagatacacagagacaaaacctggacaaatgacattcccatgtaattacagccacaaaataaggaagacctgtaagggtcgcatgtcaattgctgtcatgatagactcctaacataattaacaggtaaagagagcttttgctcagacctctcagatgaaaaagtctcttgctgttagtgtctctgttttgaaaagtgtcaagaaatgtataattgcaaggcagaaaagaatgaggacaatcttttcttcctaaaaagacctaatagaaactttaaggaatgtgaattatgtagaacatgctagccacagtctcgaccacttttgtctttttattaaaagggctattatgtttttatttccaagaaattatgtgggttttttttttaaagtgagatggaagaaagtatagacacgagatgctaaataagagaatagcctattttaagtgggtgctctaacacttttacagtaatcctttacatattatcatgcccttgatggcccaactctccctgaaggtcaggatccatcctcttaacacattagggtgccttaatattacttactaatatttatccttaagaggatgtgttaagtgaggctcattgataatttcacaatttgagactgcaaacttagaagcattagcatggtcaggcaaggtggctcacacctgtaatcccagcatttagggagactgaggcggaaggtttgcttgtgaccagaagttcaagaccaacctaggcaacatagcaagatccccatctctacttaaaaataatgtttaaaaaataaagtcttagaagcattagtagtagtgagactattggaattggaaacaccaagacttactgtctgcaccatgcagacatcctgcaggcacggggtggggcggcaccaaattggagctagcacagaaattcactcagtgatggaagcttacaaagggtccaaagaaatggacctgagtcatgatagagaggtttccttgtggtcactgttttctgtttaagaagccaaagataatgcacaggaattcttttataaagatatgcacctcattcttcaaagattagcagctgaacgaacagtgaacatgttaacgtggctggacccttattaaaaatgaaatgtttcatgctgcccactagggggcatgctggcatcgtcccagcactacctccttttcatgtggtttattcctaaactccacagctcttagaataataaagcaaaatgatagtgtgagctatttgaataaaagtttctatatttaagtgcctatgggtggaaatattccagaggtgttatggattcaaaatggctatttttacgtactcttggtatttaaaatgcaaagccatgcgagctccaaataaatgcatgcaaagcaaattagacacaccaaaaagaggggaggaggagaactgaaagagcagaattattacagaagaagaactaatgggattgcaaaatgtattgagaattggagggaaacttacaagctgcattctactaaggataccatttcttcatctcccttcctttttttagtgaaaataatattaaaatctaagagagggctgtctagggggattgttttgtgattgactgatattaaaatagaatccattttaggccgggcacggtggctcacacctgtaatcctaacactttaggaggccgaggcgagtggatcactttagtccaggatttcaagaccagcctggccaacatggcaaaaccccgtctgtactaaaaatacaaaaattagccgggcgtggtggtgcacgcctgtaatgccagctacttgggaagctgaggcaggagaaccgcttgaacccgggaggtggaggttgcagtgagccaagatcactccactgcattccagcctgggcaatagagcgagagtctctcaaaaaaaaaaacacaaaccagaattcatgttattatcaaaagatgacttatttatttacatacttactcacttgcaaaatacattttgtactcatgcaaaatacattttgtagcttactaataaagacagtggcttgtttcccaggaaatctggtggaaatgagacctgagaggtcagagggcctgtccagttgttgttaagccagacagtagctgagttgagacttgaacccagagctgggtatggtaatcctgccttgtttctctctctctctctctcttttttttttttttctgaatttctattttctccagggctgcttgtggcctggaattaatgggctctcttcctattacttgattttcaaagcctcagagtaccactacagaattgcatattgtgggtcacattagcagaacactctttttttttttttttaattcatttttttgagatggagtctcgctctgttgcccaggctggagcgcagtggcatgatctcagctcactgcaacctccacctcccaggttcaagtgattctcccacctcagcctcccgagtagctgggattacaggtgcacaccaccacatgccacacctggcctcttttttttttacaatattcatatctatctataggcctcattcagatcttgccagttgtgaactgttataacgaaagggaaaacatatttttctgttccagcatccagtccaggatttcacgttgcattttgctgtcatgactctgtagtctcttgtcatctagaacagtctttctttgcctctcattaccttggtatttggaagagtgcaggccagttatgttgttgagcctctcagtcgggcttctctgatacttctcaagattcgatccaggttatgaatatttggcaggaataccacaagagcggtgctgtcctcagctcctcataccaggaggcgcgtgctgtcttgtctgtcccgttactggtgatgcatgcctggatcgcttgattaggatactgtcgggccgggcacagtggctcacgcctgtaatcccagcactttggaaggccgaggtgggcagattacctgaggtcaagagttcaagaccagcctggccaacatggtaaaaccccatctctactaaaattataaaaaattagctgggcatggtggcgggcacctgtaatctcagcactttgggaggccgaggcgggtagatcacctgaggtcaagagtttgacaagcgtggccaacatagtgaaaccatgtctctactaaaaatacaaaaattagccgggcgtagtggcaggcgcctataatcccagctactctggaggctgatacaggagaattgcttgaatccgggaggcggaggttgcagtgagccgagattgcaccattgcactcaagcctgggcaacaagagtgaaactccatctcaaaaaaaaaagatactgtctgccaggtttcttcaatctaaaattactattttaacctattttgggcaaagtattttcagattatgtaaatattattctgatggttgtcaaatggctgtttttctattttcatcatttcttctatatcactcttctacaagaaagttggtatcctattttttttgttattattatttcattctcaaaagagctgaagagttggtattccattgtaaggaagctcttaactgtatgggctcttggattcttattttattctgtatcttttttttttttttttttttttgagccagggtatcactctgtcacccacgctggagtgcagtggtgcaatctcagctcactgcaacctccacctcccgggctcaggtgatcctcccacctcagcctcctgagtagctgggattacatgcggctgccaccatacccggatgacttttttgtatttttagtagagacggggttttgccattttgcccaggctggtctcaaactcctggcctcaagtgatcgcccacctcggcctcccaaagtgctgggattataggcgtgagtcaccgtgcccagccatcttattttattctgtagattataacactgtcattattttaatactcaattatccaacgtatggccagtaggggaggccctttaacctggctctgtgtcctccatcattttttcagcaccccatttctggcaggagatattcagccctgttattcactgttctccaaggagcccacattccttttggtggaaaatggtgttaagaaaccagaatttgagtactgggtgtcatcgtttctagacccactcaatggacagagctaggaaatacatgtatgtattatatgtaatgtaggtagatacgtgtatatctttctgtacccatccatacttattcaaaaccacgaggtatcaaacagatagttccaaatccatctaacaccacaggatttgtggtttattccaggattccatctttccatatttgtaacccccttcccaaacagtgagagacctggctcctcttctccgcggtgtatttatttgcacaatctgagaatataccataggagtttacaaattcatgactcatatctctgtgaaaaacaaacccagtagctagaattcagtatttatcattccttttgtcttgggcctgaggataatagaatcaaagcactgttcaaaagttacctttctctacgtatcagtgtggttgtgttattatttggaatatattaacccatttatgcctagtgttccattattggaatgctaagcttgtggagttatttctatcctactgctcaaggtcattaccaaggtctgatttttcacaaaacaaatttgcaacctccagcataaatgggttaatagttggttcctttttttttttttttttttttttgagacggagtcttgctctttcgcccaggccggagtgcagtggcactatctcagctcactgcaagctctgcctcccgggttcacgccattctcctgcctcagcctcccgagtagctgggactacaggtgcccgctaccacgcccggctaattttttgtatttttagtagagatggggtttcatggtgttagccaggatggtctcgatctcctgacctcgtgatccgcccgcctcggcctcccaaagtgctgggattacaggtgtgagccaccgcgcccagcctagttggattcatttttattccactttagggattccctctcattcttgctgatttcgtgttttggttttgagcgttttgttattgttgctgttgttttgaatgtttgaaacaacgtggctgggcacagtgtctcatgcctgtaatcctagcactttgggaggccaaggcagatggattgcttgagcccaggagtttgagaccagcctgggcaacatggcgaaacctctgtctacaaggaatacaaaaattagctgggtgtggtagtgcacacctgaagtcccagctacctgggaggctgaggtgggaggatcacctgagccctgggaggtcgaggctgcagtgagctgtgatcacaccactgcactccagcctggcaacagagtgagactctgtctaaaaaaataataataataaaaaaaataaaagacattaatgtagctccaaaagtcagaactatacaatacagtaactctcccttttgccctgttttcttcccctacccccttgtaggtaagcagtctcgttcacttctggttcctccttcctgggtttcgtttagcacaaacaggcagacacaagtatgctatcttcccttctttctcacagcaagaagtagtaccctagactactctgctttccttttgcatttcttcagttaacaatttattaggaaaatgattccacattggtttgtaggatcttcctcatttttaaaaccactgtatcagggctgggcttgtaatcccagcactttgggaggctgaggcggccgaatcacgaggtcaggagttcgagaccagcctggccaacatggtgaaaccccttctccactaaaaatacaaaaattagctgggcgtggtggcacacacctgtaatcccagcactttgggaggccaaagcaggcggatcacttgagaccagagttcaaggccaggccggccaacatggtggaaccccatctctactaaaagtacaaaaattagccaggtatggtggtgggtgcctgtaatcccagctactcgggaggctgaggcacaagaatagcttgaacccgggaggtggaggttgtagtgagccaagatcacgtcactgcactccagcatgggcgacaaagtgagactccatctcaaaaaaattaataaataaataatttaaaaatttttttaaaagcctctgtatcagatcccattatgtggacatagcatggtttattcagccaatcttctatacatgggcatttaggtttccagttttacaattacaaacactactgcaagggctgatcgtgcataaacctatttttgtgttgtgagaggagtgcctgcagggtgaatttaggggtaattgcacatgtggttttgttaggcaccaccagatttccctctgttgggtctgtaccagtatgtgtttccaccagcagcttttcagaacctcttttcccacagccttactaactaaatgtgccattacacgcttgagtttttgccagtccagtagaggagaatgtattgcagtggagttttaatttacatctctcctttctgagtgaggtggaacatttttcagatgcttaagggccatttatttatttgtttatttatcggagtctcactctgtcacccaggctggagtgcagtggcacgatctcggctcactgcaacctccgcctcccaggttcaagcaattctcctgcctcagcctcccaagtagctgggattacaggcgtgagccactgcgcccagcccttcccagtctcgttgagacgtggcttgtaaggatgtgatgcaaggtgtgaaccttccccagaaagaagtgcatacgcacagcacagcctggctgcagcatctgcttcaaacaaaacagttagccgagctccactttctttgacttaatcattcttcatgctccacccatttccggaaagatgtgaggcatccctctgatgctgagcgcaagtctgtgcacctctttgccttcttgtatgttgtgctatgttgcgtccaatttgtggcagttgttttctgttttcctgctacagatctaggcagtactgacctgggatggggaagcaggactctctggcatggtctttatgctaccccagggaaatctgggatagttgaaatctgagcagtaatgtcccttcgccatgtgtcaggcagaagctgcccactaaataagctctgttcagcatgtgtgggcacagaggggacagtgcagacagactgcagctttatgcttacttggacacattccttgacctcttggaggttctattttgttgcccagcatagaagcagcactcctgtgttgaagtgatgaagagaacagtgtctggagccagaccatgtggatgaaattcaggttccagcgtgttggagccatgtaatgcctggtaccgtctgtgtctcagtttctcgaacttcataagtgacttaagatgtgagaactctcagaacagtgcctagcacatagtggacgctcagaaattgttagcttttatcatcaccaaccacataatccatatttgtgggatattgtgaggtttaactcaaatcatacaaagtgttcatcatatgtgctccacacattttaatccattaaaatgttcactaacagatttttaggccgggcacggtggctcacgcctgtaatcccagcactttgggaggctgaggcaggcagatcacctgaggtcaggagttcgagaccagcctgaaaccccgtctctactaaaaatacaaaaattagctgggcgtggtggcatacggaggttgaggcaggagaatcgcttgaacttgggaggtggagattacagtgagcccagatcgtgccgctgcactctagcctgggtgacagagagactccgtctccaaaaaaagaaatagatttttagaaaatctttcacttttcaggaagaaagcttatagtctctgtggctctgtgttgaggaaacagcattaatctcactacaggagactgcttcactatcagttatttctacgtggaaatatcttgattcccagtatcattctgtcctgagcccagcacatcccaggctgcccaaatcttgccatgctctcctttgagccaagctgatcttagcttctctcgaaagtttctgaattgtcccccatatggtctcccagactcttcagttgaaaaaaggagccctccctgacagcccaggggtcggtgcctgctcatgggaaggtggttgctgttgaaagcagttatgagcttactgttcactcaactcagtggccacctgaccctttatggtgcatgcaattttaccatgtacttatggccaagcactacatagtcaacagacctcattaagttgtcaaaaagcattctcaggctgaggacgttaggcaacctggctttagttggcagaggtgcgtggacactgccaaggctcctatttctggttccagtggatgaggtggaggaggattatttgtaataatagcaaacagccaggtgcggtggctcacacctgataatctcaacgctttgggaggtggaggtgggaggatcacgagcccaggagtttgaggccagcctagacaacatggtgagactccatctctatgaaaaaattaaaaatcagctgggtgtggttgcgcgtgcctgtagtcccagctactcaggagactgaggcggaaggaacccttgagcccaggagttcaaggttacagtgagctatgatcgcaccactgtaccccagcctgggcaacagagtgagaccctatttctaaaaagagataataatagcaaacacacattgagttctaaccaggtgccaggcagtatactgagggcttaaatgcagcatcatgtctgtttctcacagcaaccctacaaggtaagtgcttgtgatttctacattgtacagatgagcaagagagattcagtaacatgccgaggtcttgtagagggcacaaatgcagccccacagtctcacagcagagcccgcagcactgcaccacactgacgcctgagcaaagttcactccctgactggagagccacagaggcacgaccgaaggtcaggggacagggtttcctagcatccgcgagccttacagaaaggcaactgtgcagtgctccagctggctttctcatggagagtcaacagagacatttcccctccagtagaacacagaccgtctctcccctcccccttgttggttttacccaggctttgttttctgaaaatgtggctgggcctgcttaacatgcttagcagggcactgggaaatgcacttcagtggccggtgccagctagctttttggagttttaaaaagactttcagaagtcttatttctcccccattgaaaggagggaaaagggtttttatacagttacttcttttgagagaaatgtggaaacagtgggaccagtgaagttccttccgataatgaaagagcgatatctgtgtctgaagcaggaggcttgagatgatttttatggacacaccaagaaataactgcattcagaaacaggtgaaattcccaacgatgatgaaaagaaaggactacagatgggaaaattgtgtgtgattacattagtatctcttcctgaaatgagggatacattgatagagatgattaaagccaacagtaatcgggctagcttgccgagtgctagaagtcagtatttcacagatgggggtccgtttcttttgcatgtcaagaaggtttacttagcatgttaccagcagaactagtccagttgtagctcagtttttcctaagcagtgggaaaggctgcttatcctgtctgaaagcaggggttggagaaggagaattttcttagaatttaacaacacaatctgagactgaaattcttgactggaaatgcggttttgtacatgcttggtgtccctctgatgtcagcatctcctgagtgtgtataatctagccccgctgcctcctattttaaggaattccttcagccaggggtcagctgctttgttgctgcctggaagcagcttatctcagaatgctctttctgtttcaggtctctgttctaggatgtcccgacccagtggtgcatgagatcgcctatcagtacggaaaaaatgtaggaatagcttttcaggttagtatgctttttatttgtaagaatggtggcgtagtgatacagtcagcattctcccctagtgtgtaatcgtcaaaatagtaagaacgatggcagcagtgttggcatggcggtgctccttacatcccatttttccttttgccagctaatagatgatgtattggacttcacctcgtgttctgaccagatgggcaaaccaacatcagctgatctgaagctcgggttagccactggtcctgtcctgtttgcctgtcagcaggtaggttttacaaactccctttgacacatcactgcatagccccacagaactgatgtcccgcggcacagctgatgggaagattgcataaaggaatagatgggaaggcattcagataagagatcacaggtctgcatttgatcctggctgagtgagatgttggggctggtcatttcaccttgctaagactgtttccttatctgtgaaattgagaagatcacctttctcccagggtggttgtgaggattagctaagatcctatttgagatctttgtgtcttgtggtgtgccataggcatttgaggtagcatcgtgattatttccatatattttggccactggcaaagtgaacggtttctaagtcttgattataggactggactttggtggtcctcagagccccttaaaaggcataggaagcatcaagggcctccaagcataagaaattctccggttctagaagtttaatgagactctgctgctctgagagaggctttagaacctcggccattgcctcaaaatgtcaggaagtcagtggagtgcagtagacccacatagttccttctttctccggattgagggactgagtcccccttaatgtgaatgaaaggcttaggaagcttcaaagatgttccctcgactgacaaagcagacattctcacagcctcctccagaccctgccacatggcttgtggctgtactgaatgttacttgaaataagtgagacattagctggtgttggaacatctcgttaatagattttcatcttagtagtatttaatttgttatgttgcaaagcagtaagatgttcatcaccgtgccatgaaattcaacattagctctttggtgtaaaattatagtaacttttggtctttcagagattttgcctctattctgtcttcacgtttacaaaggtcagtcatgtcctccataaaattcagtgattccactgtgatacagaaaccacggcccttgcttttggtgggtttctgattggagagaggaaaggtcatctttcacccactatctagcatagccattggcagcatgattcttcccaggggaggctgacgttctgggtggctggaccaggctactttggcagcttgctaaggctatgaatggagatgttggggtactcggtaggaacacccaccctcattattacaaggcttccatcctctcaaactttggaggctgaggtaagaagtgaaaggtatgctgtaaataggtcctctctcccaatgaggcttacttgccagcccaaaatcaaagagtataatacatgtgcccagttttgacaaaaatttataaaacctccttttgtacattaaggcaagagtgaggaacatttgagccatgtaggtgttatgctggggattagaaaaatgaggcactggctaccagtaacctatataactgcgaacattacttctcagatacttgttagtaaacatgagtgaaggaaagcaagatggactgagtgtgctgaaatccagctagcttggtaaagattcctttacctaggctcagattatcaggataaaaggaaaaagcctttttccctggagaagtctatgagaaagttttggttgctctatttgtaaaaatcttcaaattgttaagtacttgttatgaaccccaggatactaagttaccggttgagtcctacttaaaccttaaggtgactgggtgagaggaggctggcctcttcggactgtgtttcactctgaatatatttcagaagaaactaacttactttcccctacacacacaaaggagtaatggctatctctgctttcatatatagtgggggaaaggggaaatggacctctgcatagtatctgtcagtaatctacaagagactgaaaaatgctggttaggcggtggctcatgcctgtaatcccagcactttgggaggctgaggcagttggattatgaggtcaggagttcaagaccagcctgaccaatatggtggaaaccccgtctctactaaaaatacaaaaattagccgggcctggtggtgcatgcctgtaatcccagctactcgggaggccaaggaaggagaatccttgaacctgggaggcagaggttgcagtgagccgagactgcactccagcctgggtgacagagtgagactccgtctcaaaaaaaaaaaaaaaaaaaaaaaaaaaaaggctggttaaaaaaagcaagcaaaaggaaaaaaaaagattactgtacccgaagccatggttttatgtgtgctttgctgggaaatcccagtcatgaggcacctactcatgctcaccagacagcagtgttctcatctgcccataaggcagtgagttgaaaaggcacattgcagcctcagaaaagggaacacagaatggagtccaagcaggaagtgactctggacaggactcatttcaaaagtagactgatgtttctgtcttgtggcacatgggccagaagttagccaagtatgtatttataagttgccttctaataaaacagcaaggttaggctcttttgtggaatacactgtaaaacaagagattcttagcaagaaatgtgtcaaaagatatatgggactaagattaattcaggtaaaaacaagttccaaaaataacgtaagaatatgcaatatctccacttaatgaaaatgtgtttttagtttacaaaggattctttcatacattatctctaatctcacaactcctctttgtggtagatattatggtgtttattctgcaagtaagaaactgatgcccaaacctcgccaaaattaaacatctggtaaatggcacagcagggaactgaacaagtctaagaccagtattcattttattacatcatacatagtgttattgccactggtaatgctgagaagttagtagctatgataccacacaggccttcccacagagcaggtaactaacccacctgggcactgacgatactcaaagaatcatctctgtgtcatgtctttgctattgtaaacaacatacctacttggtggagtagttctaagacgtctgtaatcctttccctttggtaggtgagttttgtttgctgatgagatggtctttgaacttttccatttgtgaacactggaccaggacaagcattcttgggaaaccaccttttcctttttaatttggtgtggtgggttgtcttggagtttactccagccagcacttgacagaaactccctgtcttttggaattcctttatttttaacatctctcttaaggggtttcctgataacagttggttcagaggatttaaaaagagttttggggatttctggagaagtcccaggggatgacagcgtcctcccatgtacgtatgtgtacatattctctttaagaataaaaacctcatgttaattggattttgaaagcttcagaaacaaaatggaagtgttttactttctctggtgaaacttttttaattttcaaatatcttttttaaaaaaaccaaatctttcctttcttctgcttctcttccttatttgataagtcactagacccaaacgtcagttgtagccacgtttccaaatgccatcaccagcccctgcaccagctgcacaggccttatgctatcgtggtgactagttggtgccttagtgttacccagtttcgtttgggtagactcatactcatcaccttagcagtttagtttatggatgggtttcacagagttacaacccgatttatccacaggtggttttcctactcttaaaaacagcacctgagcaaacagaatttttatttgtcactaaatctgcaggcaactgttcttcctgctgtgtttctcttttcttttccacatacacattaaggggactggggagtgcccggggaagagtttgatattttgcatattaaaattgcacacatgacatgtttggaaggaaggatgtagtcactcaatgcaaatatttttttcaaattttgctttctcaatgctttttatagtaaaagcatcagtgaaaacacccaatcagcatatcttaccacacttgctggtactgtagaaaaagcttatacatcataaacaaggtaatgtcaccagatgcctacgagagaatcacatcagtgtcaacgataaaaccttctagatatccagtattggtatgtggtattaaaaaactaaaacaggctgtgtgtagtggctcacgtccataatcccagcactctgggaggcccaggcgagaggatcacttgaggccaggagtttgacaccagcctaggcaacaaggcaagaccccatctctataaaaaatttaaaaattggccaggcacggtggctcacgcctgtaatcccactttgggaggcactttgggaggccgaggtgggcagatcacgaggttaggagatcaagaccatcctggctacggtaaaactccatctctactaaaaatacaaaaaattagctgggcgtggtggcttgcgcctgtagtcccaagtactcgggaggctgaggcagaggaatcatttgaacccgggaggcggaggttgcagtcagccaagatcgtgccactgcactccagcctggatgacagagcgaaactccatctcaaaaaaaaaaaaaaaaaattaaaaaattagccaggtgcgtgcctgtagtcccagctactcgggaggctgaggcagaggatcacttgaacctataggagtttgaggctgcagtgagctacgattgcaccactgcactccagcctgggcaacagaacaagtctcataacaaaactaaaacctacttgatttggcttttttaccgtagaagttgatttgggctttcctgatttctagtagcttgttttcttcttaaaagacccagtaactaaaggaaattactggttttcataagaactaaccagttgctggctctataaattctgtaaacacattagcagtctccacatgtttagagctttgttctgacacatattttggtctgaaaaaattatttctttgtctgtgatcacttggctgcggcttttctatgtatgccctattttttcttctaggattactaataccatggtcatggttacaggacaacttatttcatccttcaggttcactgccagggaaaaactggcagctgctgtaagcactgacgtggccaaaatcaaacacatcttacctcttccgtggagccatagactgttagagctcaagggcttccagtcatgaagatgagaagcctaagaccccaggggctaaggaagtcactcggctgtggcagctggtagccaaaccaagactagagttcggatctaggaagtgaagtgatttggtgtcctggcttttgtattctgttaatggtgacacttctaaatagttgctaagtattgtagaatatcgattttaccttcagttccttttttacctattttttctctctcttcttgctatcatcttaattcaggtcttttttataacctactctagtaacctgtttgttctgtctacctctgactcttaattccatggttctcaaccttggcggcacattaaaaataccagggtgggcgggaggaggttgaaaatcttggtgcccaggctaaaccccaagccagtataaccaaagtctctgggaacaggatctaggcaactgtatttatacctccccaggccaggcgcggtggctcacacctgtaatcccagcacttggggaggctgaggtggacagatcacctgaggtcaggagtttgagaccagcctggccaatatggcaaaaccctgtctctactaacagtacaaaattagccgggtgtggtggcgcacacctgtagtcccagctactcaggaggctgaggcagagaattgcttgaacccgggaggcagaggttgtggtgagccgaggtcgtgccactgcaccactccagcctgtgtgatggagcaagactccatcacaggagggggggaaaaacaacaaaaaaacaaaaaacactccccagctgatcccagtatgcagtcaatgtcatgcaccgctgctcagatccactctacacactgcttaaggcagagctctgcacataatgccctctgctcagaaacctcagtagctttcagttggtaatcaatttagaacttagagtagaatgcctaattcccatcctcatcctaggccagtgactctcaaaatgttggcagagaccagagatactggtgtcacctgttagatggtggcatctgttagaaatgcatgccaaggctccatccctactcaatcagaaactgggggagaggccccacaagcagtacaggtgatcctgatacgatttaaagtttaacaaccatgttgttttttattttttatttgagacggagtttcactcgttgtccaaggtagagtgcaatggcgcaatctcggctcactgcaacctccacctccccaggttcaagcaattctcttgcctcagcctcccgagtagctgggattacaggcgtgcaccatcatgcccggctaattttttgtatttttagtagaaacggagtttcaccatgttggccaggctagtctcaaactcctgacctcaggtgatccgcccacctcggcctcccagagtgctgggattacaggcgtgtgccaccacgcctggccagaaccatgttgttttaaagatgtactttattcctcctgcctctcttaactcagtgttggactaggataaaacatcagaataaacaaggactaatgtcttctcctcccatacaccaccacagtgcctaggcatagacggtggatgtctcttagctcagcttttgttgccacagtttactgctcccccacatcatctagacacttagtttcatttttgttgtttcttgttatttcctattgttacaaactagtgttagaacacttgtttctcccaagagaaataaatagattttctcagattttctctctttttttgttagttcccagaaatgaatgctatgatcatgcgacggttcagtttgcctggagatgtagacagagctcgacagtatgtactacaggtaagactgtttttttaaaaaaaaggcagcagcaggaacaacgtggcaaaatcctttaatccaaaaatgtaacattaactaaacattaaattatagatacaagactgtttggtcaactcttgatgtgacaaaaactgagaagggaaaactcatttttctgattttttattttcatttctcttctagactacttacgaaatgttttgttttaactggtcttaggtaaggcacagacattaatatcttttaaaaggtacctaagtgattgtggtgaactgttagtgttgaaacccagtggtgtggaaccagccttccctgtgtccatcaacagaatcactgggcccccagtcacccagcctcggctccagcctcatccatgtccccatccatgaccccatccgggctgctgctggactgctgcaatagtctactcataattgggctttcctagtccatcctacctgttataaaagtgtgactaaagaaatgatcattgaaaacaataaaccaacacaggcaaactatacatttatataaatgtttttcttttaaagggagaaccatttaaccccattcaggggctagtggcttgctttaaatatattgccacgtatcttcagaacttttctgtggaagccagatctctctgcatgacttgagttttggtgactgactcctgtgagaatgagccatttccaagttcactgtcatttgcagccaacagatctactggatgagtcggagtgagcaaaaaatcattacaaagcaagtgtggcatgagatctgtacttagtgtagtacctgaaagacttccaaataattaccttccagattcttaaaaaatttaaaaagcaaccccaacccctaaaaggttatttttctctcttaactgactatactgttaagccccattattcactacgggttactgccttttttggagaatggtttaaacgtactattaaaaactatggcagggagctggagctgataaagaagtcaatattccctgggagaggttctggcttcagaaataatggtattattgaaagctagagtgggaagtggaactgaaaagagggaagttaatagtagcacctatggaaaatagcaaagttccagcaatcctagccagaaacacatttagaggaaacaaaaatccacgggaatgttctctgaacaaattctccaaaattctagctccctgttcacccacagagcttctaggcctattccctcattaaatatgaatagacaactcagggttacaaataagttgactaaagcttgctgaacaaaagagtgggaccaaaataacagggggaaaaaaaaacaggaaaaacgtaaataggaggatccaaaaagataccacattcacaaaacagtacaggatcatactttttaaatgagtaagagcaagttctaagaaactgaaaatgactgaagaacaaactccaaagaagggctgcaatgtgaaattgtggaaatcctcccaagtgtaaaacagaaagggggaaatagtgaaaaataacaagagctacaaggaccagtaccatcatgtaacaagtatttcaggaagaaaataaacaaaaaagtggtcacttatgctagaaaatggtgtcaaaactggctcaatgaatagcaaagatactggatactagaaggcagtggaggaaggtcttccaagtgaggatgaaacattttaaacctaggatccattaaatccgaaggcaaaagaaagtcaccacacatcaggactaaaatgttgacttcccataaacactattttattttatttttattttattattttattttattgtatttttcttagactgagtcttgctctgttgccaggctcaagttgcagtggcacaatcttggctcactgcaacctccgcctcccgggttcaagtgattctcctgcctcagcctcccgagtagctgggactacaggcacccgccaccacgcccggctgatttttgtatttttagtggagacggggtttcaccatgttggccattatggtctcgatcttgacgtcgtgatccgcccgcctcggcctcccaaagtgctgggaatacagggcgtgagccaccgcgctcagtccccatgaacactttctgggtaggttatttgcagatgtacttcaggaaaacgtgtggaaaacactgagagaaggcaggcttctgtacaaaaaggaacagcaaactaaaatatgtcatgttttgagcaactggtatagaaaatcagatgtatttcaaccacaatgttaggaatattccatttctaaatgtcagaggggtccgggcgcagtggctcacacctgtaatcgcagcattttgggaggccaaggtgggtggatcacttgaggtcaggagtttgagaccagcctggccaacatggtgaaaccccgtctctactaaaaatacaaacattagccgggcgtggtagtgcacgcctataatcctagctacttaggaggctgaggcacgagaatcccttgagcctgggaggcagaggttgcagtgagccaagatcacgccactgcattccagcctgggcgacagagcaagattccatctcaaaaaaaatttaaaaaaaataaataaatgtcagagggatcatgagccatggagaaggaaatagaattatagtatatgacttgattctgcaataaatatttttacatcatagaaatgatactttattagtatttggcttttagaaagaaccaatattttaaaacatggttatagaataggatgtaaatatctatagtctaacaaacagtatagttaaaggaaaggacaagagctcatagaagataaaatctgaagttgatgctacctaacagaagtaatcaacaaaacaactaaagacagcagtgtgatgatgaggcggcacattgtgggtgggctaaaccctcatcttaacaaaaaggtaacaggtaataactaaaattggtaatcaagaaataaaaactaggctgggcacggtggctcacacctgtaatcccagcactttgggaggccaaggcaggcagatcacttgaggccaggagttcgagaccagcctggccaacatgacaaaaccccatctctactaaaaatacaaaaattagccgggcatggtggcacgcgcctgtagtcccagctacttgggaggctgaggcaggacaatcgcttgagcccgggaggtgaaggttgcagtgagccaagatcatgtcatgcactctagcttgggtgacagagtgagaccctgtctcaaaaaaaaagaaaaaagaaaaaaaaaactattggataaagtgagtgcctttggaagaaaggaagctgattttcatcataaaccctctgtactttcattttgttatgtctttattctttattttttaagtaagttttacttgtgttttttttacatttaaaaatgttgtataaagatactttgtacatagaacttctgagaaattctaataagtaaaaattaggggaaaacgaatgactatgtaatattgatgagctagttgctttgcatgctaatagaataaaaatttgcttcaatatgagaaaaaggcctaaaggaagttagcactatgagtcgggaaaagaacattagagatgtagtttgactgttaactgtaatcctcagctcatctgatctcaaaactatgtgttcatttattatagcaggaagttaaaacgctgattcagtcagtgacaggcatctgttctgttttgttctgtatcttatagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaatggtttgtcttgatttaccgtaggagtaaaggtcagaaaaatgtgaagtctgcattgaagtccacatgagttatattttaacagtatccaaaatttcatataggagaatggtttattataaaagactgtacataaaatttagacaacaggttatatacaaattaagagaacaatccacttgaaaaatggaaagtagaaggtagctagctgatcactaatgatactttgtttgtttaaaattaacaaaggcaaaatgcatatgaaatagtcacattgatttggtagcaataatggtctttaattttcagaaataactgttttgcactagtcttaccattcactatgctgttataagtctgtagcatccagtacataactgtaatttgaattccaaacaaatcctcaataacacagaaacccacacttgagtgctctactttaatatcctaagcaatagagaattatacacaagacaagaagagaaaacatccctcagccctcccttcaattaagaggagacacacaaagtgcatgtgttgcattttgattatgtcaaaagacaatccaagtctgttggttaggtaaatctctgttcactgattaatacatgacccaccttctttcccaattattttattttaaaattctaatgttgctagtgccaggtaatggattaaagagtgcctactcacaaatcaactgtatccacttttacaatatgtaaaaggtacttttaacttcctttcattgaaccagtgtacaacagttcactgtacaactgaaggactgacatggcaatccttaagaattttacctacagaatgaatgcacacaatttgacacattttcttagtttcaaaagattatttaaaaaaggaattcagtagattgacttgtaaataaccattgcagattttgaatctgcaaaaatccgtcacattgctgttgggacagattaagataaggctaaaatttttttccaagttaacatattgagaaaatagaatcataattctgcaataaatcattatcttttattttttttaaagcaaatcagtgaaggaaaggacaaaaacctttggttcacttatgtatttatgaatggaaaaagtttataatgcaaatttcactcattaaaaaacttaggtacaaattacaacattacagataattctctttttgcttgtttcacatggagaccttggagactcaattcacgttaagacacctaagtacgagtcctccaggtaaatattacacaaatgggaagcatcttgaatttttaagtatatttcaatacataaatttttatgcatgctttaaacaaacagtattttttttaaatgagagaatctaacaaaaaaagtctgaccagcaccagcatttaaattttctgattttaatattagtctgacatagcgttagtaaccatgctgcactgaaacatgtaatggtacaatctgaatcatgattcgttaaatattataccccacttcccccagaatatttaggctggtcataaagttaaaaatgtgtaagtaagtacataagcataatcagttatggacagcttcttgtataaattgctattcagcaatacataaactgcctcaaagatttatgcttacaggtagacattcaatttaccaataaaacagcatgttctgaaaatatgggcacattttaaaacatattaagacagttctgttaaccataatagtcccacagtatgactgagtaataagaatctacttcaaaagaaaaaaaaaaattaatcagtatagtgcatgattgattcaacatagttcccagggaacagaccagtcactcgattgcagactccttcataccagccatcatcattcttctttataacataaatgattgcaccctccataaatgacagctcatcatccttgtcttttgtataatcatatattgcaacaactatggaaaaaacagttgaaatatcacatgagtgcactatatccaaaatttac

SEQ ID NO: 13947 - DNA, 32655 bp, Human
  misc_feature (1)...(32655): n = A,T,C or G
agtggctgactccagccggtcgccgagctgaccacgtggtgctgggccggccacgtggtgcagccgcgtttggacacctggactccagagcgtcacagctgcgcaatgaatgggagtcagtgttacccgcttactatctttgttcatttattcacccacccatctactcacccacaaatgcattctttcatgcagtgtgagacgtttgtgagtatagagccatttgtagacagcaggtgcctaatattcattcaatatttattgcaaagcagccataaaaaccagcaaagtgtctactctcattattttgcattggggtagacggactataaactaataaactagtacataaatagagaaacaaatttcacagcaaacactaagaaaaaaaaaatgaaggtagtgtgattgtcactgggagctaagtcgcatgggatgggtaggaaagatcatcctttacatttggatttcaaggataggaaagtccaaacggaccccaggcacagggaacagcgaaaatgaacgccgatgtaaaattaatcttggtgttgctcaagacatgtgatgagacatttccaaggacgacagaaaactgatcaccatctaagttacagttgccagaaatgttctcccaattcattttcgtcctactcaaaatacatgcacgattaatggcgtggattattttaatttcttttgcagaaataaaggaggtgaggccggccgtggtggctcacgcctgtaatcccagcactttgggaggccagggggcagatcacttgatgtcaggagttcgagaccagcctggccaacacggtgaaaccctgtatctactaaaaatgcaaaaattagccgggcgtggtgcgggcatttgtagtcccagctactcgggacgctgagacaggagaatcgcttgaacccgagaggcagaggttgcagcgagccgagatcgcgccattgcactccagcctgggcgactgagcgagactccctccagcccctccaaagcaaaagaaaacaaaacaaaaacaaaaaaagggaagaaaggaggtcggttgttttggtttttgccagtttaattgtagtacattgttttttctgggtgccctaacagttcaagacagatggttcaagatgttttttgttttaacccacaacactgcatgtaggtcaggctactgcactgttccacaacacctgttatttgacatgaatccgtttacttgcttttgtttctgacaaaaaaaaaaaaaaaaaaaaaacttggcccggcgcggtggctcacacctgtaatcccagcactttgggaggccgaggcgggcggatcacgaggtcaagagatcaagaccatcctggccaacatggtgaaaccccctctttactaaaaatacaaaaattagccggggtgggggctggcgcctgtagtcccagctcctggaaaggctgaggcaggaaaattacttgaaccagggaggcggaggttgcagtgagccgagattgctgctactgcactccagcctgggcgacagagcgagactccgtctcaaaaacaaccaaagcaccaaaacttctggttaatttaattgattcgtcggattcagatgctggaaagtgggcctgggatatacagtaagcgatcaataataacactggcccaacacacagctataagaagcgaggcaagtacacattaacgcggtagcctgaagcccaagcgaagtctcagcgcaatgagccgcgcagaggctcagaggcgtcagcggcgtgcgcggtttccaaggaaaccgtccgtcctagccaccccagcggctctggaatggtagagcaagaggctccgcccacgcaccgccgagaccaataacggaccgggagggttacggcgagtgcgcagagggctccagcgcactcccggccctcctcctttagctgtgggcggggctcaggggcgcgtgcgtcctgccctccctgtgcgcgcgccgccccagcatgccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcaggtaccgactaccccgctcgccggacccgggcgtcccctgcaccctcgctcctcccggggtcgcgacttgggcctaaggctggagcgaagcgacccccgagccaccctcggccgggctggaggggcagcgggggaggtggacgaccctgctctctcgtttgccgaatgaatgaaccagcttttccagcgcttcattcattctgcaaagttgatggcgcttcccttccggatgggtcgggccccgtggcggaccctggggaggccgtgatttaacgactccagtcccgttttcctggaattctagagccacagacagacattcaaaaattaaataagagaggatcgaagatagggagggatcggtgctctggtgcagataaacacgaacggggcagtcccagggacacgtttttagagagagggtggttcctggggggcttttctgaagaggtgagcgtcgacttgcttgattgggagaagcaagtgtcctgccaagaccggggaaggaggcgtcccgggaggagggaacgtgtttggagagcagaaagtcagtttggctggaacgtaacgaggggaccttttaattttgttatttatttactttgtctcccaagcgggagtgcagtggtgcgatcacgactccctgcagcctcgaactcttggactcagtcaatcctcccgcctcagccacctgagtaactgggactacaggcctgcaccagcacacttggctaattttttgtagaaacgaggtttcgccatgttgcccaggctggtcttgaagtcctgggttcaagcaatccacctgcctcggcctcccaaagtgctgggattacagacatgagccactgtacccagccaagacccttttaatttagaggtaaaggggcgatgtgacctgtgtactgtttatttatttatttgttggtttattttttgagacagtctgtgtctcccaggctggggtgtagtggtgcaatctctgctcacacaggctcaccgcaacctccgcctcccgggttcaagctatgctgcttcagcctcccaagccgctgggatttcaggcgcccaccaccacacctggctaatttttttttttttttggagatagagtcttggtccgtcacccaggctggagtgcagtggcgcgatctcggctcactgcaagctccgcctcccaggttcacgccattctcctgcctcagcctcctgagtagctgggactacaggcgcctgccaccacgcccagctaattttttttgtatttttagtagagacggtgctagccaggatgatctccatctcctgacctcgtgatccacccgcctcggcctcccaaagtgctgggattacaggcgtgagtcaccacgcccgtcacacctggctaatttttgtattattagtagagatggggtttcaccatcttggccagggtggtctcgaacttctgacctcaagtgatccgtctgcttcgacctccgaaagtgctgggattacaggcatgagccaccgtgcccggcctgggttttagaaggtcactcaggttgttgaagcaactccttgcctgatccttggcttttctcttgcccagccacactcccccagctctttgtccagcccattgcgatgagggtgataattgtaataatgataatcagggatattcaggccttgggaaggaaggaatgttgtctgccttgtttgctactggatccttggcacaatcagtaaatatttacaggatgaactgacgtccacaagtttttcaaatcctaactcctgcaggagaattttctgacagttccagttcccatccatctccatcctttctgagcccctgaagctcttctttaccccacggtttaatgtagatccacagtcccttttttgcagttctaaaatcctaaatactctgtaaactgaaaggtttgccttaagtttacagcaaagtcatttggccagaaaatgacctcaactgaccgactgagagcctttctttttcccacttagcgaatatcattgattctcagctggggtgattgtgctacctctggggacactggacggtgtctggggacatttgtggttgtcacagttggggggcgctcctggtatggaatggatggaggccggggacgctgctcagcaccctgcagggcccaggacagctccaccccagaaaacgatccggccccaatggccacagtgcagacagagagacaccctggtgcgtattcctgcatctcactgcagaaagagtaatttgatttcggagtgctgcctcagcctccctagtgatttggaatacatggcacttggactctattaatactgttctacaatggggggaaattctgaatgttaaaatgtccccggccccaagactttttggacaggagagcatggtctgtaataacagctacctcttgaaaactttctggtggtattcaggatacaagatgttttgccttcatacctcactgaattcttagacagttcttgttctctgcaccctgaattgttcccgttttgcaggtgggaagcctgagagttaatgtttcttgccagaatcccagaactagcaactggcagaggtggggtccgcacccaggccatctgacttcagcttctgcgttctgagctagcttgttgtgcctgccccagcctttgtaaaaatgcacatctgattgttagtgccactgtcccatccccttcctgtccctttccagggctccaccttgcactcaggattgaagttcaaagccttcattgtcatctacaccaggagttggcaaactccagcctgcctattttttttgagacggagtttcactcttgttgcccaggctggagtgcagtgctacgatctcagctcactgcaccctccacctcccaggtccaagcggttctcctgcctcagcctcctgagcagctaggattacaggtgcctgccaccacacccagctaatttttgtatttttagtagagacggggtttctccatgctggccacactggtcttgaactcctagcctcaggtgatccacccgccttggcctcccaaagtgttgggattacaggcacaagccacagcatccggccaagatggagtcttgctttgtcgcctaggctagagtgcagtggtgcaatctcagttcactgcaacctctggctcctgggttcaagcgattttcctgtctcggcctccagagtagctaggattacaagcccgcaccaccacacctggctaatttttgtatttttagtagagacggggtttcaccatgttgtccaggctggtctcgaactcctgacctcaagtgatccgcctgccttggcctcccaaagtgctgggattacaggcgtgagccaccgtacctggccaggcctgcctatttttgtacacccctggaactgaagatgatttttggatgagacagaaaccatatgtggcccacaaagctgaaaatccttggccctttgcagaactgtttgttggccccctgggtcctctgcagaactgtttgctggtcccctgggtcctctgcagaactgtttgctggccccctggaccctctgcagaactgtttgctggccccctgggccctgcacggttaggtgtttccaggtggttttgccaccttctctgtgccgagccgcactgacttcacatagtcgcccttcccgcagctgctctcgctgccaggagcccccgcctgccattcttgttttcaggctccatttacccgtttctcagagaggccctggtgtgagtggccgggccacatatgactcgcccgtagcacctgtgggtctggcacgaccacacgccaggctgactttcttgttgagttcatgaatggaggcctgcttgttccccccactgggtgtggggtgtggaagaagcagacagaagaagggactcctcccgaaaaccccccgatacctcacctttcccctctggcatggcaggagttgagcagtgcgtgggtggtcctggacttccccttttgtgaacacccaggggtttgtacaggctgatctgtgcatggtgtctccactctagggcagggggattttttttttttctctttgagatggagtctcgttctgtcgcccaggctggagtgcagtggcgcgatcttggctcactgcaacctccacctcccgggttcaagcaattctcctgcctcagcctcctgagtagctgggattacaggcatgcgtgccaccacgcccagctaatttttgtatttttggtacagatggggtttcaccatattgttcaggctggtctcaaactcctgacctcgtgatctgcctgtctcggcctcccaaagtgctgggattacaggcgtgagccaccaagcctggccgggcagggggatttttaacagcagtatcatctctattccgggctgatcgttctctgctggggccgtcctggtcactgcagggtactaagcaggatccctggcctccacccactccacgccaggagcatctgcaaccgcgacagccacatgtgtcctagatgtcacccagggttccctggatgggattgatggcagagtagcctcctgctctagaggactggtcagtctgtgcttccctacaagagccctggacctcactcttctggatgagaagcgggtgatcccttcctttccctctgccctcctgactttgaccctaactgaaccgaaagcagacccgcccggcactgggttttgtttctgcgtagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacaggtaagtcccaggcagggtctgtgcgtgggccgcaggtgccgagggaggtggcaccgcaggcgggagtagcccagcccgtggagccggttcagaacctggcttgaagtgtcaccagcaccctgcccctgagcacagggcagcgccacctgctcccaggctggtcgtggtggctaaatcagatggctgggcggaagcgtctggcaggtgctggtcactagaggtgtaggagagaggcagttcctcccgtgctccgctctgcttcacagcctcgtccattcaaaggactccctggttgtgtgatctgagagccggagatgagaaaatatgtctaaacagcacgcctctccagcctctcccagagccagcagccttgaaccctgaccccgtctggcctctttccctggcccgggaaggcgggtatttgtttctctctgaatgactgaacttggcccccttggcttctgcctctgcgccctccggcgggggtgacctcatgtcctcgggcgtcctcctcaccctcagcccgatcctcctcctctccttggggtccctgtgctcacggtgaggagtgaggtgcctagtgacaggggttagggacactgcttcccgagctctgcctaaggctgacagtgtacctgcctgaccaagagacccagagagtctccgcagagagctctgagtgaggcaactccccacccttccatctagcggaaggcctttttgctgggaaccatcgagaatccttgagttcaagcccagggcttctctcgtgttcccaaggcatcccctgaaagggttggcctccgtggcccatgccatgaggcctccagagggtttgctgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctccttggccacgtggtggccccttgtccctcccgtaggagtctcatgaggctcaggtgataccagttccctcttatggcgcccagcggtgccaggcatcatttcccccgcccgtgccccaccttcccctcctgcggcctttcctctcctccttcacatggtggcgagactagcattaaaggaaactgaattcggccccagtgctcccctcggggcctttccgcttccctcagggtgacgcccagcatcctcggtgtggtcttcagcgccctgcaccgtctgtgcctggacacccagtctcctcgtgcctggcaccctcccccagccagggcctctccagccggcccctcgcgcccctcgccctgtgctctgctgaatgcctggcttctctctgatcacagattaagtccacttcgcccaggagcccttcctcctcctcctgtccccatgccagctgcctggattagtccctgcacggtactgacactgtcgtccctgcggtcacttgtctaatcggtcgcccgtaaatcccgagaggacagagctgattttctttctgtcttcagccctagcgtcaggcctggcccagagcccccactacaggcttttttgttgtttttttgagacagggtcttgctctgtcacccaggctgctgtagtgcagtagtgtgatcatggctcactgcagcctccatctcccaggctcaagccatctttaatttttggtagagatgaggtcttgctatattgcccaggctggtctagaactcctgagctcaagcttcctgcctgccttggcctccaaaagtgtggggattacaggcatgagccaccgtgcccagcccaccccccctctaaacacacggagcctcctccagacgtgcggagcctcctccaaacataccgaggcctggggacatttctgttgacccagaactgaggtagtgaccagactgcaatttgaattcaggtctttctgctgcaaagtatatgctttttttaaaaaaaaattattattattagggtttttttttgtttgttttttgtttttttagaatgagtctcgctctgtcacccaggttggagtgcatggtgctgtcatggctcactgcagcctcaacctcccaggctcaagcgatcctcctgcctcagccttctaagtagctgagagcacaagtgtgtgccaccgtgcctggctaatttgtttttttaaactgctccattgagatatgatttgcataacatacagttcacccatttaaaccacacacttcaggctgggtggcggctcacacctgtcatcccagcactttgggaggccgaggtgggcggatgacttgaggtcaggagttcgagaccagcctgaccaacatccagaaaccctgtctctactaaaaatacaaaattatccgggcgtggtggcgcatgcctgtaatttcaactactcgggagactgaggcaggagaatcacttgaacccgggaggcggaggtggcggtgagccgagatcacaccattgcactccagcctgggcaacagcagcgaaactctgtctcaaacaaacaaacaaaaaaaaccccacacacttcagtggtttttaataaatttgcagcattgctcagctgttaccattctttcattttagagcattttcataaccccagagagaaactttatacccttaagtggtcacgctccatctcccctgtccccagccctggcacccacgcgtcccctcctgtctctgtggatgggcctgtcctggatatttcgtagaaatggcaccacatggccgggtgcagtggctcatgcctgtaatccctgcacattgggaggccgaggcagatggatcatgaggtcaggagttcaagaccagcctggccaacatagtgaaaccccatctctactaaaaatacaaaaattacctgggcgtggtggtgggtacctgtaatcccagctactcgggaggccgaggcaggagaatcgcttgaacccaggagttgaaggttgcagtgagccgagactgcaccactgcactccagcttgggcaacagagtgacacttcgtctcaaaaaaaaacaaatggcatcacacactgtgtgacttttgtgtctggcttctttctctgcatgtgacatcatcgggctgcatccacaccgcagcctgttccagagcctcattccttttcatggctgagtcgtgttccactgggcagaggccacatcttgtcagtccattcactcgtggatggaccttttgtcaattgtgaatcgcgctgctgtgagtgcacgtgtgcagattcctgtgtggatgtgtgttcatgtctcctggctggatcctggcactggagtcttgggggtcatgggatgactccattttaaagcttttttttttttctttttttttcttttttgagatggagcctcactctgtcgcccaggctggagtgcagtggtaccatttcaactcgctgcaacctccacctcccgggttcaagctattcccctacctcagcctcccaagtagttggaattacaggcacgcgccaccacgcctggctaatttttgtatttttagtagagatggggtttcaccttgttggccaggctggtctcggactcctgacctcaagtgatctgcctgcctcggcctcccaaagggctgggattacaggcttggccaccacacctggcctaaagcttatgcttttctagccactgacacttcctctactcaacctaaagcacagatgtgctcaggaaattgtaagtagtttatgcatttaaatgtgaccatcggcagctgcagctctctctggaatggaattccgtcagcctctgtttcgtcgtacccagctctgttgggtcctccttggcttggagggctttgagttgaatccttatttttcttcggtctgtaagatctccaaggacacaggcaacagcacctcctttctccatcccagggcccagcctggaggggacggtggcgtgtgcctctagtcccagctacttgggaggctgaggcaggagagagttcacggggggattcagcagacaggcctgggagaggggtccgggcaacacctgccagttgtactggggcctgttctcacacctgtctccctggtctcccctgttttagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggtgagggggccctgcggggagtgcaaatagcctcccaagtaactaggattacaggcgcccgccaccacacccggctaatttttgtatttttagtagagacggggtttcaacgtgttggtcaggctagtctcgaactcctgacctcaagtgatccgcccacctcggcctcccacagtgctgggatgacaggtgtgagccactgtgcccggcccattttttgtatttttagtaggcacagggttttgccatgttggtcaggctgttctcaaactcctgacctcaggtgatccgcccgccttggcctcccaaagtgctgggatcacaggcctgagccaccacgcccggccacacatgtgcactttcatttcctttcctggccatcctagtgtgacccaaacaccccatccccacatggcgtgagctggcagggcctggcggcatggctgcgtgggctcctgctcccccggatgctcctcgcagtatgcagtggggcctttgctgttgatgtcacatgatcaggagagacccagagaccctcctgctgctgttcatcctcttaggcgaggacccctgggaatgtgctgatgtgtcccacagtctcaggatcatgcagccctagtgctttggtaaatccagatcagggtgacccatgatagccgtggattgttatttctttttatttaaatacagacagggtctcacaacgttgcccacgcttgtctcgaactcctgggcccacgcaatcctcccacctccactttccagagtttctgttgagacaatgagaggttcccatgcaggtgcaggaaagaatcgaatgcctttgccaactttgcccaggtccccagtgatgacgttttgcaaaactatggtgtcatctacaccccgataccgacctggagaccaccagcaatctaattcccattcagccatcgcactggtgaaggagctctggactgatgtcagtgtggggctcttccaaacaaagcgaacgtttgcacaggttttatgtagagacaggtcgtcatttctctgagataaatgcccaggagtgcagttgccaagtcacacgggggccggatgatcaggtttttaagaaactgccaaactactctttggagcggctgcactggcccacgtcctacatgctttgatgtttttattccaggagaaagttcagaaggactcactgaggcccgaggctgcgcggtacctggagcggctaatcaagctgggccggagaaatgggcttcacctccccagagagactcaggaagtgagtgctgggtgtagggagtgctgggcgtgggcaatggtcgatcccggggagtgctgggcacagggagtgctcagtcccagggagtggtgggagcaagaagcgcagggcagggggagtgctgggctcggggagtgctcggctcagggagtgcttggggcatcaggagtgctgggttcagggagtgctgcgtcccggggagtgctggactcagggagtgcttgggcacagggagtgctgggtgccgggagtgctgggtgtgaggagtgctcggtcccagggagcactgggcatggggagtactgagctcagggagtgcttgggcttggggagtgctgggtggggggagtgctcggtcccagggagtactgggtgtggggagtgctcagtctggggagtactcggcatggggagtactgggcacggggagtgctcagtcctggggagtgctcagttgcggggagtgctgggctcagggagtactgggtgcggggagtgctgggcgtggccagtggagcttctgtggccccctgcccctgcctcctcgggagcgtccccccttcagggctgacccccggcctgatgtccatctttcttctgcctgaggacctgaactctggcaaggcaggtccacacagacatggggcgcagaggctcggtaacgaggggagcccctccacccactgcccggtgtgcctgatgtgggcgtctcaggggtgacatgagttagttggtgcagagctgggagcgcagcgctgaagtcaagcgtagtgtgttagcagaagcccagtgttcagcggcaccaacagagcagtggcgaccgccactggaaagatgcgtgtcacagttcccaggaactggcagctcgccacatgggaagcatggctgggtcaggaggtgtgctctgggcagggccttcgctggggtcccttgtgaaggcatgggtgtagcggggagtgggctcagggttggccggctggaccatctcagccagccctggcatgggggctgcccctcatcgggtgcctggccctagggtaatgggggccggtggatggtgccccagagtgtaggggctcgagactagttgatttgcacgtgaaagatgtttgcaggcgagctgttggctgtctctgggaggggccatttctcgagggccagcaaggcacccaaatgtcaaagcatcagaatacaggcccctgattcaccatggtgtgtgttcagtagaaaccgtgcttggaatgctgatctttccgaggccggccacttgggcacttgctgtcctgtgacgctgggcgccagccacagctaccagctagcctgcaatgacgcaggcaaactgaaaaccgaagttacatgagatacccaacacctcatatccgatagcctttgccttcggcgatctcaccagaatgtgggctgctgtgagttcctgagcacgcttaagacaggccaggttaagctgtgatgttcgctcctattaaatgcatttgtgatttatgatattcacaactcacgatgggattattgggacatacccctgtcctaagtcagggagcatctgtacaggaaagaaagcacacagttcaatcaggtcccaggctgcagccatagccccatggctgtccctgttccggttccataaagccaccgctgtcctggttagggggcgtctccaccttatggctgaggcaaccaagactcagagaggccaggtgggtttgtcagtgaaaccagcactgacgaaagcggagtcagggtccgtctcagtactcggggactgggggtcctcagctcagccgcagcggacaagagccagttatttttatttttatttatgcatttatttatttatttagacagggagtcacactctgtctcccaggctggagtgcaacggtgtgatctcagctcgctgcaacctctgcctcctatgttcaagcgattctcctgcctcagcctctggagtagctgggattacgggcacccgccaacacagctggctaatttttttttatttttgatagagacagggttttaccacattggccaggctggtctcaaactcctaacctcaagtgattcacccgccttggcctcccaaactgctgggattacgggtgtgagccactgtaccacagttatttttaaaaccccttcggcttgttgcatgcccagcatgtgtggccatgtgcatggtagaagccacaaactctcccacaagggccagcaagcaaggagggagcagaggcagccccgcctggaggacagaagcgcggaaaaggtgcgaggtccggatgctggcgagcagagttccagcgcgtccccgcggcccttagggccagcgctgtgtgctcattgagtctccagagccttccctggcatggctgggtttgttatgtgagatggcaagagggggagacattgggaattgcccagcatggggcctgttcccaggagaggcccagcaaaccctcagctggttctgaaccagggccttcctgacaagatacaggctccctgcaaagtcctgggcacagtttccccctgctgccgccctctgtcctgcggatgagcatttctgctctggccccatggagctgggctccagacccgcctggcggagcttccagcaggagaatctgagtcaaagtacagccctgctgccagcctgtcatgtgtcatgtggcctcaagccaggtccttgtcacatagtggtcacctcccagccttcaaggccaccagagggaccactcaagattcagttcctttgttgatatcccatatcaccagggtcgagttttagctgtttctaaaaccagctttaccagataaggggtaaaatgttcaaaagctgccagacacggtgactcatgcctgtaatcccagcactttgggaggctgaggtgggaggattgcttgagcccaggagttcgaaaccagcctgagcaacatggtgaaaccccgtctgtaccaaacatacaaaaattagctgggtgtagtggcgtgtacctgtagtcctagctactcaggaggctaaggcaggaggatcaattgagttgggaggttgaggctgcagtgagtcgagatcatgccactgcattccagcctgggcaacagagcgagtccctgtctcagaagaatgttgaaaagcttaggctgcaggctctgaaggtgattccttaatggataggagggtctggagcactcttggccagggccacacctgacagaccggagcacatccctgaggttgcccgaggtcacccagctttggatgccgcagctggtgttgaaatccacactgcgcagcctcgtggcctccgtgtctgtctgtcctccgcctcccgtctcactctttcctcctcggttgcctcttctttcggcctggttcttggggaaatccctcagccctcggcgagagggttcccaggcgttgcgtctccccgcggagcccgccccggtctctccctcccctcacgccccgcctttctctccagaacatcaaacgcatcaagaagaagctgagccttctgtgcatcgacttcaacaagaacctgaacgaggacacgaccttcctgcccttcacgctccaggagctaggtaggggccgagcagtggggcacgggtggccatcggtcctgggactcagtgcaggcctgccaggccctcgggggccgccgcttcctcctgtgggcttctgtgctgaagggcggcgggaggccgaagtacgtggacctgaccgccctgggctgaggactttcctcaccggaagcgctccagggccgtttacagccaaaagctctgagccctccttggggagggccatggtctgtcccaccaagattccaccctgatagaaaatgtccctggcagtggcggaagcccaggccggacggggtggccaagggtgccagtctcagccatggccctgagggaaccacaattttcccttgagaccccacttcctgcctgcctttatttatttaatttaattaattaattaatttattttgagatggagtcttgctctgttgcccaggctggagtgcagtggtgcgacctccactcactgcaacctccgtcccccgggttcaagtgattctcctgtctcagcctcctgagtagctgggactacagacgtatgccatcacacctggcaaatttttttatttttagtagagacggtttcgccgtgttggccagggtggtctcagactcctgggctcaggatctgcctgcctcaacctcccaaagttctgggattacaggcatgagccaccgtgcccaggcaggccggaatattctgatgggtgctatagaatataacctccagttctagactctgaatgtagttgcctctgaggtggtgggtggggacaaggccctcatggccggaggcctccgcaggtggcttgatgtgtggtcacctgggcgtatgtttcctgagggaacactcgcaggtcgggcactgccaagcttggctgccagccacttgctcagccctcccgtgtctcgggcagcacatcctaccctcagcttctggcactcaggagagacgacgggctacaatctgccgtaaagcacgtttcccagcctgcccctcagtgggtgcactgatcacccgcaccattcccgcagccacccacgccatcccgcggccacccgcaccgtccccgcggccacccgcaccatccccgtggggctgcttctcctgcctgctcgtgttagcaagcagaaggactcggtgcctgatgttctagaagccaatgccatggcaccaaggatttgaggaaacaaaagcttctcattgcaagtgactcccaaggagactgggcgtccagctcaaatctgcctcctgtgccagctttcaggcagtactttcatgagagaaggtgcagaggtggattctgggattagcaggtgattgttggaaggaaaggggaggtctggaaggtccttgggcacgcacagttatctgtccgtgccagctcgtgggtcctgggtgtgaatcctggggaagtctgtatgaagcgcggtggaagttcagttggcatcagccagctggttctgcacagactctgctggctcatgtgggttccagccggtttcagccagttttgttcttgtcggcgtttcagctgcctgtttcttttcacgtttgccatcctgcaaactcgaatgtttgtggattttggtgtctaactctttggggtgccgttccatttgtcgggcctgaggggtctcccgtgcaggtggcttgagtcccatgtggccaggtgacaccgtcatgcgggtggctagcgtgttgggtgacagtctccagggctgtccgctgctgctgccccgggacctgtttccctttgtggtccgtcatttctcaggagacgccttgcgatggtcttagttccttttcttctgcttacaacagaaaacctaaggccatgtagtttataagaaaaggaattaacttgtcacagctctggaggctgagaagtcccaggtcgaggggccatatctggccagggccttcttcctggtggggactctggagccctgaggcggccagggtgtcacatggcaaggggagggggctaagcgagccggttccacccaggtctctcctcctcacaaagccccaggccctctgccacattaacccatctgtcccttcatccatgaatccatgaatggattcatccattcctgaaggcagaggccacatgacccagctgcctcttgaaggccccagtacctaatcctgccatctcccaataccaccatctccaacaccgccatctcccgatacccacatctcccaatacccacatctcccgataccgctacctctcaataccgccacctcccaacactgccatctcccgatacccacatctcccaatactgctacctctcaataccaccacctccaacaccaccatctccaacactgccacctccaacaccaccatctccaacaccgccacctccaacaccgccgtctcccgatacctccacctccggacacccccacctcctgacccacccacctcccaacaccaacacctcccgacacacccacctcccgacacccccacctcccaataccaacacctcccgacacccccacttcccgacacccccacctcccgacaccaacacctcccaacaccaacacttccccacacccccacctcccaacactaacacctcctgacacccccacctcccgacacccccacctcccaacaccaacacctcccgacacccccacctcccgacaccaacacctcccgacaccaacacctcccgacaccaacacctcacgacacccacacctcccgacaccaacacctcccgacaccaacaccttccgacacccccacctcccgacaccgccacctcccgatacccgcatctcccgacaccaccatctctggcattaagttcctggtgcattttggaggggacgcacccaaccagagcagagacctgtgagtgtccatcactcgcacattgtcatacactagttgccatgtccatggatgacttctgccgccctcaccctctgggcatcagtcatcctgccgtgactccgaaccttccctccttgcctgtcttcttactgatttgtttctgtccgtgtgcatgaggcttctgtcttattcccgggttatcattcattatcatttatcccagtgctcaaatcgtcccacatggaccctcaggagtccctccgaacaatccctgtgtccttgtaatgcacctgctgtcctctgaacctgctcttactgtggggcacatggtaccgcaggctcggcctctgagcccgcgcttactgtggggcgcgcggtaccgcaggctcggcctctgagcccactcttactgttggacatgtgatgtcgcaggctcgtcccatgctctccctgccccagccctcagatgctccatttcttggaggagacctggcgcctttgagtggagggtgacttaggcaccggatgtgttcaccactgccagggagcagcattcctgggcaccgttaacagttaggaagcagacacgcatctctgcaccacacatggacacacacactcttctattctgtgtctgtatatcaaatccacaagtgcagcggggcatgccggcacacacctgaggtcccagccactcgggaggctgaggcagggggattgcttgagtctgggagttcagggccacagtgaacgtgaactatgcattcgtgaactatccattgcagcctgggcaacagagcaagaccctttttctaaaaaaataaaaacttccaggagtccactttgcagcttctcttccagtccagcgctgctgggccccccagctgtctcccttgctgtcctttaactcccgtctccgaccgccagccgtcactcctgggtgacacactgtcgagatggggagctgctgtttgaaggcccgtggtccttggaaaggacgatgtgcaggtcccgggaggcctccccctcatgctgcagtcactcggcagacaattgccaggcccacgctggtgctggggtacaaacgggaaggcgggggctctgccggccacaggactctcagctccctcatcaccacccacacccacgggctggcctcccaaaatttcccccatctgcctctggccccccaaccggatcattctttccacccttgcctccctggggtccccgtgagctcccgatcattctttccacccctactgccctggggtcggggtgagctcccaatcattctttccaccctgaccgccctggggtcggcgtgagctcccgatcgttctttctacccctactgctctggggtccgtgtgagctccggatcattctttccaccctgactcccctggggtcggagtgagctcccgatcattctttccactctgaccgccctggggttgaggtgaaccagtctttgcattgaagctgcaagcctgaggcacggtggccctggcgtctcccgagccatgaggtaggaaccccagagggtttcagtccgggatgctgccgcccccacttctcttgaggctgtcgggcaggggccaggtgggagggtgtggctgccgggcagcggggtgaactgtgtcctgccaggggttttgtgggtggagaagggacagcagggctccagtgagaagctctgggagtaggaattgggtctctctggagggacacacttgaaagtggttgagccgtggggctgcgtgctgagatctcagctctgagcgggaggctctgcctgggggtggttcttcaggaaaagcaaagcaggacctccctctccacgtggggcctccctctccgcccagggcccagcgtgctcagctctcctgctgtttttgtctttgatgggaggcactgcctctaacgctggtttccttgtgcagtggccgggccacccttcccgccaccctcctcccttcacacatgaggttggtgacggcgccctggaagcccacgatgtccgggggttgggctggatttagctttaacctctctggggcaggagatcctgctctgaggatgctggggggtttcctggtggggttagaggcgggacgtgagaaacgtggcaggtggtggccaggctgtgggggagccagggtatttcttgatggggttagatgggggatgtaagaattgcagcgggtggtggccaggctgcagctgctcgctgagggcccccttgtagctttccaggcagaggggaagcccaccccttccctcacacgctgtgtgcaggctgtgggcccatcagtcctgtcaaagccaccctggttctgtccccataggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggtgagaaggcacggccagggggccccagaacagtgggtctggagcttgtggggcccgtctgctccatgtgtgtgaggcacctccaggctttgcacttggatggcctcccaatctccctggccaggcccagtggccagcagaggcctccctgtggggctctgccgtgccctggaggtgtctgtgctgggctccacccagaccctggggccacagctcagggcccagttcatccttcccaagctgagcctcctgctgctgctctgagcatctggccgcgcacacgtctcgtccctcccttatctggagccgcccctcaggtgtgtcagcccagatcattccttttgtcttaaatgatggtgcccggacctgagcctgggtccacaggtgggttgtgactgggctatctcgctgtgactggcgtcagacggccgttcccacagggacacatgtaactgtccacggcgccatggtgtggtcggtcaggtggtctctgcacgtctcccattcgccatctggaacaggcagaggctctaggagtgggcctcttggtcccctgacgacaccaagttggtgcttgtgcggctggcaaaagggggatacacgctgatcactgcaaagggatgggcgggcactgatcactgcaaggggacgggcgggtgcccatcactgcggggggacgggcgggtgcccatcactgcggggggacgggcgggtgcccatcactgcggggggacgggcgggtgcccatcactgcggggggtgggggacgggtgggtaccaatgggggtacaggtgggcaccgatcactgcaaggcaggggggtgctcctcgctgttcagggaccgggaactcagtctgctcagatggggcgtggcctgccctctacatgttggctatgaattcatgttgctgttaagcctaagtaggtggacccgtggactgggcacacctcgacttccccactgcgccttagaaggtcaactgggcaatcccgtcctggtccccaggcttgggtcctagtggcagagtgagggccaggccaagagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcggagcccgtgagactgggaaccaaggcctggacatggaggtgtccccacatgcagcagtgatgccctcggaggctcctcggacagcccctggtccccataccacgttccgtgtgaggccttagagtcatctgcaccccttctggttccaaaaaggccttgggattatgataacgctggtggcatgaccagaggagttgtgtagtaacacaggccgagaggggcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccacacgcacgccgactatgtcctggagatgaacatggccaagaccagccagaccgtggccaccttcctaggtagcccttccttcctcctccactggggtccctgtggggaaggttctcagggtcaccccaggggacagtcggtgctacccctagagccttgtcctttccctccatgaagagggacttctgacgcctgccctggctccctcactccccccgagggacccttacagaacagggaagcgcccgggccctggggtcagtcccatgcttgcacccggccccgccgccccctcaccctgagcgtgaggatgctcggcccctcgaggggttgccgggaactgcgggtcctcccttccaaatggggagcctgacgaagtcgcggccgcgggcaggcgagcccagagccatggaggagcccgcgaggcgagaggcccacctttctgccctccccgcagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcggtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggtgggtgcgggcccgggcaggggcaggggcaggggcaggggcaggggctgcctgtggtcagcgaggcccaagcctggggcttcggcttccggctctctctgcacccgtccggtggctccttcatccaatgccacccaaagatggtgactccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcaggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggtgcacccgccccgtccggggaagggtgctaacctcggggggcggcacacagctggggcctggcatgtgccccgggtgggggtcggagctctgggcagagtgggccggggcaggtgcagaggccagctctctccttccctcccgcccaggcctcttcaacctgcgccagatcgtcctcgccaaggtggaccaggccctgcacacgcagacggacgcagaccccgccgaggagtatgcgcggctctgccaggagatcctcggggtcccggccacgccaggtagccacccttgagccgggcacaccctggaatttggagcctcagctgcttccctgggaaggtgaagggagttggtccccatgcttcacttagcaagtgcaggagtccctgctggggagccacggagcgcgtcccaggctcctcgggggacagccccagctgagatgcagctgcaggcccagggtcggggacgggtgtgcggccccagcccccaggaggagtgtgttccctggagcctctgctttgaatgaagctggcgttttcctgattgaaatgtatgacacatgctttgtaaaaagcctggagaagtacaggaaggcctaggaatttccgatcctaatgatgagaagtgggccctgtttccatgctcacctgttgtcctgtgtgcatgtgtgttcacacacgcttgcgaggatccagaatttggaaatacagcatgattttaacatgggtggtgttttgctggcttaacactccatagacttcaaaaatctttccaaaagcgttttcagcagcgtggcctgtgctgttgcgtgggcgtgccttgctttattgacgcagtctcaaaatggggactttgctctgtggcagctgacagccccgttaaatgagctcctgtccttccaggagagggggcggagacttgtggccctcgctttgtggctgactctggttctagaagtatccagctggtctcggccctcaccgtgatcctccagcttctccctgttccgggcaggggtctcaggagtctggctggttgtcttctcctggaggaggagcatggggtgggggctacagcgtgaaccctgccatgtgtccgccccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggtacgcggggactggggacagggagggcgtcctgaacggcaaggtacgcggggaccggggacagggagggcgtcctgaatggcaaggtacgcggggaccggggacagggagggcgtcctgaatggcaaggtacgcggggaccggggacagggagggcgtcctgaatggcaaggtacgcggggaccggggacagggagggcgtcctgaacggcaaggtacgcggggactggggacagggagggcgtcctgaatggcaaggtacgcggggactggggacagggagggcgtcctgaacggcaaggtacgcgggggaccggggacagggagggcgtcctgaatggcaaggtacgcggggaccggggacagggagggtgttctcaacagcagggtggggccgagaaaagcacacnnnnnnnnnnnnnnnnnnnngggacagggagggcgtcctgaatggcaaggtacgcggggaccggggacagggagggcgtcctgaatggcaaggtacgcggggaccggggacagggagggcgtcctgaatggcaaggtacgcggggaccggggacagttacgccttggagcgaggtgtattccatggcatgttccacacggctcaagcaggagggcgtcctgaacagcaaggtacgcggggactggggacagggagggcgtcctgaacggcaaggtacgcggggactggggacagggagggcgtcctgaatggcaaggtacgcggggactggggacagggagggcgtcctgaacggcaaggtacgcggggactggggacagggagggtgtcctcaacagcagggtggggccgagaaaagcacacctttggcctgggcctgggtgtgccgggtgagccatcccggccgaggcacctgctggtcttggtgcggtgctgcccacagctcctccctgggccctgcaggaagctccacactggcccctcaggcctcgggctgtgagtgctgggagctccgtgtcttcccatacgagtccttccgggatctgcgtgatcggcctcagagccatgggctgagacagacccttctctggagaaggcttggcgtttgccattcatttgctcctccaacctccagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggtacctcggagccaccaagcaggcactcagctgctccctttatagaggtgcagaggccaggacctgggggagcaatggtccgacaagccccctgtcttcacagcccagcagggacctcccccctcctgaggcagcctccagcagctccccctgctgctgaggtgagggggtcccacctctgaggaccggccgggggctgtagaggtggagtcccccgggtgggagctgggactgtggctccctggctctgcagcctgcagtccgcgcaggctcctgcggggctctggggcgtcggggtctccttggtggctggcaccggcgcctcgcagtctcatctgcctcacctgcccgtagtcccgcagtcacagggctgggctcaaacctgggcctttagggcggcccagagcgcgagcggcttccacattgtccagccggaggctcagccacttctgttcatgggctcagcctgggatttcagtgggggctgatggcgggagccacctcgggagtttggggagttcggggctctgctggcccctcagtgcacacccccgctctgagattctgatgaaaggcacctgcgctctcccacctgtgctgatgcaggcggcccccgggcctccctgggagcctggaaggggttgctccgaggcccccctgggcgagggtgtgcagactcctggggtcctctgccttcctccctgggtccccacccggccacagtgccctgtctcctcggcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgattgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccacccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccgactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactcc

SEQ ID NO: 13948 - DNA, 52530 bp, Human
  misc_feature (1)...(52530): n = A,T,C or G
tggtttctagtgtgactttctttgccacctcttatttatacctggcttcgctagtatttctttgcctgtgtggcattttcatctattctctttgttatgttgatatttaagtcccagaaaagagtgggtaggaaccagagtagctctcaaggtgacaggcaaatcttctaagtgaaaaaaaccatttttcacttttattaattaaagatttgcattgtttttgctgctttcttttcacagttcaaacagacaacaatatcagtgttactatagttatttattttttttgagatggagtctcgctctgtcaccaggctggagtgcagtggcgcaatcttggctcactgcaatctctgcctcctaggtttaagtgatcctcctgcctcagcctaccgagtagctaggattacagacgtgcaccaccatgccccgctgatttttgtatttttagtagagacggggtttcgccatgttggccaggctggtctcaaacttctgacctcaagtgatccgtccgcctcggcctctcaaagtgctggaattatagactgtgagccaccacgcctggcccaaatatgtgcatttaaagctacaaattttccttttacacagtgtcactgcattccacaaatttgatatgttgtattattatcttttatttcaaattattttatttttattattttttatttttgagacagagtcttgctctgtcgcccaggctggagtgcagtggctccatctcgggcactgcaacctccgcttcccggattcaagagatactcgtgtctgacctcaggtgatccacctgccttggcctcccaaagtgttgggattacaagtgtgagcctccgtgcccggcctcaacttatttttaaatttccattgatctcttctttgacctagagatttggaattatgttgcttaatttccaatatttccggaattttctggcttgtttgggttgatttctaattttaattctattgcggttagagatgatactctgatttcaatcctcttaaatttgaggctcacactgaggattaagtataaaaaaattttttttgatacctgtttcatggactcgcctcacaaacttctgttttaaggtggggtaattatagtgcgttcagggatggatttttcttctgctttggttatgcatagagtgcactgtggcccttcaacactatactctgaaatcccacacagtattttcctcatctggaggtcctataggcttacactagggaggaggatccagttcaggccagcgtagtcttcagctgcgccgtgggactttcgggggagcgcctttgccctctcagaacggctgggcggaacggtgggtttgtgagccctccaggctcagggtgggtcgctcaggggccatctggggactttgggaagcaatgaaagttgtaccctaggatttttttctactggtcttctcttcagaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgccggggtgggggagaggaagggagcggtcacgtgtgaggggcggcccgaggtcacgtgacggagcgccggagcggagggagccggggctgggagttctcctgagggaagaggagtggagtaggggggacgcggcggcggtgttgacaatggtgagtgcgccgcggccagcgcgctcgcctcccgccctcgtcccggagcgcgaggcgggccggccaaccgcgggccgggccgtcgccggaggaggggacgggggagcagggcggggagcggggttaggcctgtcgggccacccctgggtctgggaaaagctggcggcgccacctcttcccggtctcggcgaggcccgagcacctacgggcggcggcgtgctctcctggccatgtcggagcctctgcccgcgttcttcgactgcttgttggggctctggctggggactcggaccccgcctctgcgggggctggtcgccgcctccccttcctaggtagccagtccctgttctcctcccgggcagcctctcttccatccaggtggggcgacccgggagccccccacctccggactcttcgggggacttgggcactcagtgtgtcacgaacttgataaactctgatattttaaaacctgactatggtgacattctttgatttcatgaccccagttcaggctttctgttgacacttgtaaaatgggagagaaaaataaaaggacgttggaatgggggatatctttaactccagagacacccgtttggtgcccgccgttttaagcattggctctcatttccgtccgcaagctatttctctgaacttaacgctctgggttgttgaaacggcctatgaggcagaggagggaggggaatcagtgctctcaccacagtccgcggaagcactagcctgggcattgtggtatttagctgggtgtcggcagtctctaggttagatctcattttacccattttctggtagtagtcgtcaattctcttcatttagcgcctactgtatgctctcctaatactacctgctcttcccaaagctcactgattcaatagactgcttgagacttttggcttaaaaggccgagccaggtatatttttaaaaagctactttgaataaataacttttaatttcagtaatgatgttgctttcaaaacaaaacaaaacaaaatccagacattcatgttcattcttagagcttttttctttcattcaacaaataattgctcaggtgtgcctaggggaccccagtaaaatggaaacagcgcctacctgctctcgtagcttacaatgtagggagagataaacatttatttgtgtaaattatttgtttaacgtggaaattagaattgtgacagatactaagaaggaagtattgggggaccttgcctagtcagtgttagggcaggcttctttaattgaatatcatttgaaaagaaaacttaaaaggtcctcctattttttgcttacatttgtaattattacttttaatacgcttttttgaattatgttcaagagcagtttatattttcaagttacccaaacagaaactaaattgtaaaactttaaaacactgaaatggtcacagatgtaatatatgtatgaaaatttgctgtttcattgcttgtgtatgggctaagtgaatgaattttgagagtcagccttccacctcagaaatgcaatgagttgcatttctttacatccactggacttagtgaaattccttcagtggggactaaaaagttgcctttttatgtatctaccatgtatttttgctaattggtaatgctcaatattgggttcagaaattatatgaaaaatcctaaattaacctaaagtcagtgataggaggtttaggccaagattagaaaactataaaaacaattgctagcatgtttttatagtcatatatattgcagtccagttatttaaaagctcaagagttttaacttgcatattaatagttaatcctgaaaatcgcaatattccaaatacgcccttgaagatatctttaccaaaagaagtgagtagtatttttgcacttaaaagatctcacggggtgcggtggctcacacctgtaatcccaacaatttgggaggccgaggtgggcggatcacctgaagtcgggagtttgagaccagcctggccaacatggcgaaaccccgtcttcactaaaaatacaaaaacaaaaaaaaattggccaagtgtggtggcgcattgctgtagtcccacctactcgggaggcggaagttgcctgaccaacatggtgaaactccgtctcaactaaaaataaaaaaattaggtgtggcgcacacctgtaatcccagctactcaggaggctgaggcaggagaatcaattgaacccgggaggcagaggttgcagtgagccgagatcgcgctgctgtactccagcctggcgacagagtgagactccgtctcaaaaaaaaaaaaaaaaaatctcaaaactgaattgctgtctgcatcatatcctaaccctcaacaaattttattctctttccttctagtctttaccagcttgacagttgtgtattttacttcctctttaacatatcagaagtattagaattttatttagaataattagaaaaagaatttaatttcattaccctttatttcaaatgacagaagttgcacatcttagaaaaaactttgaaagagagactttgggtagagatctttctctttcagttctttctaaaagacaagcttttttcctcagtatttttttctttttgttctctacctgtaaaatgtaagatatccacaattttctggaggtgttttttagtaagactagttcttttattattattattattttttgagacggagtctcgctctgtcgcccaggctggagtgcagtggcgcgatcttggctcactgcaacttccgcctcctgagtagctgggactacaggaatgcgccaccacacccggccaattttttttttttttttttttttttgtatttttagtggagannnnnnnnnnnnnnnnnnnnatgtaaaaaactgaatgttggtcgggcgtggtgcactttgggaggccgaggcgggcggatcacgaggtcaggagatcaagagcatcctggctaacacggtgaaaccccgtctccactaaaaatacgaaaaattagccaggcgcggtggcgggcacctgtagtcccagctactcgggaggctgaggcaggagaatggcatgaacccgggaggcggagcttgcagtgagccgagctagcgccactgcactccggcctgggcgaaagagcgagactccatctcaaaaaaaaaaaaaacctgaatgttaacccaatgccatattgtcatggaataactggttaaagtgcagtaatttattactcaacctattacttttttgcatatgctatactaggctttttaaaaatgccatttgattgcttccaattttagtgttttgattgtatttaaaaatatcttttttttttttttttttttttgagacaagctcttgctctgccgcccagtcagtggcttactgcagcctcgacctcctgggttcagcctcccaagtagctgggactgcaggcacacaccactatgctgggctaattttttaaatttttgtagatatgggggtctagctgtattgacgaagctggtcttgaacttctgggctcaagtgatcctcctgcttcagcttcccaaagtgctaggattacaggtgtgagccactgtgttctgctactttttttaaaattatgaaatatttcttgcatccagaaaataatagaggatagcacgtagtttttcacatatttttaatggttaggaatttaaatatttaaggaatggtgtcaaaacactgtttatcattatggtgttaattgtgaaattttataaaatgaacttggtttataccattttaattggtggcaattttagttctatcaaaattttatttaactttgggatttgattttttttttttttttttgaggcagaatctcactctgtcgcccaggctggagtgcagtggcaagatctcggctcactgcaacttctgcctcctgggttcaagcgattctgctgcctcagcctcccgcatagctgggactacaagtgcatgccaccacgtctggcaaatttgttctgtttttgtagagatggggtttcaccgtgttagtcaggatggtctcgatctcctgaccttgtgatcctcctgcttcggcctcccaaactgctgggattacacgcgtgagccaccgcgcctggcgatttgatcttttaatgtcagctttcaaatcccaagtggaactctgtgtgtttaggtatatgcatgtggaaaaaagttataatatttccttttctctgtaaaacaatttttatagttttcaaatctcatttttcttttaagtagctctgggaagtgtcaggaggaatgagaaaattaattttaaggccaagcaaggtggctcacgcctgtaatcccagcattttgggaggctgaggcgggtggatcacttgagcccaggagtttgcgcctggcctgggcaatgtggcagaaaccctgtctctacaaaaaatataaaaacgagccaggtgttgtggctcacgcctgtagtcccagctacttgggaggcttgaggtgggaggcttgcttgagcccatgaggcagaagttgcagtcagctgagatcataccactgcactccagcctgggtgacagagtgagactctgtctcaaaaaaaaaaaaaaaaaaaaagaattaattttaatttttctatctctgttttataactcaaatgagttataaatgtggatgtcataaggaaggagagctcattcttattgctctctctgccaattagcattatccttcaatataactgattttgttttccatctaaaatagactgctacttgaagatgttgtcttctaccctttcatgattgctcctcccacacaacccctgtaccctgctagctcagcacatattcgattagtaaatgtgagctgcatgattttaagctgctatacattctcatttctgtagcccttagaggaaatgtactacagtatttcagaatttaccattttgagtttaagacttggagtacgaaagccacctaggaatggacagtgtgtgtgacctatcactgatgattttcattctcttttttctaaattagttcagaatagttttctgattaaaattagttttctggttaaaattcgagtttgttatttgtaattttgccagaaaagattaaaacgtgtcaaaaagaaaaaaaaattttttttttttttaaacagagtctcactctgtcccgagggctggagtgcagtggcgcgatctcggctcactgcaacctccacctcctgggtgcaagtgattctcctgcctcaggtgcataccactacgcccagttaattttttgtatgtttagtagagacggggtttcaccgtgttagccaggctggtctcgaactcctgaccttgtgattcgcccaccttggcctcccaaagtgctgggattacaggtgtgagctaccgcgcctggcccaaaaagaaaatttgctacatatgtcaaaagtactaatctggtaattcttttagttggttgcttaaaattataatcccttttgttaatacaggatttaggaaaacatctcatttgagtatagcatcaccttgtgccctacatagccacaaagcaagctaacagaaagcaaactaatgactctcctaagtgaggacagaactgaggtttaatataaattccattgatatagtttgctactataccaatgctaatttgctcagaaaggctaatattattgactattccagatttcagttaatttctcttgtatatttgtttattttctgttattaaaatggtatgtgtttgttcaaaattaacattcaataggtattttaatgccttctgctaaatgccatacgctgccttagatgagcctcatggagtttacagttcagtaggagagtcaggtactaagtaagccttgtgaaacctaaatttggagaatccagttttgattaggaagtcaaggaaggtctcatggagagggagtcaaactgaaactcaaagggtgaattaggttaagaatactttgcttggctctaagacaagaaggacactagcaaattggaactgttgaagaaagagctctgaacgttggaggctgagtagttggagagatgactagtgtcagatatatgtagaccacattagagaatacattgtgtgtgtgtctgtttttaaaatcacaactgaagtaaaataactatgaaaaagtacacgaataggtgtatagcttgatgaattttcaccaagtgaaatacctctgtatcaaatgctcagttataaaaaaaacagccagaacattactagcagccagaagctccctttgtgctttctttcagtcactgcctgacctgtaataccataatgtaccttacatggtttttgcttactatgtgagtggagttatacgtacgttttgtgtattccttttgtgtctggcctctttcactcaacattatgtgtatgagattcattcttgtgtgtagttgtatctcctctaattctattgctgtttggtgttcccatttgtatgaatatatactaaattgcatatatccattctcttgttgattgatacttggattgtttctatttggggctattatgaataacacttgtgaacattttttttctggagacaaattcttgctctgttgcccgggctagagcgcagtggtgcgatcttggctcactgcaacctctgccttctgggtccaggtgattctcctgcctcagcctcccgagtagctgggactgcaggcatgcaccaccatgcccgactaatttttgtattaaagacggggcttcaccatgttggccaggcttgtcccgaactgctgacctcaagtgatctgcctgccttggtctctgaaagtgctgggattacaagtgtgagccagcgcgcccagccagatatgttttttaaagatcattcagagccaggtgcagtggctcacgcccataatcccaacactttgggaggccgaggcaggaggattgcttgagcccaggagtttgagaccagcctgggcaacagagtgagaccctgtctctacaaaaatttttttaaaaaagatcattctgggccgggcgcggtggctcatgcctgtaatcccagcactttgggaggccaaggcgagtggatcacgaggtcaggagatcgagaccgtcctggctaacatagtgaaaccctgtctctactaaaaatacaaaaattagctgggtgtggttgcagatggctgtagttccagctacttgggaggctgaggcaggagaatggtgtgaacccgggaggcggagcttgtagtgagccaagattgcaccactgcccttcagcctgggcaacagagcaagactctgtctcaaaaaaaaaatcattctggttgttatgtaggacagaatatgaagggatgtaggatgacatgataggagactgttctctgtgtaaacttaaaaagattagaagactaaatttcattgtggctaaaataatccataactatatccagtatcaaaattgctaatggattctgtattattaccaactgatgtgttttggcattgataagcaattgattttgtcccttatatttgtcatcttcaggatttatagaacaaggcttgtagattttctttggaaaaattcacagaaattttattttccttcattatagccagttttactacaagggctttcacagtgtaacatatcctgttcagaccaaatatagcagtagattttacagtaagtagtgcattatagtagtacatttggatttgtgtgagtactttgaattgtgtaaattctgctataataaaagaacctcataaataaaagtataaataaaggtaatttttcaagcctagctgttaagaattaacttcttagatttctgacatatgttaatatttgattatagtggttttgtatggaaatgattgaaattatagcatgctgaaatttgtttagggttttttttttggtctttttggtggttaaaaacacataacatgaaatctaccctcttaacattgtacttaagttgttcagttttgatgtagtttttttttttttttctttctttcttttttgagacggagttttgctcttgttgcctaggctggagtgcaatggcgcgatcttggctcactgcaacttctgcctcctggattcaagtgattcccctgtctcagcctcccgagtagctggtatcacaggcgcatgccaccacgcccggctaatttttgtgtttttagtagagacagggtttcatcatattggtcaggctggtcttgaactcctgacctcaggtgatccgcccacctcagcctcccaaagtgctgggtttacaggcgtgagacaccatgcccggcctttgatgtagcatttgatatatgtttttatcatttccttatgaactcacagatttgcagtctatttaaccgtagttcataggtaattaaattcaaattataaaatgtagtgactgactaaacatgataattatgaccattttcattttatttcagagttttcttggaggcttttttggtccaatttgtgagatcgatattgttcttaatgatggggaaaccaggaaaatggcagaaatgaaaactgaagatggcaaagtagaaaaacactatctcttctatgacggagaatctgtttcaggaaaggtaaatcttctgtttgacaaaactatctaattgtaagatatcagaattagttatcaaagtggtctgtgctgtttcttaaatttgaataattttatgagggagagagatttttttttccctaaagttcagctaaaatatttgattgattagaagataatctttcctgcaaaggaaagattcttaccctggaaggctttcaagggaagagcctctaaatttcatgcaaaattttctgtttaagtctcctgtgtggttcatgaaaaaaaaaatattttttttttctgtttgtgattatgtgcttctgtctggtttcagacagtttcttcagatcggagctgtaattcacccaaagtttgtttttcctttaacattaagttagagattgagagtaattctctggtataactttctaaaggtttttttacattctttgtaacttacctctctgtactgctactattgtgtctgttgatcttatttctaggtactctgtagaggacttgagtacttttgggatgtgtctatgcatggtcagatatgtttatgacgccttctataaggtttcacttttttccccttttctttatccggtaatgtatacggttttttgttttgggttttttgggttttttgttttgttttgtttcgttttttaaatagggtctcactctgttgctcaagctggagtgcagtggtgtgatcatggcttactgcatgcggccttgtactcctggactcaggtgattctcccacctcatcctctctggtagctgggactacaggcacacaccaccacttcagctaattttttaatttttttgtagagatggggtttgtccatgttgcccaggctagtcttgaacttctgggctcaagcaacccacccacgtaggcctacaaaagtgctgggattacaggtttgagccaccacacctgactgattattcttatattttagggagtatgatcaatacttattagtggtcagtgatagtggagaatggtaatatcatagacaaaagcaaaccacaaaacatttgaaataatttaaaaatagaaaatactaggatttttctcccctgcttgttcagttaatatattcatgtggtagacagttttggaaatatatataatctcttcatatagaaataattcactgttaaaatttggatgtgtttcctctaatctccgcattaattgatatttatgtatatgtaatatattcagcatactttttcctctattgtttgatatttaagcagtttctgtttttcagatggctttcttcatatctttggtaatatggacatcggtatacgtaaatttttctctaaatttctgtaggacgagattatttccttagaatagattgctgaaagtgagctgctaggccaaaattcgtgaaatatctgaaggatcttaatacacattaatctggaaaatgtatttgcattaaattacatgtccacctgtgggtctttttcacccaaggcagcattgaatatgatcactttgtaatctttgctattttggtaggcagaaacaatcttattattttaatttgcatttctttggttactagataaattgaacttagatttaccagccatgtgaggttattttttttttttgtactgcattgtctcttctggtcctttgccagattacctactggggtcttagtgttgaatccgaagtgaattttttggttttcaactttacttcccttttattcttccttttaaaagatgaaaaaagaaaaaggccaagtgcagtggctcacacctttaatcccatcactttaggaggccgaggagggaggatcacttgagcccaggaattcaagaccagcttgggcaacatggggagaccctgtatctatttaaaaaaaaaaaatggagaaaaaggcctaaagaagagcagacaatcatcaaaaggatggagcatgtcaaatgaaagaagagtaaaagtagtagtgtttggcctattgaaatgacttgttaatgggctgggggcataggaataccaatctagctttctttctagggagagactgaacctagcatctcaggtatttcttttacagatatgacatgtaaatatctctcctactaatttgtaagctccttaagttcaggggatcagagtgtgcttctgtagtctccataaaatacatgatagtgttgattatataataggctttcactaaatatttatttggtttatttactgtttttaagtcttgtagagaatatcttcagtctagtttaaagtaatcttatgtcacctggaccagttgaagttcatggctgatgtttatgggataaaggaaaaggggggtgtttaaagtaaaagtaaagctactccagtgtgttctttaaaaagaatagttggtgttcaaattacattttgatcctgggtgtggtggctcatgcctgtaatcccagctctttgggaggctgaggagggaggattgtttgagcccaagagttcaagaccagattgggcaatgtagcaagatcctgtctctaacactaagtaaataatttttttaaaaattacattttggaattgctggaaaccatacgtagacctgatcaactatggatagcattttttaaaatgataagatctcttataggtaagtattttcagttcaaaagttactatatcttgaatctgattgtttattggtttgagatttttttcatttttaatgtttttattgaaaaaacacgtgtagaaaaccatatacaacaaaaataaattattataaggcatattttcttattatcaccatccaagtcaagaagtagtactttgccagctaccccatgtgtcctgtctccatcacactcccatcccctcaaaagtaaccagtgtactgacttttatagtagtactttcttgtgtttgtttagtcttgctcatttaagaaaaatttggtacggtttttaaatctctcttaatctcaggttccctcttcatacctttctttaacttgcaatatctgttgaagaacacttggtcatttgaattgtagagttctctgtgtttgtgtattcctggtacagttattgcctatcagttggcagctaggtccagaggcttgaatcaaactcaagtttgattcttctggcaagaatataggtggtggtgtgtttttccattgcaggtgcaaaatgtctggttttctttctctgtcatttttcttttcttttctttttttttttttgagacagagtcttgctctgtcccccaggctggagtgcagtggcgtgatcttggctcctgcaacttcccgcttcctgggtccaagtgattctcctgcctcagcctcctgagtagctgggattacaggcacgcgccacgacatccggctaattttcgtatttttatttttaacagagacgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaattctgttattttgtttttacttatgaaatggaatacatttacaaagagacgttatctatatcttgtgacctagtggtacagctcatatagaaaaaagaatgcttgacctttttccttttttggcctgttttgttatttatttatttatttatttattttgagatggagtctcgctctgttgcccaggctggagtgcgatggcgtgatctcggctcactgcagcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgggattacaggcgtgagccaccgtgcctggcctttggcgtgttttaaaaaataataacttggttccttatcttccaaaggtgtaaactactagttttatttctcaataacttatataaactcatgatttaaacatacttgatgtttataaatattgccctattgaagctctagttgtataatcctctgtaacaaattaccacaaacttagcaacctaaaataacaaatttatgtcttaggatttttgtgatttagaagtccaggtggaggttagctgggtcctatgctcagggacttaccaggttaaaatcaatccaaggttgcagtctcgtctgaagttcaggattttcttccaggctcactggtttttggcagaaatttccttgttgtgctatgactgatacccttgtttcttgtgcagtaggctgtctgttcctataggttgccctcagatccttgctgagtggcccctttctctcagtttgcgttgtcttcaaggccaggaggagaccatcactctgacattcatcttcttttaaagagcttacctggtttgatcaattccagttaggataacctcccttttgattaactaaaaaaatcaactgattagtaacctgatcacaggagtggtatcctatcatattcactggactcacccacactcaagaggattatacacatgtgtacaccatgggatagtaatattgagggctatcttagaattctgcctaccacatttgtattgactcttatgaaaggacatgggggccctaggatttttctttttttaagctgtattgagagatatatatatatatatattcgccataaaaattcacccattttaagtgtgcttaaaatttttagtaaatttagagttgtacaactatcaccactaattccagaacattttcattactccagaaatttttaaaaatgctgtaccattagcagtcattctccatttcccctccttccagtctctgacaacccctgatctctgtttctatgaatttgcctattctggacatttcatataaatggaattatacaatgtgtggtcttttcctattttgtttctttcacttagtataatgtatttgagattcatcaatattgtagcatttgttattagtatatcattgttttttattgatgaatagtattccattttatggctataccacattcttgtttatgcattcaccagttggtgggtatttgggatgtttctacttttttgctgttgtgactaatgctgatgtgaacatttgtgtagcagttttgtgtggacctatattttcctttctcttgagcatgtacctgggagtggaattgctgccttatgttaaatatgtttaagtttttaataaactgccaaagaccttaggagtttttggtggctttcttgctaactggtatgacaagatgtttaagggtcttttgtgtttctgcttcatacctgcactcagccgtatctttcaaggccatagttgcatgcaaagattgctcattgctacagtgttggacattatttctaggctgctcagtggatagatggggagagtttttaaatatagatttaataaatttatttttatttgtgtatattgtttaagataaaatacttcaggaatcatattgtcatttccaattcaatttgaaaattagaagtttttacttaacctcttatgttacatgtatatctcctttcttctgcatcaagaatactgattttcagagtcaaaggaagatgtaattagcatatcccataatttactcaatatctttaccccacattatatacataatagtctcagaataacaatactaacattaccactatcaatatgattatgaagttagttaaaaaaaatttagcatttgctatttgttttactcacatttcttaaatgtaccatagtaagtacattgtcagagtgtatagtaattatatactttatgtgcttcctttcgccctcacttagtcttggttttataaataactgttcatatagtgtgcaccaccagtccttatatctttgtctctttatttgtttcattgtctgaagcttattctctagttactagagtctaatagattcctcaggaaatgctcatgggaacaataaggcctaagtttttgcatattggtaatggcttttttgtgtcctttacacttaaaagttagtttttctgaataatcttggcttacatttttttgagttattttatttattttctatttatttattatttttgagatggagtcttgctctgtcacccaggctggagtgcggtggcataatctcggctcactgcaacctctgcctcctaggttcaagcgattctcctgcctcagcctcccaagtagctgggactacaggtgcccaccaccatgtctggctagtttttaaatttttagtagagatggggtttcaccatattggccaggctggtctcaaactcctgaccttgtgatccgcctgccttggcctcccaaagtgctgggattacagatatgatccatcgtgcccggccttcttgagtgttttaaatctattattactgcattgtcttctggcatagggtattgttaacagttttttcatttgaggaaagttttcttgaattacagccattattaattagtatttattccattcctttgctttggttttcttcttgatatcagtatttttgagtcttgtttgagtgtggttttttgctcttgtattccttctgcttatcctttatttctaaaatgatttttacttctatttctaattcttttctgatttttctcaccctagcttaagattttctttcatgtattgtatcattttcttaatatcgtatagcctgttttgaaataaattacagttttgatctatcttgtctgtagaaatgccattctgttccttctctttttttcttaaaataactttgtatgggatttgaccttgatatatttatgttgctaatttttatgtgaaattagttttccccaatgttttttttttttgagataagatcttgctctgttgcccaggctggaatgcagtggcatgactatggctcactgcagccttgacctccaaggcccaagcgatcctcctacctcagccttccgagtagctgggaccacaggcatgtgccactgtgcctagctaattaaaaaatatatattttttgtagagacagggtcttgctatgttgctcaggctggtctcaaactcctgagctcaagtgatcctcccatcctggcctcccaaagtgctgagatgtgagccactgcacccgaccttctcctgaactttttgtcttttcgtgatagagtctcactctgtcacccatgttggagtgcagtggcacgatttcagctcactgcaacctccgtctcccaggctaaagcgatcttcccatctctgcctcctgagcagctaggaccacagggcacactaccacgcccaattattattattattatttttggtattttggggtagatacggggtttcaccgtgttgcccaggctggtttcgagctcctgagctcaggcgatccacctgtctcagcctcccaaagtgctgggattacaggtgtgaaccaccgtgcctggcccttcctgaacttttgatggtttggtttaggatagtttttctaaccacctatcctagacagcaggcctgactggtcagttttgagtgttctaatattattggattgtgcaaaactccttccagcgttagctcttattctcagattgacaccatgctttccagtgaatatatatgagtaatttgggagttcttaggtccatcagacactccattgcattctttgattcctcctgcacaaccctagtatcatgcaggttttgtggctattaacctggtttgtccctacgcattatgttttgggattgtgggaatactttatctttttctgtggtaaattggatccttagatttttttggttttgctgtctagttggtccatctgtttttatgtgacgatctggggagattcaaagactatgttgccatcttcccagaaattgatctgagattctaaaaggccatgtgtaaccattctggcagtttagcaatatgtatcaaaatcttcaaaagtggatatcatttatagtagccagaatagtctggattattactatgtaagagacaaccccaaaactcagtgacttaaaaacaacagtggcagtggcttctttcttgcccaggcaacatgttccttgtgagttagctgagggccttattctgtgccatgctcagtgatggagcagccaggaacatcacactcatcatggctgagggagagaaatctctgcagagtctttcacaagccattaaaatgccccatcctagaagtaacaaagagcatttctgatcaaatttattgtctctagaaacagtcttgttcgtacctcacccagccacaagagggtagggaatacaatcataccatgcactcagaatgtatgcagctggaaatatttgagcagtgcctgtattgattaatattattttgatccacagattcttctgatcagattttatcctaaaataatcaactttgttcatttcactgtttataatattcaaaaattgaaagccacttaaatgtccagacattaaaaaacctaattatggtaataaccattaagtgcttagggccattattaatgtgattatattgatctgtattcattcacatgaaaagaggtttgctataataacaatatttactgagtactcaccatgacccaggtattccttctgaagttcttcataatgatacaatgattcctcttttttttttgagatgcagtcttgctctgttgccagcctggagtgccgtggcgcgatcttggctcactgcaacctctgcctcccgggttcaagtgattctcctgcctcagcctcccgagtagctgggattacaggcgcatgccaccacgcccggctaattttttgtatttttagtagagacggggtttcaccatgttggccaggatggtctcaatctcttgacctcatgatctgcctgcctcagcctcccaaagtgctgggattataggcgtgagccaccataccaggcctttttttttttttttttttttgaggtggggtctcactgtgttgcccaggctgagtgtagtgtcatgattacggctcactgcagcctcatccccctgggggcccaagtaatcctcctacctcagcctcccaagtagctgggaccgcagacatatgaaccaccctgcctggctaattaaaaaaattttttttttttatagatagggtcttgttgtgttgcccagtctggtctcaaactcctggactcaagtgattccccaaccttgacctcccaaagtgctgggattataggcatgagccactgtgcctggccaaggattatttgaaagattatcttgtgttcagtaaaattaggataactaaagaaaatgaaaaaagtggtatagatttgtaataacctcagaaagactatcttgacaacgagcttgaggcttttaaagctaagaaagacattttaaacctcatatttagaataagatgaataagaaaataatatgctcatttggcacacttattttaatataacaaatgcaaaagaaagctttccccccactattcaaaaaaaaaaaagatttaaattgggaaaggtaggatcattaaaaattaaaacagaatgaaagctttgttatggttaagaagattaaaaataaactaactagttttcaaacatcctggtgaccataccagacaaatgctatgcgataatactgaaagaattttgcagaactggtcaccaaatctctgctaggagtcctttagtaattgtggaaaatgagagaggttctagaatataagaaaagcccttatttataaaatggggtagaaagtttgtttcaggtaaacttaatattggttcctgacatatctttagattattaaataggtgatcagtgaacatgctgaaaagaaagcttaaaggaaaaagaggaggaaacaacgggttgtttacgaccaagcatgtgtcactaagaacaaatcttgccacaccaatctagggtttgtgaaatgtcctggtgtaataaaaagatcactgggctagcactggaagatctagccttaactttactgctgtcttggtaggtaactctggacagtcatttaatttcctggatctcacctataagtttaggaggttagactgcctcattggtttccaaacttggctttgcactgtaggatgctctgcatgaaaatctttcatatattagatattatgttggatcttggaggtctgacatctcgcccacagcaagaataaattcctttttaatattcctgacgtgagtttctgtatgcctacttttcagagtgtggggattctgctgttctgttaacagtatccactctgctttttagagatacgcaaaataaatctaatccttttctaagtaagagttctctctaagcattttccacatcactgtcttgtttatcctgtcttctctaagctaaatatgctatttcctttagttattgttcaagaaccctgggttttgagtctttatcacccagattgctttcttttagttttcaaattaaatttaatttttttgagacagggtcttgctgtgtcacccaggctggagtgtagtgatgtggtcatggctcattgtagccttgacctctcaagctcaggcgatcctctcacctcagcctcccaagtagctcagacaacaggcacacaccaccatgctcagctaatattttactatttttgtagagttggggtctccccatgtttcccaggctaatctcaaacttctgggctcaagtgatcctcctgcctctgccttccaaagtgctggaatgacaggtgtgaggcactgtgtccagcctcagattcttacataactatatagaaaactggtttgcattatctgtatccagcagttccactcctagatacatactcaagagctcttttaagagcaattctagattttcagaaaaattgagcagaaagtagagttctgtgtactcccttcttcctcaccccagccccacatggattcactgttactaatcttgcattagagtgatacatttgttaaaattgttgaaccattattaccacattattattaactaaagtccatagtttacattagggtttactctgttgtacattttctgggttttgataaatgcataatgtcatgtatccatcattgtgatatcatatagaatagtttaaccaccctaaaaattccctgtgtttcattcacctagtcatgccgctctggcacctgcgctaccaccaccatccacacagtcttcggcaactactcatctttttactgtctataattttgtcttttctagaatgtcatgtagttggaatcatatagaatgtagcctttttagattggtttatttcatttagcaatattcttttaaggtttctccatatatctttgtgacttgattgctcatttatttttagtgccaaatcatattccattgtatggatgtaccaatgtttgtttatccgtttacctactatcttggttggttccaagttttgctcatttttctatctagttgactctttttctcttattgatgtgtaggattttttgtatgttcttgataaaggtgttttatatatctagatatggagtcctttgtctatgtatgtatcataaatatcttctcctaatttctggcttgactttgtagtctcttaatggtgtcttatgataaacagttcttaattttaatacactagatacataatgtttcctttttgtttatgcttttcatatctagtttaaaaaatctttgcctaccccttgggcacaaagatattctcctgttttttttcctcctataaatgttatttaatttaattaattaattaatttatttttgagacagagtttcgctcttgttgcccaggctggagtgcagtggcgccatcttggctcactgaaacctccgcgtcccgggttcaagcttttctcctgcctcagcctcctgagtagctgggattacaggcacccacgaccacacctgactaatttttatatttttagtagaaactgggtttcaccatattggccaggctggtcacgaactcatgacctcaggtgatccacacaccttggcttcccaaagtgcagggattacaggtgtgagccaccacacccggcctaaattttatttttatacttcacatttagatccttgttttgcttggaattggttttcagtttgtctgtggtggtaacataggagtcaagtttatttttcttcttctgtatggatactaatgaacccaggatgtatactgaaaaagccatccttttccactgcactgtcataccacctttgtcataaatcagtctgtggtgtgacacaggagtcaaatgtatttttcttctgtatggatagctaatgaacccaggatgtatattgaagaagccatcctttctcctgctgcactgtaatataccacctttgtcataaatcagaggttgtgtgaacctgttcagaattttattctgttctgttggcctatttgtggcatgtacttttttcttttctttttttttttttaaatagcctaattgagttataattcacatgccataaaattcacctattagagtgtatagtgatttttactatatttgcagagttgagccaccattatcaaaatgtaattccagaacattttcaccaccccaaaaagaaatcccatattattagcagtcactacatgagaaccactaatttacaaatcttctttctttcttgctgaatttattgattctggacatttcatataaatggcatatactgtgtggccttttgtgtctggctccttttacctagcataatgttttcaaggttcatcgtgttgtagtatgtacccatacttcattcctttttatttttattcaatcacttattcattcattcattcattcgagatggagtctcgctctgtcacccacgctggagtacagtggtgtgatacgggctcactgcaacctctgcctcctgggttcaagcaattctcttgcctcagccttccgagtagctgggattacaggtgcctgccaccgcgcccagctaatttttagtacagacggggtttcaccatgttggccaggctggtctcaaacttctgaccttatgatctgcccacctcggtttcccaaagtgctggaattataggcgtgagccaccgtgcctggtcaacacttaattcttttttaaaaaaattgtggtcaaatatatattacataaaatttgccattttaacagttttaaagtatataattcagtggaattaattccattgataatgttttgcaagcatagctactatatttccaaaattttttcatcacctcaaatagaaactttgtacccattaagcggtaactccccatcttccagcccctggtaacctctaatctactgtccgtttctatgaatttgcctattttagatattttgtataagtggtcatataatatttgtccttttgtgcctgacttatttcatttagcatgttttcagggttcatccatgttattgcatgtatgagaacatcattcttcttttgtttgtttttggtgccagataatattctaatatatccgtgtggtataaggatataccacattttgtttattcatcagttgaggacatttgggttggtactatttgaccattatgaataatactgctgtgaacattcatgtacaggtttttgtgtgaacatatgttttaacttctgttggatcttagcagtagaattgctgggtcatatgttaacttcctgtttaatttttagaagaaccgccaaatttttccaaagcagctgcaccctttcagattgcctccagcaatatataagggttttggtttttccatgttcttggcaacacttactaatatgtctattttttattataggtattttagtgggtataaagtggtatctcattttgattttcagttccccaatgagtaataatattgaacatcttttcatgtgcttattgccatatgtctgtgtttcttggagaaaactctattcaaaatttgactatttttttaattgggttatttttctttttatggttgagttgtaagagttctttatatattctggttacaagtccagatatgtgttttgcaaatattttctcccattctgagttctctttccactttcttggtgtcttttgcagtgcaaaagttttacattttgatgaggtccaatttatcaatttttttttcttttgttgcttgtgcttttggcattatttctgagaaatcattgcctaatccaaaggtcatgaagatttgcacccatgttttcttctaagagttttttaattgtagcttttacatgtaggtgttttatccaaatgagttaatatttgtgatggcgtgaggcagcagtccaactttattcttttgcatgtcagtatccagttgtttcagcactatttgctgaaaagaatattccttccccattgaattgttttggcacctctgtggcattttattttttattttttatttttattttttgacagagtcctgctctgtcgccaggctggagtgcagtggcacaatctcggctcactgcaacctccaccttctgggctcaagtgatcctcccacctcaccttcctgagtagcttggaccacaggcatgtgccaccatgcccacctaatttttatatttttttgtagagacaggatttcgccattgtgccccagctgatctcgaactactggactcgagattagcatgcctcggcctcccacagtgctgggattacaggcatgagccaccgtgcccagcccctgtattgtgttttcatatgaaaactttgtcaaactctttaggtattgctgagaattttttttttataaatatgaaatagctactgtcacaacaggcagagaataaaagaacctcttattgtatctatttaaggtaaagagatatttagtaattaagatagttggtaattatttcaaagtgagatattattttagaagtcaattttcactgttctctactttcatttgtaagacatttttatttcttttttagaaattgaatctgtggcaagtaaaatggcttgaggtggtactactattgacaagccacttagagtgaactctggatctattccctgttgcaaaagtcaacacaggggttgacttttgtttagtccaagattatagtagtttatagtttagttctttaagcaaggaatatttttgtggcatctttcatcaatatgcatatggactatgacagcagttgcaaactaatcttggatttccactggcagcagttggaaactaattttggataatcacaatatccagcaacaataatatacagataatttggtgtctgattttaaaatgagtgtataaatggtgtgtggtacattgatagtatatgtttgtcttaaacagtgtagaataatgtaactccttaaataaattctgaagatagcattattcgagacatctctagaatattgtatactgaggcatgagctttgagactcatttgttggagcagagagtatttttttttttttttttttgagacggagtctcactctgttgcctacgctggagtgcagtggcacgatctcagctcactgcaagctctgcctcccaggttcactccattctcctgcctcagcctcccgagtagctgggactacaggtgcccgccaccacgcccagctaattgttttgtatttttagtagagatggggtttcaccgtgttagccaggatggtctccatctcctgacctcttgatctgcctgcctcagcctcccaaagtgctgggattaccagtgtgagccaccgcgcccagccaagagtatgttttgtatgtagatctgtttttttttacgttcattttaaacctatgtagtctcaagtatctgcacacaaattattcattaatagcaaaggggagaataataactttaaattagagaaacttggtagattaaccaagtgaccaaaattaacatcaatcagtattgggacaaactggcattgtatgcttcctaatatgatgcattgaaatagatacaactacacttttgtggtcttttttccaaaagtgtgtaagctgagtctaactgtgatgaaacatcagacacaccaaattgaggtacagtctataaactgtcctgtatttttaaataagtcagggtcaagaaagatgatgattgaggaatgttctagattaaaaaggatactaaagagatatgtaatcctggactggagaggaaaagactataaagtacattattggaacacatttaaaatttttttttaagacagtgtctcctgtcgcccagcatggagtgcagtggtgtgataatggctcactgtagccacaaactactgagctcaagtgatcctcacacctcagcctcccaaagtgccaggagtacaggtctgagccactgtgcctgtccctattggaacaattgatagaatttgaatatagaccatgggaatgttaactttcttggtgttttttgttttttttttttttttttttttttttttttgagatggagtcttcgtctgtcacccaggctggagtgcagtggcatgatctcagctcactgcagcctctgcctcccaggttgaagtgattctctagcctcagcttcctgagtagctggaacaggcgcgtgccatcacgccctactaatttttgtatttttagtagaaatagggtttcaccatgtgggccaggctggtctcttaactcctgacctcaagtgatccacctgccttggcctcccaaagtgctgggattacaggcgtgagctactgcacctggccctcatttattttattttatttttatttattttttatttgagactgagtcttactctgtcatccaggctggagtgcagtggctctctgcaaactgtgcctcccgggttctagtgatactcccacctcagcctcccaatttgctgggactagaggcatgcaccatcacacctggctaatttttgtatttttttgtagaaaacggggtttcaccatgttggtcaggctggtcttgaactcctgacctgaagcggtccgctcacctcagcctcccaaagtgctgggattacaggcgtgggccactgcgcccggcccaactttcctgattttgataattgcactgtgattatgtaagagaatgcgaattttcttttcttttttgagatggagtgtccctcaggctggagtgcagtagcacgatctcggctcactgcaagctccacctcctgggtttcacaccattctcctgcctcggcctcctgagtagctgggactacaggcgcctgccaccacacccggctaattttttgtatttttagtagagacggggtttcaccatgttacccaggatggtctagatctcctgacctcatgatctgcctgccctggcctcccaaagtgctgggattacaggcgtgagccaccgcgcccggcagagaatgtctgttttcttaggaaatacatatgaaatgtttaggggtaatggagcatcatgtctccaacttactctttgttgtggaaaaaagtatatatatgcatgcccatatatatgtagagagatgatgataaagcagatggggcagaatataaaacttgtgctgaatctgggtaaaggttatgtgagatttcccttgtgctattcttgcaagttttttgcaagtttttgaattataataagaagttagaaaagtataactgaattggtattaagactcttgacataggttgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattcttcatattgcagaagagcctacaataaggcttaaaagcaactgtgttttaacatcagtgggagatcaaggaaaatttcagagtttgcagtttggtaggaagactgaaaaactttgcatttgtactttaatagtgtggtttcatgatggtttttgaagaactgtaagttttaaaaatatcagacaaagccatgttcaaataaaatcattcttaaaaactgctgccatataggtattttcaaaaatataatttttttctatatgctttgttggtagagattatagttcaaattactgcatggcttttgaaatagctgggattatgcttgttttattatttgtggttcaaatataaaatttttaatgttaagcctgtttaagtactacttttctttcttaaatatttttctgactttaatagtattttttgcctttttttttaaagaggcctgggcaacatagtaagaccctgtataaaaaaaattagccaggcatggtggcatgtgcctgtaatttcagctatttgggaggctgaggtgggagaatcacttgagcctggcagattgaggctgcagtgagtcatgatggtgccactgcgctccagcctgggtgacacagcaagaccctgtctacaaaaaacaaaacaaaaacttaaaaaccagagaaggaaacaattacccataatcaataatcattcatttcagaagtaactgctgttaagagtattctctttctgtagtttcaaaaaatataatcggcatatacttgtatacaatttaaccatgctttattcacgtaacacatcatgcatatctacccacatcattaaaaattctttatcattattgtttttaaacttttaataatattccatcatatggtgtatcacaatttacttttttctgagttattttgaaggcaagtaactaacttatattggttataagatagggaagatacagaagatgaatattttaatctatgcagtttacaaacagaagtaattggacctctttttcttgttccttgatttctgttatcttttgagaaacattatttgtaagaaaagcttttaaaagttacattaccagcatttgttatagtaaaaaacggcggggcacagtggctcatgcctgtaatcccagcactttgggaggccgaggcgggtggatcacgaggtcaggagatcaagaccatcctggctaacatggtgaaaccccgtctgtactaaaaatacaaaaaaattagccgggcatggtggcgggcgcctgtagtcccagccacccaggaggctgaggcaggagaatggcatgaacctggaaggcagagcttgcagtgagccaagatcgtgccactgcactccagcctgggcgacagagcgaggctctgtctcaaaaaaaaaaaagaaacctggaagtatgcttttttgtatgaaaaaggatcctacctaattcttaaatgttaagttgtttttttttttttcggttggcgggtacagggggagatagagtcttgctctgttgcccaggctggagtgcagtggttcactgcaacctccgccccccgggttcaagtgattctcttgccttagcctcccaagtagctgggattacaggcatgtgccaccacgtccagctaattttcgtatttttagtagagacgaggtttcaccatgttggccaggctggtctggaactcctcatctcaagtaatccactgtcctcggcctcccaaagtgctaagattacaggcatgagccactgtgccctgccttttttttgtttgagacaaggtcttgccctgttgtccaggctggagtgcagtggtgtaatcttagctcattgcaccttcgacctcctagggtcaaaggctcctcctgccacagtctccctagtagctgggactacaggcacacacgccccaatacccagctaatttttttttttttttttagtagagacggagccttgctatattgtccaagctcgtcttgaactcctgaccttaattaagcagccttcctgcctctgcctcccaaagtgctgaaattataggcatgagccaccacgcctagcttggaattttatttctaacatacatagttcacagatatctttctcaaattaaaaagttataaatttggctgggtatggtcacttgaggcaggaggattgcttgaggccaggtgttcgagaccagcctgggcaatatattgagactccacctgattctctgctttctctttcctttttctgatttctctgttctttgagggtaagatgatattctcagactacatacatctttcaatagtagccagcacagggctgggtacattcagtgaacaagtgaataaatgaatatacaaaatacaatcagaatcttagagaaggggaacccggtaggattgtaaacacatgcagagaaacacccatcataggagcaggctggcttcaagtctagaccctggtcatctcacagtgaactaatggtacttgaacggagccctgactcccatgccaagcaatgtgaagttgtatccttgactgtctcaggtaatacttagagaagaagagtgttatcaagaaagacaattgagaaacaacctatatgaccatacaggggattcagcaggtaaatggtggtgtagccaaacaatagaattctttgtagatctggctgggcgtgatgactcatgcctgtaatcccagcactttgggaggccgaggtgggtggatcacctgaggtcaggagtttgagaccagcctgagcaacataatgaaaccccatctccaccaaaaatacaaaattagctgggcgtggtggcacatgcctgtaatcccagctacttgggaggctgaggcaggagaattgcttgaacttgggagatggaggttgaagtgagccaagatcttgccactgcactctagcctgggcaacaagagcgaaactccgtctaaaacaaaaaaaaggaattctatatagatcttaaagatgagtttgtggccagtacagtggctcatgcctgtaagcccagcactttgggagtccaatgtggcagaactgcttgaggccaggagtttgagaccagcttgggcaatatagtgagacctcatctctacaaaaaaaatttttttaattagcttggtgtagttatgcatccctatagtcccagctatttggaggctgaggcaggaggatcacttaaccctaggggttcaaagctgtagtgagcaataatcatgcactgtactccagcctgggtgacagagtgagactctgtctcttaaaatatgtgtgtgtgtgcgcgcacgcgcacgtgcgtgcacatatatatatattttttttaagatttccacttggcagatatatgagtttagggattttgagattatatattttactccaaaagtatgtaagataatggccaggtgcagtagctcatgcctgtacttctagcactttgggaggctgagggaggaggatcatttgagcccaagaggttgaggctgcagtaagctatgattgtgccactgcactccagcctaagcaacagagtcctttctggaaaaaaaaaaaagtatgtaagataaatcatacttgaatttaaatctttaggcattctgtttttatggtgggtagcagacttaggacaaaaggcactgcttttaaggttaggaattataataatatattggttacagaaaactgaaagtgatacctcaattacaataagtatgaagctatgatttgaccgacaaatttctgagcattgtccataatatagtcctagttgtgtggatgttagtcttgcttgatttaaatgtcctggaattgcatctgtttttaggtcagttcttgaaattagtaattacctcacattaaaatgcttttattagtcatagaattaactgtttgaccagaaaacaaatatggatagttgaaggctgttcctttctttgagtctttttatagttctccacctattaaggattccttcttaacaaagcagactttatgttgatgtaaataagaggttcacccatgattgtgtataactaaattacaccttctctggtgctataacatcatcctgatttaggtatgtggtggtgtctcaaacttcataaatgaatacctgaaatatttatatattgcattcatctgaaaggaagctactagtaggcccactcataggattgttaacatctcttataatttcatgttttggcaggtaaacctagcctttaagcaacctggaaagaggctagaacaccaaggaattagaattgaatttgtaggtcaaattggtgagttttaaaatagtattatttctttttctttgataactgaatttgaagagggttggattttgcaccaaaataattgaattagagcttagctttgtagaaggaaggaattgattttgcataataaaagagaggatttactttataactatattaaattgtgtttctttgacttgtatgaaatgatatttgatatatcatttcatgatatatatgaaactaccagccttgaaaactaattcaagtaaattagttgacctactgaaattttcatctgcctgcatttttcaccatccttcttataattagcagcctcaccttcattcttcattttctaattacccatgccatttgtcttcctgatctagtgtgtgcctgtagccagactcacttgtgtcaacacacaattccatgtgagaaggaaaggtgtagtttcttcttgacttagatcaacttatgtacatttccatacatgattccagatgaatgcttgatttagtagggagttaaactatataaatctttctatactgaagattcagaagagaaaagaaaatatgtctttataatactgtctacataactaggcttaaaatctagctttctaagtttcagtgtacatttttaaagtatcagaattggaatgggtagatatttatatatctgttctgactgagagtgtacttacatgtctattctgactgagaggcaagttgtagtaattgatagttggttttagtctttttgtgttttgtaattttatgaaggtaatatatttgcctaactaaagcaaaatagaatttttgccttgtctaggggaagttcaaataattgctggtaatgtgtcaaatggcttcatattgggagagccccaactacatcaaaggaatgaactcatttttaaagaaattttcattgtgctatgccacttgaaatcttttatgcctacatgaagtataattataaaaaggataatggaattcagagcataggtctagtttattagagacaaactcaataattcttttggtaaaaatcgtttgtgtttgaagtagatgtctgggttttattgaaatggctattaaataattggtctttttgccttttaaaatttctcagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtatgaatgtgtattataaactgtaaacagaatcaaaaccagaaagtaatgactactgttgatatcttatttgaacctctaattataattctgtattggaagatttaagatttttaaaaattctgtcacatactttggctaatgctgatttgaggtaatagagcgttctaacattatagagttagacaacattgttatgagacatttcagttatacacttccctggtatgaattgtcccttacgtacttcatttgtcatgtaaactgaatgaccttctaaatccactagtttcccagaaaatctcctttagtatatggttcagaagtaatctggagtaccagagaggctctgatacatctaaaatgacacaaatagtggatggcagaaaaggagtacgaacctagttttctaaactctcaattcagtgtcctttcccttcactaagtctgtatgcaggaagccagggatgcctcagagtccagggcatttcaggatattaatctgaatgcatcaggtccgagatcttgctttctctgtttaacttggcattatctatctggaactgggtttgacaacccaaatttcaaatagcagttccttaaagaagtgatctggagaggtttcttcaagtaggcttgatgacagccctccaaactcatctgtaaagtatttacactattcttaaaattgaactttgtattttttttcatgttgggggcattaaagaaaattggaactccttcgtgaagtaatgaagtaagttgatcccaaaggagttccagcaaggaggagaagcctgagttgcagttaatgtttgctgatttaaaacatgaaaatttatcacaggtgatttaactcatcgactctcttttaactttgtaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtaagtatcattcacagataagttgttcagagaaaattcaaaaattaacttttcaggtgtttgtcagttggtcaaagtaaggatagaattgacattaatctgatgttaacaaatcaacaggatctctgagctaaaagaaattttaggagtttggtctggtttccactcagtaaaggtgtcttttatgttctattcctgataaatctctgcttggccactttgtgtagaggatgtcaccatctcagaaggcagccagtccttctgaggatacaatttatcttactggcttgatattacctcatcctagccatctcttttcacatattttcacctttaccacttaatcactgttaatgtctccttgtatatcatttcttggggggagggggaaggtatatatgtttatatatgttgtatttttacaaaactggctcatattttgcttgtgtttaatgcctttttaaattttattatgggaaatttcaagcatatactaaaatatttgaacagtatactgaataatataatgaatcctcatgtacccattgcccagctccaacagttatcaacacacaatccagtttatctgtattcagctctcatactccccataggttatattgaagcaaattccagacatttaatttaacccataaaattatgtatcattttatcaattaaattatatatgtggaatttgcttcgatataatctgtgggaagctgtatcaatatcattttatacatggactaagatgttctcagaaacattacttacatgaacaaaagattgccatttaaatgcccactggtattataacagttaaataaattatggtccagccatactgtggaatgctaaagaagggttaaaaagattgaggccgggtgcggtggctcacacctgtaatcccagcactttgggaggccaaggtgggcagagtttgatcacctgaggtcaggagtttgagaccagcatggtcaacatggagaaactccgtctccactgaaaatacaaaaattagatgggtgtggcggtgcatgcctgtaatcccagctacttgggaggctgagggaggagaattgcttgaacctgggaggtaaaggttgcagtgtgctgagatcacgccactgcagtccagcctgggtgacagagggagactccatctcaaaaaaaaaaacaaaaaaaaaagattgagacatatgtatttagttctccagaagcgtgtccatgatatattaagtgaaaaatttagccataaaaacagcatgcatagtactgtttcatttctgtaaaatactcatgtatttggatatgaatagaaaagagtctgcaatgatattctgttgttaacagtggttatctgtaaaggatgaaattatgtattgactttacatatctcttatttaaatgttatatgacaagcttgttttctgtgtctattcagaaaaaagttttaaaaagttatatatcattctaaatataactacaatactcttatatctaaaaatattagtaattccttaatatcttcatacacccagacagtattcacatttccctaattggctcacagatatctttcttttttcacatactttgttcaaatcaatatttaaactagggccacacattgcatttggttgtttgagccttaaattttttaatttataggtttcccttctattttttttattaaagtttgtttgttgaagaaatggatgtgccctgtattatccctttcataccccagtcttttgttacattatttttattggttgtcactcccaggtttatatcactgaatatgtaatacatatggacttcagaatcttaaaattatattgttgatgaaattatcaaatagtttaggacctgaaaccactgaagcttcccttcagactgacataatttttacacacacacacacacacacacacacacacacagtgttttgtttgtttgagtctcactttgtcgcccaggctggagtgcaatggcgtgatctcggctcactgcaacctctgcctcctgggttcaagggattctcctgcctcagcctcctgagtagctgggattacaggtgcctgccactatgcctggctaatttttgtatttttagtggagacggggtttcaccatgttggtcaggctggtctcaaactcctgacctcatgatccacccgccttggcctcccaaagtgctgggattataggcatgagccaccgcgcccaacatatttttttttttttggagtcggaatctctgtcgtcccgtctggagtgcagtggcatgatctcggctcactgcaacctctacctcctgagttcaagcaattctcctgcctcagcctcctgagtagctgggatgacaggcatgtgccaccacgcccggctaatttttgtagttttagtagagatggggtttcaccatgttggctaggctggtcttgaactcctgacctcaggtgatctgcccgccttggtctcccaaagtgctgggattacaggcgtgcccggcctgacataatttatattaaccaactcttgagatacaattttgagagccaaacctgggaggatgctaaaaagtcctctggatattatagggattcctaagtttattaccacatcattacaaggtacgtgggagcgacctttggttattagctatcacaacagcagactcaacctatgtaggtaggtttcttttactttgtctttgtgggcagatgatttatgttagctgcactcttgtagaacttgagtaataatgacactaaactcttgtgtcttttaatgttgaaaatatcttcatacaccaaatatttcaagtattttttgtgtgtgtttgttttgagaaagagtctggctctgtcacccaggctggagtgcagtggcacaatcatgagtcactgcagcctcaatctcccaggctcaaattatcatctcacctcagcctcctgagtagctaggatcacaggcatgtgccactaattttgcaccacccagctaatttttagaagagattacatccccctatgttgcctaggctggtcttagactcctgggttcaagcaatcctgtcgccttgggcctcccaaagtactgggattataggtgtgagccactgagcccagccagaacagttaaccagggtaattattccctctgaggtagtcaagtaaaagtttgattccttatttgcatagtgaaatgatgaatacttttttgaaaaaaagaacactaaacaatatgaataatcaaaatggttgttgttggtttttgtttttggtgagccaaagttttatttattcatttgaagtattctctgatgacatcctggcctgagactccttgccatagttcttaattactgcacaactgcaaacaaccactttacggggtttcccccatctgtcagttttatagaggcttacccattccccagtttcttcttgtcatcaaccggggttcagcacaaagggcctccaccaacttaacatacatgggctcatcacaattagatgcaagcacacaaagatgagcttggtgcctgtctaaggctttggcagctttgtgaattccacatgctaggccatcatggatgagggtggtcttcagcacctcttgtaaagcagtagtaacgtcccttatacctccagcagcaatgccttcctcagccatggtggtgagtgaaactgaatcttgaatacacccaggccgccacctccatgcaactcagcagcggcaaggaaagagctcaaaatagtactttttttttttttttttgagatggagtcttgctgtcacccaagctggagtgcagtggtgtgatttgcctcactgcagccttcacctgctgggttcaggcagtcctcccgcttcagcctcccaagtagcagggatcacaagcatgtgccaccatgcccagctaatttttgtatttttagtagagacagtttcgccatgttggccaggatggtcttgaactcctgacctcaagtgatccgcccaccccggccttccagagtgctaggattacaggcaagagccactgtgcccagcctcaaaatggcttaagtaattatactaaagatgtctatcaaagtcttttaggacatagttcactgtttttgcttgtttttaaactgatatttagtgagatatgttcttccccaataggtatcatttaaaggatgtgattgttggaaaaatttacttcttattagtaagaataaaaatacaacatatggagttacagctgatcaaaaaagagatcacaggaattggtaagttgaaaagagtatgtaaattaaaattctttgttttagttgacatttttaaaatcttaaaatattgtttaaacataatttgatatccacattgagtactaattttgctagttaatattgctggcagtaagttatttaatgtttttttaaattactttttgattgtccagaatttattttttataaaaaattaatttttgaataggtaataaattcacatggttcaaaaataaaatgtaaaagagtatacagtaaaaagtatcttatttctgtactctagctactcataggtaatatgtttattataagtttaaaaatcctcagtggagcaggtcaaaactcctgtgctgatcagtagtgggattgtgcctgtgaatagccactgcacttcagcttggacaacagagtgagaccattccaaaaaaaagaaaaacaaaaaccaaaactttccaattagttattatgtatacaagcaagtacctatgtataagacacacccctttttacttaaatggtggtgtataatgcatacttcgctttgccacttagtagtgcatcttagagaactttccataacaatgtgtagaatactttatctttttaatagttttccattttattgatatactaaaattgaaccagtctgctgtttgtggacatactggttgtttccggtcttttgctattacagataatgtcattttgcacgtgtgcaagataaaatcttagaagtggaattcatgggttaaacagcatatttgtttataattcttctgccctttttgtggcgaacagggtctcactatgttgcccaggctagtctcgaactcctgggctcaagctatcctcccacctctgcctcccaaagtgttatgattacaggcataagccattgcacctggccatttacaattttgatgcatgttatcagtaagtcctctttagggattatcccagtttgcattgctatcagcagtgaatgtaggagagtgcctcttttcccccatattctcatgagcacaatgctgtaaaaacttttagctcatttgatgggtaagggggagatactactacattgtagttctgggatttttcttatggattctttttcccccactgctttattgaggtataattggcaaataaaaattgtatatattcaagatgtatgatggaatgtttacattatgaaatgattaccacagtcaagctaattaatatattccattatagttttaattttcagttttctttttttttttttttttgagacggagtctcgctctgtggcccaggcgggagtgcagtggcgcaatctcggctcactgcaagctccgcctccagggttcacgccattctcctgcctcagcctcccgagtagctgggactacaggcgcccaccatcacgcccggctaattttttttgtatttttagtagagacggggtttcaccgtgttagccaggatggtctcgatctcctgacctcgtgatccgcccgcctcagcctcccaaagtgctgggattacaagcgtgagccaccgcgcccggcctaattttcagttttcttattgaggatgaacatctcttcatatgaataaaaacaatttttattttctgtaagccattcatattctttgccccattatctattctttttcttacttatgtgtagaaactatatattagagaaatcaatccccctccaccttttttttttttgagacagggtctcacactgtcacccaggctggagtgcaatggtacaattatagctcactgcagccttgaactcctggacttgagcaatcctccaacctcagcgttgtgggtagctggggccacaggcacatgccaccacacccagctaattttttatttttttgtagagacagggtgtcactacgttgcccaggctggtttcaaactcctggactcagcgatcctcctgcctcagcatcccaaattgctgggtttacaggtgtgagccactgtgccctgaattcctttttctaatattaagggtagcaaaaatttccctcgtttgtcttgtttgtggtggttcatgccatgtagaagttattgatgtttatgtagtcagatttatcagtttttcattttatggcctctgggttttatgccatggttagaaaggtctttttcacactgaagttctaaaaataatttcctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgtttcatccctgctttttgattttaatatataaatatataaacttactttctcctctaatattgttgggtgtttttttttttttgcagacggcgtctccctctgtttccaggctggagtgcagtggcgtgatctcggctcactgcaacctctgcctccagggttcaagcaattctcctgcctcagcctcctgagtagctgggattataggcacacgccaacatgcctggctaatttttgtatttttagtagagacggggtttcaccgtgttgcctaggctggtctcgaactcctgagctcaggcagtctgcctgccttggcctctcaaagtgctgggattacaggcgtgagccactgtgcctggcctcatcgtcgggttttttgctgaaagtaattctaggcaacactttataagaatttatagtcagtattcataatttaaaacatctgtgatttcttttattattattattttatttttaaataaaattctcacccaaggcatgatctcaaggcaagaggtcctgagaacatgtacccccatatgtgatttcttaatctccatgtttctacttgctagtaaatttaagtgattttaaaatcacttcaaattctcctttgttgtttcaaacaacttcaaattctcctttgttgtttaaaatgtggccaggtgcggtcgctcacctgtaatcccactactttgggaggctgaagcgggcagatcacttgaacccaaggaattcaagaccagcctgggcatcatggtgaaaccccatctctatcccaaaaaatacaaaacttagccaggcatgatagtgcacgcctgtagtcccaactactctggaggcttaggtgggaagattgcttgagttcaggagtttgagaccagcctgggcaatatattgagaacccatctctacaaaaattgaaaataaaaaaacaggcatggtggtgcacacgtgtaatctcagctacttgggaggctgaggcagaaggattgcttaagcccaggaggttgaggctgcggcaagccatgattggaccactgcactctagcttgggtgatggagcgagacaccgtctctaaaaaaaaataatgtagtggaaaaataagaaggcataaggctagtaattatattctggaatatttaaattaatgttatttacattattgcactaggacccagtaccacaacagaaacagaaacaatcgccaaatatgaaataatggatggtgcaccagtaaaaggtaacacacttttcagttacttcttttgtatagtgcaaacatcagtgttcatggcagttttgtttgtatttatttagtgtgaaagtatctttgaattcttaaaccattcttacaatgatagcttttaaggtcatctttgtacagctgcaaagaagactgtaattatatttcctagtctgaaataaggtttaatttttcagtttcaatttaggatttactagagacagttatatgtatctattctctagttttgaatttgtaatattttcattgtcttctattatacaatagttcgtctttgtaaatgttttttctcctgaccacaaaatggagtatggctgagcattaattcctgtaggtttttggagtcattatagctctcaagaaaataagcagttccattactagattaatcttcagtatctgagacaatgaagccagtatttatcattttaaaatttatgtctgggttttcttcactatttgtgcttacatcacaaagccagtaccatttattaagtgccaagtgtagatgaggcaatgtaatcttaggtgctctaaaactctttgagctaggtggttgtgtcccttatgatgcatgtatgtgtactcttgtgttatgcaacattactttgtaaaattccagcagccaccagtttttatgtaaaattatgagttttatatctttcagcaaattggtgtgcatgagaaaattattatgtaaaaaatattcaggccgggtgtggtggctcatgcctgtaatcccaacattttgggaggctgaggtgggcagatcacttgaggtcaggagttcaagaccagcctggccaatatggtgaaaccccgtctctactgaaaatataaaaattagctgggtatggtggtgcacgtctgtcatcccagctacttgggaagctgaggcaggagaatcgcttgaacctgggaggcggaggttgcagtgagctgagatcatgccactgcactccagcctgggagacagagtgaaactccgtctcaaaaaaaaaaaaaaattcaggggccgggcgtggtggctcacgcctgtaatcccaccattttgggaggccaaagtgggtggattgcttgagcccaggagtttgagaccagtctgggcaacatggcaaaacccccatttctataaaaaatacaaaaattagccaggcatggtggcatgcacctatgatcccagctacctgggaggtgggaagctcacttgagcccaggaggcaaggttgcattgagccaagatggcactactgcattccagcctgaatgacagagggagatcctgcctcaaaaaaaagaaaaagaaaaagaaaaaaaaaagccaggcgcggtggctcacgcctgtaatcccagcactttgggaggccaaggtgggtggatcacctgaggtcaggagttcgagactggtcagcctggccaacatggtgaaacccagtctctactaaaaatacaaaaaaaatttgcagggcatggtggcaggtgcctgtaatcccagctactcgggaggctgaggcaggagaattggatgaacccaggaggtggaggttgcactgacccgagatcgcaccattgcactccggcctgggcgacagaccaagactccatctcaaaaaaaaaaaaaaaaaaaaaagaatatgcaaagaattacccttaggaaaatagaagcaatgagaatctgaataacagtctttttggtaataaaagaatgtcatcattctgtccgtttttagctttgaatatatgagtaacaagtattcaataatttatacacatgattagaaattatggtaaacttcatgaaagaagataacaaaacaacttatagagcacttatctgttggcactgtttgagttttttaggtatattaacccatatagtccttacacattccttgtgaatactattgttattccccatttcacagatgaagaacttaaacaatgagtaagtgatttttccaaggtcacacaaccagtaagtggttgagatctgaagccaggtattctgactctagaacagtagttctcgtctaggggcaacttcacctcacaatgaatgtttggtgttgtctggagatatttttggctgttacatttggagagtactactggtatctagtgggtagaggccagggttgctgctaaacatcctacaaaggataggaccctccccacaacaaagaattattcagcccaaaatatcagtactactgaggatgaaccctggtctttgttattttgcatctcatgaggatgtgaagcattagtgtcaactctatagtgcttagtcctacctgttatgtgactatatttaatcatctttagaattaagtagaaattccttttctttcaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggtatggtgccacttgggctggtattatgttctgcggcagatctaaaaatacctcgaaagcactcttctaagcttcactgtactgagcgagtgggagtttctaaataaataaaaacactgtgggtatgatagataaagaagtagaggagaatagaatcctatgatagatccctccccaatcattctgcagtactccagaatgagctataatttttcagggcttttagttttctcttacaagttcttttgtttttgttttttaataaaaacaatacctgctgcttatttagaaaaaaataaggcaataaagaacaaagaatgaagtaaaggtcagcagaatttccaccaccattgcaactaatgtgtgtatgtgtgtttacatcatattatggatattgcttttttttttttcttactgtttttaattttttgtagagacagagtctcactgtgttgcccgggctggtcttgaactcttgggcttaagcaatcctcctgccttggcctcccaaagtgctggaattataggcatgagccaccgtgcccagctgtattctttaatttgcatttttactcagtagtgtcttgaatatctttctcttaacaaatatacattattattattattattattactatttttattttttaagatggggatcttccaagcaatcctccagtcacagcctcttgagtagctgggaggtacaggcacgtaccactgtgccctgctgatttatcccttttaaacaattctgtcataatgtccatgagatgactgaattctaataatttttttatttgagacagagtctcgctacaggttaatttttgtattttcttttttgtagagacagggttttgccatgttggccaggctggtttcaaactcctggcctaaagtgatctgcctgccttggcctcccaaagtgctgggattacaggcgtgagccaccatgcccagcctctaatcctttttttttaagttttttttttgagacagagtctcgctctgttgcccaggctggagtgcagtggtgcgatctcagctcactgcaaccttcacctcccgggttcaagcagttcttccgcctcagcctcccgagtagctgggattataggtatgcaccaccacacccggctaatttttctatttttagtagagactgggtttcaccatgttgaccaggctggtctcgaactcctgacctcaggtgatccgcctgcctcagcctcccaaaatgctgggattacaggaatgagccaccgcgcccaaccgcctctaattctttgtttaatataaagtgttcattacaaacttgttctcatttgaaaatcaattaaaagcttttggtgaattttgaatgaagatagtaattagaatggtcttttgtattctgaatcagattaataaacatgtagttaaatgtcagttgagtgttcaaagctaagttagaaattaccctgtcctaagtactgtgaaaaatacaaaaactaccttttataaacatgatctgtcctccatgttctcacattgtagatatctgggaaaaagaaaaataatataaactaacagaatacttaaataatagcttgacagtaatttagaagagacaaaacctattccagtattgccatcctaatgttgtataattaaacatacatgatttataactttgaaataaattacatgatttttacaatttcaaaatcaattgcatatcatggcactattggaggtaagtctgttatttcccatgtgcactcatttggatgtttaaattctgatatgttggggaaaaaaaaaagcctataatgacttcatgaagcaaataattttaggaatttagaagagggaagttctcaggatggattggttagggtaagagttaggtagagaaatcgagatttgaagactggggaagatgtagggcgagtttatttggattgcattggaggcagagagtaactccatttggccgatgggggaaaatggtcaagggagggaagagaataatgttggtaaattggataaaggttatagaggggcatgaatacctgtttggagatttatcctggaggcactgagaactactaaagagcaatccaagcaatgtgctggaggattaacctgctagtgataataaaggattagatagaaagggctctgcctctcttgcctctgaggaagctgttttaatatctaagtgacaagaacttgaatttggatgagggcaatgaacaattaaaggatggatttggggaattctttaaagtaacaataggacttcttgacagattggattggtggtggtggaatgcatgggtgctggtgataggagcactagaggtagaaggggcagtcaagattagagctggaagaaagtggaaaagaagttggaaaagaggagggcttttgtagggaagaatttaattttattatggttaaaattgaagtggcaatcaatagagataaggcatcatatcaaacattaatttgttaatatcttgcatttgtttactaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctcttctcattgttagatttattgtcgaggataggattgttcaatagtttaggaagctgtaactgtgataatgaatttttataaatattactggtttcaattttaaatagatatataatgcttttaataggctggcttaaaactgtcatatacaggatgcctatccgttttgctcaagactttttgtagcataaccaatttgaaaaaaattcaaatttaatatttggtgatttcagtcaaaagtcagccagctaattagaagtcataaactgaaaaagaaatttgtgtctttaatgaagagttacaatgtctaatctattggttctcaaccctggctgcatatcagaatcaccttagaagcttttaaaataaccaggcccgggtcctactctgaccaataaaataagaatctcagagactgggccataagcattaaaaacaaaacaacctcaaaaaaatacctgtcatctcagccacttcaggagtctgaggcggaaggatcacctggaattcgagaccagcctggccaacaaaaatgagaccctatctctacaaaaaaattaacaatgagctgggcatggtggcatgcacctgtatttccagctatttaggaagctgagacaggaagatccctttgagaggtgaagccagctggacttctgagttgcgtggggacttggagaacttttctgtcttacaaggggattgtagaatgcaccaatcaacactctagctaggattgtaaaacgcactctggctagctggaggtttgtaaaatgtaccaatcagtgcttgtgaaaacgcaccaatcaggctgggcacagtggctcacgcctgtaatcccagcactttgggaggctgaggcgggcagatcacctgagttccaggagttcgagaccagcctgaccaacgtggagaaactccatctctaccaaaaatgcattagtcgggcgtggtggcacatgcctgtaatcccagctactagggaggctgaggcagaattgcttgaacccgggaggcagaggttgcagtgagccgagatcacaccaatgcactccagcctggctagaagtttgtaaaatggaccaaccagtgttctgtagaatggaccaatcagcaggacgtgggcggggacaaataagagaataaaagctggccaccccccagccagcagcggcaaccggctcgggtccccctccatactgtggaagctctgttctttcactcttcacgatacatcttgctgctgctcactctgggcctgtgccacatttaagagctgtaacactcaaggcgaaggtccacggctccgttctttaagtcagcgagaccgcaaacccactggaaggaaccaactctggacacaccttgagtacacgaatttgaaattacactgaggtgatcatgccactgcactgtagcttgggtgacagagacaccatgtctcaaaaatctacccagagttgggaaccactgatctaaaccattaaaatttttatttctgtcactaatgaagaattttctcattgttttgatattgctggggaagaaaaacttttaccctcttaggatgagttcttgggggcctgcaaattaaataaacaagagacgtggccaggtgcctaactcttttgagaggccagggtggaaagatcgcttgagcccaggagtttgagaccagcttgggcaacataaacgggaccccaatctctacggaaaaaaaaaaaaaaaacaaaacataggggaagtggtggggcatgagtacttacgggaaaacaaatgacttagaagatatgaaatgagctcttatgaaaatagatggaagataaaattttgttacaatgtctgttcacgtgtggtacccatttattgtctcaggataaaagtcagtctttcctggttgctcccgggaaggggattttttagctcttttgagagcccaggcttttagacagctaag

SEQ ID NO: 13949 - DNA, 6900 bp, Human; identical to SEQ ID NO: 12601

SEQ ID NO: 13950 - DNA, 5203 bp, Human
  misc_feature (1)...(5203): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccaggagcccggggcgggggccacggggcggggagcagcgggtcgggttacggcgggggaggggagcggctgacccggcgccccgacctgctcggtgctgggtgcccagccgggagaggttgctcttccatttcccgggccttcctcctccttctccgaggaggctcgtactctcttcctcctccacctccacctcctcttgctgttgctgctgctgtagcgcttgggctccgagggctgtgagcagaaatctaatgagatctaactggctgtttatgtaattcttcacactcctgcctgtcttaaggcgttgctttgtaactaccttccaccgagcctgaatttcgctcggctgcaccttcaagcaattgggcttaatcagctgcctctgccggcactcaggcttttgacttggaaagtgtttgtagtttgggggcagccagagattctttttccctttgtcaccacgaatatggaaaatagaacagacgaattaagaccaacttgatttttaaacgtacttttaaatcaacttcagtgtgcaaatagatccctttcgcaaatatcttctgtttgcccttgatcttttcttatccccacccagtgctgatccagcaaacgtttaaaggtcgaccttaccatacttgcctctccggctgttaccgtgagagggagggagggagagagggacagacggaggttttttaaaatcagactaaaactcagaaaccctggccttaaacagaataatcaatagttttaatttgtgtctttgcttttgttatacttgctgccgaataggtattttcagatttagaaaaatacacattgaaaacaaaaggcccagagaagctggattttattatattgtatgctcttagtatacttaaggccgaaactatatagaataatttggttcataattatttactaggatgaagttcatttagtactcagtgtctttaattttagcatcatgtactatggaaattaaaatgatcttcctaacgtaaccaaatttttaaatgtcagtgacagagcagatttaaacagtatatatccaaagtaaactaaaacatggattcacttctaagttggtgaataacaataaaaattactacctaaaagtggcatctatatatatgggggtggggggaggatgctgagtacaataaatattcttgtgagaactgaggagagaagaatgcatgttctagagatttttcttcttagaactctattcagaaacaggtttttaaaagcattatttcatttgtaaatctacattttcctgtgtcattttaaactttaataaacgattttctattttatgtttattttgtgctagtaacagttttcaggctttctgtcctagtagacattttctttttctttttatccttagcagactaacacaggatcttagacattttgaaaggtgaaattactttggaggggggaaggtcatgggacttatattacatttatcttatttggatatgtttgcttttgttttaaggaacaagatcactcaaggtgaaggataatctactaataccagcactttgaatgaaaatttgtttctctgccacaaactgaacatctttttttttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaatgcctattgtctttgtttttaagtgttttctgaagatcgacctctggagttattatattgtaaatgctaatgatggaaaaaggcctgactcattgagtcacgaaggaataatggaaagcagttgctctactgatgtaccagatcgtggtttgccacataaaaaatgctatcaaaactatagcctgaccagtgcttggtacaactttattttttaacagccctcttcagtccacatttgtctaccccattatagagatggtatggtaaggttagctatacagcaagtttcaaaatgtcatgctgacatggaggagtcaggtgataagatgaaattccttcgtgtaatctgagatgatttatttgaaatttatatggagagagcattggatcagttttctgtttttgctgaggaaacttgcttggacaaaacggctgactgaacttagaaaaatttacatcactttactaatctttaaagtttagctattgcatatagctagagaacttatggtcaaaatctattcacggctggacagatggttagatgttagcattttcattttcccagcaaaaacgcttatgtatttaattttttgcaagtgggtacccaacctgctggtttgaaggatttagagatattgacaatgtatcaaattggagtggcttggtgaggatggagttttttaaaactgaagagttggggagaagaacactaaatgagtcatttcactaaatgtcaattgatacagtattgacatagtattggtgagaaagttaacgtccatttgatacagtgttgacatagtattggtgagaaagctgtcttaaaaaactttatatgtacttttatagtaagaaaccagcactgcctgggttaccagtgaaataaatttggtctcatgagctttttggacaccagtctacaaaagccttttgtcatttacccatgcagtgtagagcaatacaaagttttaaggaaacaagcactggaaataacagagctaagctgtttgtcagctccatggtgaggcttttgttctttagggaacagaacgaggctatgaagaagtattggaataatgggtgcaagcagcagagatctggtctgccaacacttaccacttacatgcttttgtgatcacgaagtttgaatagctgtaagaaccatcaggataatggctttaagcactagtttctgctacagactgataaagttacatttgggagaaaactctacttataaatgaaggctcaagtgtaatgtgctttttctgaaaatcataaggcagctggacggaacataatagaattttttttttttttgagacggagtctcttgctctgtcacccaggctggagtgcagtg

SEQ ID NO: 13951 - DNA, 36227 bp, Human
tttgctttgggtctctcttcctgttgggctgctctgagagatacttctgagcaaaccacagagttcctgcatttttgcctgagtcattcttgctgagttgaccttctctccattcacagccaataataattaaacaccgttttttctggaattgcactttatggatcagctgggatgaaagcatcttccttccttctttccccatcctctgcgataattttgttctaacaaaggaatgctagcaccaaaatttccagtcctgaaaccctttctctttccaatgtcctctgtaagctcgagttgtgggcatctactttgcccatattccaaggtcttgcttaggtaacctctgtagtcctttcttgagcctaggacttctacttttcttaccagttaccctctttcaggaccaaagctcaactcctcaaggccataactaggccctctcctctcaaactgatttatcaggtgcccgaatcttcctgaatgtctgggattcaacttttcagcagtcttcctccctacgttccatctaattctaagatgaaaccttctgattctttgttgtcctctgatccctacatgaacctgaggctgctgttccctgaagtcttgttctgtcagcatccaggcctgcttcataaaacctgtcactctgctaatggttagcggctgaacaaagagtcctctggccaaataagtttagaaaaactctgataaaaatattatttgggtttccttttcgcaggacttacctaagcctttaatatgcatctacggaggtaaaaataaagctatatattttttccaaagatatttgttgaagaaacatttgtcttctgcgtttcttaaaggccgagtgttctatggaacatactttaaaaatcccttttaaagaagcttagaccagagaatctccaaggtctctttcagttttacagcctctgagtcaacgattcaccaaaaaatattttggggggaagtgattgaagtggaaaaatttgttagtgtttagccagctttgtccaaaggataagatgcactgtattttgcttactagggagttattttctataatggaagacaaagaaagcacaagacacccatggttttgtttgttcaatcactgagagtaagtctcaattattgagacttacgatgtgccggtgtgcttaattctagttatgaaattttaataatgaataatatagattctattccttatatgagtttccaaaagcattgtccagaacatctatattaaaatatcttatcatatacaatatatgtaatttaaaatgcactcagaaaatctgcttgttaaaatgcagattctagtgcttcaccctaaatagtctaatttagacgggcccaggattttaaactagcatcttatagcatacttatgtacaccaacatgtaagaactgctgctattaagattctgggatggtggttgagaacaggagcttgttgtcaggtggctctagattggacagagaaactcatactgataaggtgaggattgtcaggaaataaggcaggcatctagcctcgcattaagatgaggtatagaaggcaactgatacatactaagtgctcaaaaaatattaactccctgtcctccatcatggctcaagaaaatacaacagctgagcacacccacgggttgcttactatttactcatcagtttagtgtatcttattttgtttccatgtgaatttacttgtgaagagatgactggattctctccagagataggaagatccctcctggtttaattcctacctttatttatttatttttcaattagactcaggtattgataaaaattcaaatgtcagattacaaaggtgtgtgggatttttcttcccacgttacacaatttaagtcgactgttttcagatcaaaactcaagacaactccttcaccacatttcctgtttgtaactgaaacaaagtacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggtaagtggcattttaaactttttgttccatttgtgtgtctaaaaattcacttaatttctaagtcctaacgagaagacccttagtatttagaaagtagttattttaaaaatgttggataacttttagtgtaattaaaatatattttgaaacatgttaatgagtataagttgacatttttcttttgaaagaaaaatgtggacagcattttagaatgtaaatctaattacagctgttcagtaagtgttcactgataattatgccatgtgaagtacttgttatttttaaagaagcttttgttgactatgtgtattcctctttagtttagtttagctattaaacaggataagtgtaattctaattcctcagagattaggcactatagtattttctagaaagcaatgcaattgtcaacattcagagagacaacaattttgaaaaggccagtgaaaattcaattgctgtgagattaatcatgagggttagatccatattcactcgctgttgtgaaagggttggatccatattgactcactgttatgaatccatgttgatggttcattcctcctgtattattttatgtacttttaatttattaaataaacatctttttgttgcaaaaggaaacatgcatattatgtaatgtgggagaactgtgaaatatatatattaaaaattcatacgtattttccatcaccttaaaaacacaaaatatgttttatttcctttcaaattttatttatatacattctatatagtttgcttttcataactgaaataataatgtacataatatatccagcttttttcactaacataaccatgtcccttttaatataacttctgcataatcattttaaatgaatgcacaaaaatgatatctattcagttatagtttagtcatttgtttattgctgaacatttatgttgtatacagttttttttgtttgtttttttttgagacagagtctctctttgttgccaggcaggagtgcagtggcgcaatcttggctcactgcaacctctgcctcccaggttcaagcgattctcctgcctcaacctcctgagtatctgggactacaggcgcgtgccaccacgcctggctaatttttgtatttctaatagagacagggtttcattatgttggccaggatggtctcgatctcttgacctcatgatccgcccgccttggcctcccaaagtgctgagattacaggtgtgagccactgcgcccagccctgttgtatacagtttttaaaaatatttttacatgacagaaagatgaacaactctatagctttttctgtagtaagggttattttttcagaaaactttctagaactgaaattattaagagattatggcattttaagtctcattattgccaaattgcttttccaagagtgatgccaattccctctcattctagcagtgcttctccttcacaggctgatctcctttaaaaaatcgtcactaatctcataagcacaacatgctaactcattgttcaatatgcattactttgattataatgaggttgaacatttttgcatggatttttaaactgtttatagctatcatttgtgatagtctgattacctcttttgcttaattagtatgctttgtacttttaataccaatttgtataggccagctatggagtaaagattgcatatattataatttctgtgaattggcttccattgttctgtttgatggatcttaaaaccaattgattacataaatcacacagggaccataagctggcatacaattttcatacctctccttatctttcccagttcatactttagcaaagaacaaaaacaagtgtcccaatttttctagtgccctgcaagaaatgaacatagcattactaagtataattccatgagctgatgatgatggggaactcagaaagcatgggaagaccaaagacggtgaatatgacattcctctattttcaggactaattaattctaaatttagaacagatatggtaacatttcctccatcgcattttgtagttcagacttcccctttgggtttaatacaggagctcctacatcaacagttgagaacttttacaatttcacagaagagatgcaaagacaaagtatttaaaaacctcacaggtattaaaagtcaaaacaaaacaaaatttcacatgaaggaagagaatcagatgatagtattttttatatttagataggtaaaataaaaaataaaataaatttgaacacacacaaaagaataattatttctagttaagtaaaactacgtatgaaaacaaaaacccaagtattttcttttttcctacctatatgcctgtagtcactgcatcatccataatgttctggtatcataattcctgctgtgtttctgcatttacataaaatctgtattaatggaatcaaatggtgaaaacaagtctttggtctatcattaatttaaataatgattcacaatttagtttactcatcttcattttttttaaaaaaaaggagtctcattgtctttactcagttttatcttctcttgagcctcatcaccttttgaggacaatgaaatcctttcttttagagactaggtgggactaacgtgtaaattatcttttaaactcagatgggtcaaagacaatgtttctccatttaatttaggtaatattatgaattgggcagtgtttttaaggaaagtcaatccaggaaagattgtcaattaaagatcatagttccaagaaataaatgtccccaagttgctagtgaataagagaaatcattattcggcactttcccagacatttttgattacacttaatcttctcagcattcctgaattaaagggaagagatgacaaaattaataggccttcttgaaatattaaaagaaacatcataaagtattttattggatgaaagttgccatacaaccatgccatcttcagaggatcttactaaggttcttctcaaataagaaacaataagtatacatataaatgaagtcactaaatacagagaaagacaagttcatctacagcagcactttaatctcagtagaatttctgaggtttaccaatctcaggtaaagtttaattgtagaagcaatgaagagtctagcattggaggaatcataatttactctcttctgtcctccacctcactctcatatttatactttcttcaattaaattaagtaaagtattgattgaggggaatcatgatgtgctaggaagaggtagccttaatgtaacacagatgaagatatgaaatccagttttacaattgtcttagtgagattcagtgatttgcacacaaccagccacacaactggtgactactctcattcccttttccacagtttgaaaataggtatccaaagctaatattactattttctctttccccatcacagcccactccccaacacacaccatttacttctcaaataaccccctgttcataatagacacataaggtcagtggatttcagatttgcattaaaaacagcatggtattttacttgaaagcctggaactgatttgcgagccccctcctgtgctaatatccatgattcaaatgtcttttattgtgggatgatgggtagtggttgggattgtgcatgtagtgatcatgtgtcacgttcaaaaaatcatcaagaatgtgccttatttagcaccaaccaccaccatggtaagaaaaactcattttataagtagactcatggggatcataatactgctattgagatttctgggtgcctaaaataaatatacacattcatggaatgcaaaaagacgttcattgctctgacagagtttacaagccaaggaaagccattaagagaagctatatgctgtaatatactataaactcatacacttgtctcagttaaagatagcctgaagtaaaaacaattaaggcattatatttattgctttttctattgctaattgtttaagtaaaggcttctgtgtaaatcaaatctgccagcagaaagacattatatttgcttagctgggtttccttccagagcacatgcaattgtgaatttcaaagacagtgcctgccaattactgttggctttaagggagtcagaggttttataattaaacccaccactattagcccctggtagttggaagctggagagaaacttaaatcatgattttcctagctgccattcctctctgataatttctcgaggccttcggctttttaacagtgtaaatagctgaattcaaattgtgtgggagtttttttaaattgatcaaagctatataaatgaaagtaattacaattaatgaatattgatactaaaggttacacttgttgggtaaaaaattttaagcactttgtgcatccagtattctaagaggcactgtctgtactaagtagatacccacaggaatatggagatatttatactgcatatttagaattactgggtaaggggaggtataaagtatgtgtgtatgtgtgtgtgtgtgtgtgtgtgtgtgtgtgtgtgtgtacgtttatacagacctgaattcaagttgaaaatttccatcattatctacttaatatctacccttctcatgtgtgtgcattgtttttcaaaatgggggtatttattgttggcaagcaaaaaattgtgaaagatattaagaatgtcataaaatacaaagcctccaaataaaaatcttcctgtttaaaatttatgtattatttttaaaaacttggaaaacagaagtgtcaggaattacggaccctaaaagcagaggaaaccagagaccatgtgaaactgcatcacacatacctaaactactccccaatattagaacttagattgtgttttaaaaggcctccaagtggttatgtggggcaaatttactctaacagtaaacgacaaaacacaaccctaaagaaatgtacagtgtgacccaaattcttgccttagtgtttctgacatatttcatgaaaattattaggactttcccaaaaacttttagtgtagcatataggcttgtgatattgattaggttgtttctttgtagctgagagtcaaattgtcttcttatagcaattaatggactaacacaactatttcaattctctctttaattggaaaggagaaagcaaaacttctatttgaaatataattttgtccaaatgattggatgatttatagctagattcagtgtaatttaaaaaataagattagggctttctgtttatttccttgaagtatgattggttatattgtactacattttatttactcaaaccataactatgtattgagtatatactaaacactacatgctgtggcaagtggaaagaaaaaaaatgctaagtagaaaggagatcgatttttattagtgttcccgagggtcatgagtgctagagatttattattattttccatgtatttatttacccctcctccagaaaaaggggtattagaaataagtgtaacagtatgaaagataaccaaataagtcaaggtgaagggaaaataaggagaaagggatatgattagttcacaaaaatgagtatcataaagcccttgagatttgcttagattgtgtatcaaagacagacagatgattaagtacaatattcacatgggatataatagcaaaaatgtaccagttcttaaggaaatccccaggcctttatatttgagacaccatgtgatgtattaaataatgtcttccagttcatagtatccttgaaattaatgtattcaatgaagagtttcatatggcttctttgtcttaaaacatgttttattttgtcctgagaacaaaggcccaaatgtggaaaattgaagcaaataagaaagaacaacagagaattttagattttattttctgactacaacatgaagttcaactctctgttgccattttagggcagattgtatgctttaatggtcggcgagatggaagcagtcttgacattcccttaagaaattttgaaaacataactgggacatgtccagaatagaaagtcatcaaagtctattttacttccattcatgggtagatccaggtagtttcacacaggcaaggtcaaaataatctttctgaaatcaacttctcatcccttcagcatctgatgagtgaatgatcaaggtcccaaagtatatactatagaaattggatgcaataattatagcttggactatttctaaagcagggttacaagtccaatttggccaaaggtaaatgattactgcatccattaaatgcttaattttaaccaatgcgactccctggtcaactctataataaattaactgtaaaatgagtttgtagggaagctgttctatactatattatgttatattatataattgtcactgtacaatgtacagtcatgtgctatgtaacaatgttttggtctggctgggctcagtgtctcgcacctgtaatcccagcactttgggaggccgaggtgggcagatcacttgaggtcaggagtttgagaccagcctggccagcatggtgaaaccctgtctctactaaaaactcaaaaattagccaggcgtggtggtgcacacctgtaatcccagctacttgggaggctgagacagcagaattgcctgaacctgggaggtggaggttgtagtgagccgagatcgtgccactgcacttcagcctgggcgaaagagcaagactccatctcaaaacacacacacacacacacacacacacacacacacacaacgttttggtcgatgattgaccacatatattatggtggtcccttaagattataatggggctgaaaaacttttatcatttagtgacttcataactgttgggatgtcatagtgcaatgcattactcatatgtttatggtgatgctggtgtaaacaaacctactgtgctgtccattgtagaaaagtagagcaatacaattatgtacagaatatttggtaatgataataaatgactatattagtggtttatgtatttactatactatgcttttatcattaccttagagtatacttcttctacttataaaaaaagttaactgtaaaatagcctcaggtaggtccttcaggagttattccaggaggcattgttacaggagatgacctctccatgtgtgtcattgcccttgaagaccttctactgggacaagatgtgggggtggaagatggtaatactgattatcctgaccctgtgtaggcctaggggaaagagaagtgtaattaactttccactttacattcatggggctctacatagtatgagaaaagctccctgtggccaatcttaacaaaactgggctccagaattattgttttatcccaacacatcgtattctatactactgagatcaatggaagagaacaggccattttctgtaaataaggaaagcgtgtatgattacagtctgaggattaaagaaaggtgaaaagtatagcaaactagaattcttggtaatttgaatgttgttgatttttgaacaaaagttttttatcagtcaccacttgtcaccttttaatagctacacaaaaaagtcgtttatttcataaacactcagaatgtgagaaacttgaatccttttgcccatgctgaattcagcaacttaacaccaacacccactttgaaaactgaaaaaagttatgaatattaattagtttcccggtagagactgtgtacttcattatgaataaatgcaacagctttaactgtggcaatagccagaccaaaacaaatgggtaagcagctgttatattatgtgtatgtttattttaatttccaggaatctctgggtgcccctttttcctctggggacttctagcattgttgggcttggctttggttatatcactgatcttcaatatttcccactatgtggaaaagcaacgacaaggtaagacattttgacaaatttcacatggtacctgcttgaatggagactatggagtcactggaaaacctatggaagcagacaattttatgaaatgtcattcaacaggatatttttatctatagaaaatctatttgctaatttttctcgcccaaagggttctcttatttaagaatgcaatcatattagaaatgtgaaatagttatccaatttaggaactcttctttagggtgtagagtgggaagggattatcctggtaaatacgtttttcctcctccagttgaaaaacctatgaaattgtagtctatgctggggcagccatcaaggttctctctgatacataataaacaaagggaagtctagctctttaagattccattcaagccaacttaatcttctcaggatcagtcaggcattctcacatgcaacacaaaagagcggggtcagaagacgactggaaaaggaagagattgaaccatgggcttgctgtcaaacactcccagagtctaggagaggtcaagagtatctgccactgtcagctttgctttttcaacatgctgggcataagttttaaccatgtggctttcaatctgcatatgccacaactgaaatggcctgaagcccagcagctggcacagcctttgtatgctgtaggcatccaattcatgttgaatatgcatggatccatgttgaatccattacatgttgaatacatatggatggatgggagaatgaaagttcaaatattgctggaaggtatctttttttttttttttttttgagacaggatcttgctctgtcgcccaggctggaatgcagtggcatgattataactcactgcagcctcaaacttctgtgctcaaacaatcctcttgcctcagcctctcaagtagctaggattacaggcatgcacaaacacatccagctaattttcagaaattttttgtagagatgggagtctcactatgttgcccaggctgatcctgtactcttgttctcaagccatcctcctgccttggcctcccaaaacactgagattacaggtgtgagcaaccacgcccagcctggaaggtgtttaaataccaagaaacccttaagggcaggacatataagtggtaataaaagaaaagaaaagataaatgcatttccttttaacagaggaaatgaaataaaactaagttaacaaaattaacttagacacatgtgtccaagaaaaatgtcatagagctaatttagaacaatggtcagattgcagcaaatgtccttgcttcacttagaaatatcttaagcaccgataatactaatataaaatatgaagaagggattattgtcatgcaggtttgaaaataagatgagaggtactcgaaaatggagtggtctagctgaagccacacatctattcaatagcaaaatcaatgataagtgtccagtttttctaattctctgtcccaaaaggtttctaccagtacatccttccttgacattgttgaccagttgtcctcagccagaaacccaacactctttttggatctctattatatcaattctatggctaaggtgaaatttatgacaagcaatctttttcattagcaatgctttcagtaatcttttaaaaatccaatatattttcaaataaacataaactatataagtcagatgtataaatgacccatcatcaaacatcttctacagtttccctcctttatagataaaaatgagctcagagtagcactttgctttatatatcgaattggctattttaacttctttattaagatatcttataaatccagataatatatagccagaattacaaaaaaaatgtgaattgagatctacagagagtaaataatttaaggtgacaaccaagacaagaccagtaacctgaattagtacctcactctttcattgattccactgataatccttttaagattgctgaggggccaggtaacaggtagacattgacatgcttaccttgagctcaattgtctaacttaaaatttatctagcaaatgtgacctatttactttcaaccttaatagtcaattttttcagtcctatgattgcatgaattatggatgttaagaactgctttttatcaacatcatcaagatcaggactggtataatttcactaatgtagtacttctgccccagaagtattcagctgtactagtcttttacaactcattgtaaataggttttacaattctcatttttggtagtttgtgcattgggatttatttacccacatgcatacctttttgcctccatgcaaactcctttgtgtagttgcttactatggtaatttgaccactgcagaaagacagtagccttactttaaaaagcatcgtgtttggtagttaaaaaagcagtgcctgtaatcccagtgctttgggaggcagaggtgggtggattgcctgaggtcaggagttcgagaccagcctggtcaacatggagaaactccatctctactaaaattacaaaaattagctgggcatagtggcgcatgcctgtaatcccagctactcgggaggctgaggcaggagaatcgcttaaacccaggaggcagaggttgccatgagctgaaatagcgccactgcactccagcctgggtaaaagagcaagactctgtcaaaaacaaaacaaaacaaaaaaaaaccacgttttcattttgttatttcaggacagattttttccttttcaattgtgcaaacccttactgccccaagcatgccataagcagctctattacctaaaagtagtgtaatggaaagaacatttttaagaaaacagtgaacaataaattgcatttattgatgtattttttaaataaattttgcttctctcaattgtttttaatagtatacctttgaagtagacctgatgtaaattagaactctgccttcaatatttagctggaagatcttgtacaagtaacataatttctctgagtttcagtttccttatctataagatgtggaaaataccatctagaccctagggttcttgtaagaattacacacacacacacacacacacacacacacacatctttgcatagtgctggggacttagtaggtcagtcctagatctggtgcagcccatcaccatacctagtggccgtgttgtttccttccttctttccacaaataattattaaggatctactatggctatatgtcatcccatgtaattttcacatctgttattttggtgaacattggtttctctggctactttgctgctcccaccatccctatgcccctctaagtcctctccagctccaacttcactttcctcatctctatattatttaacacatctgtacaataccctgagctttagcactaaatgttgtggtcatgtatgtcacattcaggtccatttcagagagttttctgtagagttttatggaattgattctaaacattagcttatcacaaaaccttttatttgagcagtaatgtaccctcattaggtggagcatacactggaacttgcattttattggtgtgcaattgatgtattcatcaacgctaagaatgtcctttgttcttatcccacctccaccctttctctctgccccaacttctcctaacatcttttcccaagtattagtaatagctctgcctttctttccatcccatatgaacaaatagaactatctttgtttctaacccagagatttcaaatatatttcagaactgctctgcaaacagttcagttccttccaatcttcctgaagaagacttcctgccttatttctctgggacaaacaaactataataaaagagattctattgtatcaactggcttttctgccacttgggctgtgaatgaaatgcccctgtatctggcctcatataactttttatgtttgcatctttttgttactctttgtggctgagaaatttgcaagatctgactccaccttggttagtcagtgaataagttttgctggtgtaataaatagcgttcaaaagaaaatctccatttcagcaacaatacaatatctgcacattcaatcagatagaccagataagcctccccttgatgttttctgtagcagctaggtagaagctttgaaatggagttctctcattctccctaaaataaatccttcattttttatgtgattctttgttcaaatctgttctttaggaggattatatttatttctttttctgataggagtgcattcactttttccttctttaaatccaaaaactattctttgtttaactcttcctctctggtttggaaagaaggataaacaagcgtatggtttggtcatacatcaaagtcctatcagtaggaaattatggcatcttcacatttaacatgtatcagagaaatttcattatggagtttaaactatgtgccgttgtctattcttgtacataggagggttaacactctaagaggaaaaacataaaagcaaacatatttgcatcacaccctctcaactacaaacctgaccacaagtgtttgcatctgaatcacaggagaggattatgagagctcacctagttcttcccacgcacagtcttgcacatttcattgctttatagcaaagcatacactttttttattttgctaaatgtcattgaaatcaccaggcagcttttaaattaagtcatgccacttatttttaaataaacttttgagccttcatgacagagcaaacttttcagaagcctgagcttgctggcttttattctgagctgtaacctctgaacttttcactacggctcatttaaagagattataaccttcttctagggaggactgcaaaacaaaattacccaagtactgatggctcagctgcagattatacatttacatcctaaaagtagcatggaatggggtgcccttgaacttcttacatcccatttcaggtgctccctttaaccattacttgttttctttattttccccccaaattggtttagtccctttccttccatctaaacatcacattattatattgtatcctttatatagttgcttctatttcctttttcccacacagtttttgtcttttttttcttttattcccctattgataatacattcagcacattcccattcaatagagttagttgtttgtttgtatttatttatttatttatttattttttgagaaagtcttgctctgtcgcccaggctggagtgcagtggcacgatctcagctcactacaacctctgcctcctggattcaagcgattcccctgcctcagcctcccgagtagctgggactacaggcgcatgccaccatgcccagctaattttttgtattttagtagagatggggtttcaccattttggccaggatagtcccgatctcccgacctcgtgatctgcccaccttggcctcccaaagtgctgggattacaggcatgagccaccgtgcccggccagagttagtttttatgtgttacactagtattctttctaggcaccagcgttcatacttcaagcacctccatctgaaaaatccacattatcttttaaaaacattagcctgtttggggaattatttttactccatacctactttttcttattcttattaagcaatgacactcttcacttttgttttcaatgtttctgctgatttttttccttttctttcaaattaatgctcagctggtgactatccttttgtcaagagtgagattttagtaatttcatttcaaatcaagcattacttatatatcttttaacttcaaaatatcataccatcttaataataccagtgtgttttcaactaactcgttcattgaaacttcctgactcaaatgagtgcaattaatttctggcttgttatataatatgtatttagaatgtatgtataatattaataacaaactttgtcattaaaaaatgtttttacagaaaatatttcatttacctctgacatgtactctgtgatgtaggcattattgtccctacttcatggataaattgagcaccagagctttaaagcaatttgcgtgttgtcacagggcaaatgcattgcaaaactggtaccaaatccatatcttctgattcttaaccctggatttgttccattatacatcaggctaccatttgactaaattcttatgcatctactttaattccaggcaaatctgcaaaataattagtggcctgagtgtaaacattttcttcacatagaaggaaatcaacatatactttatgtcatgtcttatttatcagtttacaatttcctggtctatattaactattttttctttatatgcttcttgacattatttacatttctcaggttttttgattttgctgaacttgtggctactatgcaatatgttttagcctctctaggcttctcccaacatttgtgtgcacttgtattcacaagactagtatgaaagtagttgaaaataactgcatcttttacatgcagttcatggtagaacatttcctctggactagaagtatgtttctgacatattccaaatggaatacattcatcacttttggtcccatagcagcttagtgcatatgctccgcaaaatcttccctcatttagtccttcacagaattcttccaaacacattgacatgtgacatgtctgtttcatcctccagtatgattactttcataaattgttccactaatgtgtctttaacagttaataacctctctggagaataactcaactttgttacacataaatttaactaaaataagttttgtagttgtttggtgacttactgaattatttgaaaatgttattgctagttccttactaacatagagtgttttcacatgttcaagttgaaagataatcatttggtcactattttctcgtgattattgtcagagagttagataatagtggtctttatttttacattaataacttttttgcaaggttttggcttttatttaatgccaggttgaaaaataagccattcaaatataataaacattgtgctgtatgtgtgcatctagttcaacagtaaagaaaatttactgatgaatggataatacagaattttctataacattgatgttaagactgtaccctgattatcccttactttttttcaataattcatcatgaatctattgccttcaattaaagaaaattcttaaaactacatttgttaaatagcttttgaattcttatatttgacctagaagtaaaaatacttttatttggctttgaactgcctcattcaaggtttaacagtgagttgcttactgagattcatcacatagtttttttctgtggttttgttgtcctacaacacatctctggtaagtcttgtcctggcagaccaaaaataacttttcttttcttagaagctgttctactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagaaaagtctcctattgatttttttcgtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctggtttctcttcaagtcatataaatctttctttcttggtaatttggtaaaaggcaaatctgattggcccaagaggagacctttaaccctacttcaatcagaggtgccctgagagccttggtcaaatatattaattgacattgaggctaaactcccctcagaacacactttagaatatttaacaaaggtatgtcaacatttcttttaacttgtctattttgaatatctttcagataaaatgtacagctactccagtgaccacaccaggtatgctgtgattcagtcatggatcatgattcccaactaataagcaaaagtaacaatgctatattgtttaaagatttggctcatggatattgtacttaggttaaaatgaaatgaaaagtgagttttaattacttttactctcatctaaagatcagaagctataacattattatctgtcctagttatttgcacactgtgagtcaacaagaaagctggttgaaggataaaatgagattctaacctgataactatagaattatcattaatttcagaggcagatagcctagattatgatccagcttagatacagaattgtgctacacttcaaaatccatagtagaaaacaatctggcaacctaatacaatttaagatatgtatacacgggccaggcacggtggttcatgcctgtaatcccagcactttgggaggccgaggcaggcagatcacgaggtcaggagatggaggccatcctggctaacatggtgaaaccctgtctctagaaaaaaaacaaaacaaaacaaaaaaaaattagctgggcgtggtggcacatgcctgtagtcccagctactcaggaggctgaggcaggagaatcacttgaacccgggaggcggaggttgcagtgagccaagatggcaccactgcactccagctggacgacagagtgagactctgtctcaagaaaaaaaaaaaaaaaagatgtgtatacacatagatatacacaaggatgagtagcgctatgctgtttgtagagttaatgtcaatcaatagggaaacgtgatgaacagatactctgaaagaatatgctgttatagatgtcacttattctctttaatagttattgagctatttgcaaagaaatttgtatagtagtatacatttttttaaaaaaaatatttatggcataaatcgtagtaaggaaattttactttttttgtatagaatattctgacccagatgtgtcaatgtattggagatttctgttttaggggtaaaaaaaaaaatctaaataaagagaatttcctagagggctcttcaagacctttctgaaatggtagactgaaaggtctttgaaaaacacagagctttctcactgggtaggataagaacataagcctttttggtctctttaaggtcttttttttaaaaaaattctttttccatgtgaaaatttcttgagcaagtataagatctgggctgcaggcataccccgtcacacacaaaatctgtttttatgactactcttaacattgaattatttaacattagatacttttcaagtcattagtttatatcaagaatgatttgcttactgctcttttggtttctttttacaacacataatgatgaaaatcctatataatcacacagtaagagctaatctctttaatgatctatttaatacttgtaatttgaagggcaattaagatgcaatgtgatagaaagtcttgtgatttgactatttagctaaattaggttgatggtttagggattaggatgggagcaatgagagggaaaattggtaaaatacctgcctcaaagcaatcaggcttttagctgtagggcaaatgtaaaaaaaaaaaaaaagcttttataacatttattcattcaataaatattcactcaacaaacaggcactgtgctagacaatagcaaaataagtttgctgattaccaatcccaagggaggatataggatagcaaagatcattactatgccaaccaccaggaataggagtctgagcgcttcagcccactgtgtcttgggatgcacatttactactttcctgagtctggtgagacaaaacacacaaacaatgagttacataaagtgagcttattacttactcagcaaaggacaaccaaagtctaagattcattcagagatagttccccaagcctcagaaaagctgtccaaggtggatggaaactcatcttcctgttccccacctgcactgcagctgaaggactccagaaagcagcctacctttgggtttacccctaaggggcaacatgatatgctgggctaaagcactgaaggatatcctgtttctgtgagagactagaataaaacctaggctgttccagctgattcttctttatccctgaaggttgcatttccagcacattctacagttattcttaaaaattagaagtgagaaaagaaggaccagttgggtgcaaagtcacccagagaactgtcctgcaacaacaaagatacaaagatggaaaggcatgaatctttcccttaaggatttataaaataacctattgtctattgtaacaaatctccagttaggcaaaatttgaatatacaatgcagatttttttctataaaaaagcgttgatattttaattcacaagtttatgtatataccttatattttgtctatttctcttgcttatgtggtttgggaacaaaaatctcttttgtaaaggggcatggaagctccacaaacaaaccagtaagcgaactaaaaactatctgaatccattaaacattaaaacagggcaagtgaaaataaggtctatgtttctcgggtggggcttgcgttactgatgcctcttcagttccaacatggtttgtggccatagagaaaggaaataaacttctatcgcactgggttctctgttgcactctctccccactcctattcaatactggcttatgctggaagggaaaggaattgcttctctcatcttatttctctgtttccccattccctgcccttcctgcaacagtacgtcagaaacatgatcactttaaggaaaccatagcacctaaatcaagcagaaaatcaaatacacactttctgctatttattcttgggtcactttatttctcatttaaaacataattcttgccttttggtttgtgttaggaggataatactgtgagactatcatggatttgagatccaggcaattctgaattttaaacagacttgcaattagtggattcgtagtcttggggaaatgagcattggtgaaatttggttttatcatatgaagaataaggtttataatataatactttatttacagagggtagttgactaaaaagctgctgttttattgaataaaaattaatgcctctgaaaattcctgcccacttgcagtatgttcacaccctaattcaagaaagcagttcaggtttacaattacattaagcttatcatgactcctcagttttcagagtctctctcaaaaagcttaggatgcatttccagcagattttcatgaactgcttctgggggacactggaggtgcttttatcataaaacattaattcagctcagctactcttctactttccggtgatttcttgaatttctggagctctgcagggtggggatcttctgtatttcctttctttgctaactatgctacctaaatataactagtctcatctgtcctcttcacccattctcaaggttgagaatccttatgacaagagaactcttgggtccccttccctgacatcacagacttccaagtggctatgcaggtggggccttcactagacccagtaccacatgtgtaaccaaagtgtctctacgtcttccagcctcctgtttgtttcaatgtacaaataatcataacccaagccccagccctgtataactacaagaagtctggtccctttcctaagcaattctgagaatctcggggttccccaaaccttattcttggctgcccccttgtcacctctagctccgtcactgctcttggattctccgtcattttagaaattgtcatgctggcagttctttccagtatcctttccgccaaactttggcgaaagacccttcttttcaagtgctctaaagcactggcaatgtgagctcattgtgcttaacagactttacaaagaaatgagcatattagagaggcacgtgaacactaatcaacagaatgagaatttagtgttagatatcatggctatgagcatccattaaccatcacttcagagacaacactgctggattcacttctcagcctcagtcacacaaaatagtgctaggatttatattcttcctctggatcagggttctctatttggtgccctcctgcgccaagttcaagacatctacactcataccacagcccatgccagagaaagcgaaaatgtaataagcatatatgcatcactctgtcaacttttcctttgtgattctgcattgttactttttctgtcccctttgtatcattcccaccaatatataaacagactgtattgtttatacctttaaaaaaccaaccatctccttaaaactagattgccagccgggcgtggtggctcacgcctgtaatctcagcactttgggaggccgaggcaggcagatcaccaggtcaagagattgagataatcctggccaacatagtaaaactctgtctccattaaaaatacaaaaatttgctgggcatgtcgtcatgcgcctgtagtcccagctacttgggaggctgaggcaggagaatcacttgaacccaggaggcggaggttgcagtgagccaagatcacaccactgcactccaacatggtgacagagcaagactccgtctcaaaaaaacaaaaacaaaaataaacaaaacaacaacaacaacaacaaaactagattgccttacagctacctcttcattgctcttttctcttttacaagaaaacttgaaaggtccctctatattctgtccatatttgctggcttttcttcctcttttcctcttctttcttgaacctactctattccatatgtcctcactaatacactgactctactcttgtcaaggttaccatgatcaaatctcggtttcagcttgctgagtccctctgcagcatttgacaccctgacactctctacttgaaacacttgattctctgggctctgagccacctccctctttggttttcttcttctcttaccagcagccccttctcctttgctggtttctgaatcttaaacatcacagttcccagggcctcattccataaataatgtcatcctctctcatggctttaaacatttacacacttacggagcccaagcttacatctttgcctattcagagtaacaactatgaagcaaatcaggttagcaattaccaaaaccaacttctgatagatcccaaagcttgtcctttcccatctctggcaacttctcaggcccttaaaatagatttatttcgttttgtaaaaaagtctttcaattttatttggatgttggaatcctgcatttgtattctagaacttgggaactgaaaagaacaatagaaatcaactagtttaatctcattttttaagtaagacaatctaaacttagagaatttaagtccaaggtgatcaggtagaagtagtgattttttttttttttttgagacggagtctcgctctgactcccaggttggagtgcagtggtgcaatcccggctcactgccttctctgcctcctgggttcacgccagattattttttaatttgaatttagttatttaaatggactttgatcacaaactacttgaggaattttttaaataaaagacctaataaataataaatataaatataaatgtaaaaaataggaactagaaaaaatataaatgtggccaggcacagtggctcacgcctataatcccagcactttgggaggccgaggcgggcagataatgaggtcagaaaatctagactatcctggctaacacggtgaaaccccgtctctactaaaaatacaaaaaattagctgggtgtggtggcgggcgcctgtagtcccagctactcgggaggctgaggcagcagaatgacgtgaatccgggaggcggagcttgcagtgagccgagattgcgccactgcactccagcctgggtgacagagagagactctgtctcaaaaaaaaaaaaaaaaaaaaaaaaaagaaatacgtgtatatatatatgaaagcacaaagtctggaccatagtaatagatataattaatatatttttcttaattttggagtgtcagtaaatgtacttactggttagagaattatttcaggcatgttcagaacaatggagagtctggtctggctgaaaactcagaggtacactagcctctcagatatgagttcaattattaatttatttttaaaagtaattaatcatccacataaaatactgccaaacatttgctcctgagctttattacacatttacaacaggctggagctatttggcattgccaagaatatatttttaaatttgtttgttaggcaattgctcctgaataatagtttatttgagatgattaatcatttgagatgggcctgtagacacaggacactgcattataaatcacatcttattttcattcatagggaataaaacaatactcattttttggacatgatttatcatttgcaagttggatctgccatctatgtgggctaggaaaatggatggattgtcttattaaaaattcttcagtttttgctattatattcttggcatggagaaaaatcatgagcagggactacttgatatcccaatattaagctgtattgaattaccggatggaaaaaaggttacagatgagttcctttgttatcagatgagtgaagtgtttgcccatatctgggcttttcaagccatttcatacaggtatcatttgaactgttatttttttaatacctacgtactatttacatatactgtgtcttttttcagtggcatagagagtaatacaggtgttatgccttgagataagagtcctttttttttttcttttgatgaaattccctccagctctcagtgacatgtaatctcaaagttaaagcagtcggtactattttatgaaatgcgactctcaccacctgataagttcctcagttcccagactgccattgtgaaatctggtcactagggccatcatcaatggtaggatgacattggtagaatgacagtctagtgacaatggtaggatgtatactgtaatcctaatagcattactcacgtgaggctggaaggaactttaatcagctagcaagagcaaatagctgtgtattcttgtcagttctcttgacctgagggtcggggagacataaaactgtggtccctgtatagtctctagactgtttccccacagcctttgaattgtatcacccactgaataacttcctcatgatgtggactgagcacggggctttacaactaaacttgctgtacaatcctagcactgccagttactgactgtgtatctgtggacaatgtcattaacctctatgagctgcaaataccttatatgcacaatagggataaaatatgcatctcatatgattgtcctgagggttgaatgagcacttgcatagagaaaaggtttcacaactggtagttattgctgatagttgagatcagcctagggaaaataaattaatctatctgaatctcagggttctcccctgtaaagcagggaagaatactactacttttggagaattttctttgtgagtttttgatacaatgtatgtaaaacacctaactcaccatctggacataataggtgatcaatcattttattgcatctgctaacctcagtctgtaatactcagaaaacatggttttaagagactgtttggactgatattctgggtgagtaaagaggcagtacattgtacaataaagagcatggattacctgggttctaattctaactctgctatttgttagtcgtaatcttgagcaagtcatatgacctctctgtgcctcagatttcttatctgcataaggaggatgatatagtacctatgttggaattgagagaattaaatgaacaaacataggaaatatactctatgtagcacctaatatacagttactattgaataagtatttgctatcatgattccctgtaagaagatccaaaaaccaactttttaaattcacacggaacacagatacacatacacacatgcatgcacgtgttcactcacttgcacaagaacacacctaccgtggttggctgggggtaaccaagaacaggcaatagttcacttaatattgaatttagctgagaagtcagttatgaattatgtgaaaagtggaatctaataaggtaaattatttttccttgttatagggttgatgagtattatattgaagacacaccaatttatggtaacttagatgatatgatttcaggtaagttttccataagttaaatttataaataagtaaatcccagttggtttcacaaaataatttaagtggcgctttaaaaaaatcaaatcacacttagctatcccagtgataaccatcaattcaagaacttttagtatattaattaggctacatttccaaagctgcatattgtaagttgtattacaatagccactctaaatcaacatcctgtttttctatattctcttcatttcactctagtagtaatgagaatacaggaagactattaccatgaatttcaacacacaccgaattctatgaaataaagctatttctaggacagaaagtggtccacagaaacagtgctttgtgctcaatatacaaaagcaaatgtacagtgaatagcatggaacaatgaacagtttctttggtttctcatattttaaatagagaatgtagggctggattgatggcaggtgggagaaagaggaactaaattgttgctgagtggtttatatatttattttgttcttatgtaataagcgctcttcagttcccagcatcccttatcacttgtgtcatcccagacatctaaaaatgaaacatccctaaatttctccaaacagataaccttggtctgattctagagttctgatgatagaagctaccaccctttccctgcaagtactcattcaatacatcagaggagacttgggggttaaatgctgttgaactccaagttttgaacacagagacatccagtaatgtaggaaatttatctaaaaatctatatattaaaacagtatggaatcatcttaaagttagaaatgtgggaattttcttttgcatgattcaagaatttatttttatctttcctttcattgtagagtgtcctctagtgctctaaggaatcaaaaattattttttggaaatatattattcaaaataatttgtccccatttcactttggagaatcatgttagtcacctataatactcaactactcaaattcttatgtattctgatggctccaaacccattatacctgctacttccatacttaagtgagcccaggtgccgcttgcacacattctgatttagcaggtccaggctaaggcttagagatctgctacttaacatcccaggtgattctgatgcagattttccatggaccatgatttgagaaacaccactctacataccctttctctgtgttgcttttcagaaagagctcaatgattattaagtcgcttttcttatagtaaatatatctttctctctctgagggtcaaactggtacaatccacacttctgtcaggttactggccatcctatgagtcactacttcactttcttcttccttttaaatggacatatctgggggaagaaaggtatggatgattcaaaaggcatgtccccataggatgaaatgagtacagatctgctggctgctggacactgtacaaaagccccaaatactaaggaccagcattgtgcagccccagacccttaggcagtctggctgagatgtccgtcactgattgatgggacaaaagtcataatataaaccctctttttcaaaattaagatgtgggacttaaaatgtccctgagcaaaactccttactcaaagaacaaatttcaaaattgtaatcactgatgtatgtgcactgtgctttgtggcaccatgcaccatttgcagtctatcttaaataaagaatactggcaatcccttaacttgtgagatctctataacatccaaatggtagcttaagactgtcatgtcctgcagtggtacaagaaaattcatatgatctagttcttattccaaggatttatttttatcttactaaccctttagctcaagagacttcaccgcctgatctgcaggtaacagtttgggcttccttacctctttctatctccaccaaaaagactagttaagtaattcttgggcagtttatatttgcagccaaatgttgtttggatcatgtatttttaatcatactagtatttttaaattttctattgtgaatcacaatctttttaattcccaagaaccaatggatgaaaattgctatgaacaaatgaaagcccgaccagagaaatctgtaaataagatgcaggaagccaccccatctgcacaggtgagttttgttttctgtttccacatttgcacatttcaagagcataagagtagtacattatgatacacatctgaaatagcctgttagaaattttgcaatcaatcagatgtcaagttctgggacctgagctctaactcagggtcatgtaaacagaactcaaaccatattcaaagagtcaaaattgtacacaatcacaaaggcaatagattttaagggaataatggaattattcctaagtaatctattaagctttttctttctgattgaaaattttgtgtatatcacagagataatataatatagaaggtgacacatggataatgctcacaagacctaaatgtcaggaattcaaaatacagagctggggtagggagagggagacctttagttataagataaattagctagatacaaaacatcatatccctattttaaaaggcagatgactttcaattttaatacaagtcctgtggctgtggtcttatggcaagagattgcaaaatatacacacagtttatgtggaggtaggcaggacaaaaacctaaggagaaacataaaaatacaggaagaaatggatagtttctctttttcctaccacaatctgttcaacctcttcagttttagttctaactttattaaaagccattagaaatttttagcctacatgctcctgaaatgctatacatttcaattaaaatagtttttcttctcctctcagatcctgtcttgttactgcctagaaatggtaatagagccagcatttcctaagcaatttttacgtgttggtcttgtactatgtgctttatgttcattatctccttagattcctatgagggaggcagcattatcattcccattttacaaatgctcacaaaggatgaaaacttgcccagaacacttaggtactaagtaagtagacagaatccaaacttagtcctctcttacagaacattctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatggcacaatctccactcactgcaacttctgcctcccgggttcaagcgattctcctgcctcagcctcccaagtagctgggattacaggtgcctgccaccatgcccagctaatttttgtatttttagtagagacggggtttcaccgtgttggttaggctggtcgcaaactcccgaccgcagtgatccacccacctcggcctcccaaagtgctgggattacaggcatgagccatcgtgcccagctgaatattttttaactaagaaaccaagatgtagtaggagttgggaaaaatatgctcaccaaatctgccatataatgtttagttaattataaaatatattttagataaacatatggaaaacctgcatgatataatatgatttgctaaatccatgataataaaaagaaaacctctcaaggaaggttaaaatacattatctgaagtgtagagattcacagcactttagttgtaaaagtactgagaattctgaatagaagttactatttaatacacatgacttgtacagggtagctttatttgacctgcatctggctttcactcaagtgaaaattatgcaaagccttaaaatgtctttaaaagcctgctcttttgtaaattgtgtatttaaaggtacttctaagaaaattagtcttttctattatactattctcataaatttagtttcacaaattagaggcaatatcttcgtatttgctcaattttatttcactacagtgtttattatcataaaaaaacactacctagtttgctactacaatacctactttgttactttggtcaaccacaaaagcataaggaactaggatattatgcataaagcttgatagacaaagtgtttcttcattggaaaaaatgtaaataggctccttggcctttgaaaatgatgtgtacagttcagaaattgtaattttagtatctcagtcttctattaactaggaagagttaatcagaaagcctagtaataaagtgagttcacaagagtccccaaatcccaaaacatttgaaaaatacaagtgtgagcttgctcctcttctcttcatatccaaatctctaatcaatcttttcctcctatgtcagaagcatcctctctcctttccaaagccaatgctcttattcatgatcttgaccctttctcctaattatttcaggatcttgtactttcaattattgaacttttctcaagtttccatttttttaatgaatcattactatttgcctaccaatatgtgaaagtccctccaatattaaaaaaaaaaaacaccttacttgaactgtttttccttctaatttctaaactgattcttagcttcttcctctattgttttgatttctttggatagatacacattcatttaccctggctatgtgttttccacccatgcacttaactaacactgcagtgtggaagtctccagtgactattaaacatacaatttgtggtcctttcttaggactcacattctttaactctgcagcacttgataaagttgaccaagtgttgaccacacatgcattatttggaatgctttcagttataaatgaagaaaacaggttgagattaaattagaaataacttgacaacagtatatggcagtgggaagaaactagagcatggatccagttaggcagctattacaatttttccagaaatgaggattttaagactaagaagctagacacaacaacaacaacaacaacaacaacaaaaccacacagccaggtgtggtggctcacgcctataatcccagcactttgggaggccgaggcgggcggatcacctgagatcaagtgttcaagaccagcctggccaacatggcgaaactccgtctctactaaaaatacaaaaattagccaggcgtggtggtgggcacctataatcccagctacttgggaggctgaggcaggagaatcacttgaacctgggaggcagaggttgcagtgagctgagatcgcaccactgcactccagcctgggtgacaagagcgaaagtccatctcaaaaaacacacgcatgcacacacacacacacacacacacagcagagggtataaatagaaccatcttttctatctggcagagaatataaaatgtttcactattaacatgaaaacaagtgccaacggggagatgcttacttacgcattagaaatgttgttaatccaaatgttatttcttcaccctgttcctgcaaatcaatacaattttggcctagtcttaaagagtaatgcttaatacataaatctttggtttgttcaatggctgtcttaaagttttagtctacaacttttcataattatagtgctaccttacttttgaacagtagttataactttcatatacattatctctatgtactaaccataacaacactatgatgatttgcattttctaggcaagaaaattgaggttcagaatatttttaaaaacctgaccaagatcccatgatcactgtatggcagagctgggattcagtcgtagtctttccaatgccaaattcaaggtcttgcctttagcatgttgcttcccctagatagcctagtttcctgtctttctttagtattgacccaggtctagtccggagaagcccactgggccctcttggatgtgaatggatatctccaaggccaatccaaaatgagctcaaaagggaactggggaaggcagataagaaaataatagggaaagataagaaatttagttatttgccagatatctatcatgtaagtgaatattgttatctttatacttctgaatcttaaaaatgtagaaaaactggggacttttgtggtaccattaaatgaccaattgttaggtacatgtaaagtagacccttgtgatttggtaaactccttcctatcatgcttattcctactttaataaactggagtatcgttacttggtaagagcgacacagggccagaactaccttaggtggaggtggaggtagaggcaggtaagaatcaacctaaaatgttcatgtactgttagagtataataaagaaataaaaatctaggaaaaagtttcatctaagcactttttcaactcaagagtgttggctgactatagttttctgttctgttttttgtttttgttttttgtactgacaaatttggcaaaacaaggtaggtgaggcctagaaaacaagttacttggttttcatacgccacagaaatttccagaagtcaagctaaagaacagactaacaatgaaaaattaacatccctttcttttaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggttatttttcaagtgtcttgtgtttggaatttgtggagcttcttagatctatgtatttatattttcatcaaatttgggtgggggaaaatgaccaatatttttttttctgtgaccctccgcattttcaagtttttcaattacttgcaaatggtcccacattttacttatctgtttattttatttcattcttttttgtatttcattttggatagtttttcttgctacatcttcaagttcatgaatcttttttttctaaatgatctaatctgccataatcctagacaggactttttaatctcagataacttagtttttatttctataaatttagtttgggtcttttgtcccccatatttcatgtctctaacgtacttaatctctcatctaacatcttcaaccaatggatacagttgtaacaactgttttaatgcttcttaaaatctactaattctgttatctgtcattgtgaatgagtttcaagtgatttatttttctcattatgggttatatttttctgcctctctaaatgcctgatgatttttaattaggcagaaaatactgtacattttcctttgtttggcaatgcatatttttgcattcttatgtttttgagctatgtagctgaaaactaacttgatagtttgttttcagtgacatagctaactgaaaactatcaagttacttgaacacaatttgatcatttagaatcttgcttttaaattttgttagattaagccagagcagcttttagactaagttaaatttagtttattactgaggaaagatcctcgttagtacttagtaccaccgttcatgaattaggacgttttccactttggctgttgataatcgacactattcccagccatgtgtgagtcatgggcactgttttctttattattttcaggtgggtttttccccaagttcgggtagttttgtcacttgcgtgcactgaccagtacttaactgaatacttgacggcgactcttcacatatctccagagttttctctacacgcagctctcttctctccagtattctgcctttttgacttctcttgacctggagctccatctcctcaattcaagagatcaatggtcttttacctaggtttcctctacctgctccaaggcctgaaacttttctccaggcaataagataggatgataggaaggtttacctcatttgtttcccatctttcagggaccgacctttgtccttcattgcctgaaacagtatgtcaagtaacactgtttcatctactttgtctggagtttagttgtttcagctggcagagtatgttcaggtagtagggtaaatctaggatgttattctatctttgtcagaagcagaaatccaaggcattcttaccactttactgtaattctatagtatatttttagtgtaatttagtataattcgataagctaagcaggatcatttgaaatgtgagtaagctatgaattactgatcatcatgtaattattagggactatatatacatcacctttggcagttttcagggcttatgttccagaaggaatacaggatgaatatcctgtatttggaaacagaagtgtttctgatttttagattttggaatatttattcatatgtagtgaagtatcttagggatgcgacttaagcctagacagaaaattcatttatgtttatatacacatagcttgagggctatttatgtaatatttgtaaataattttgtgcattcatcacataatgtcaggtgtggaattttccacttgtggagtcatggcactcaaaaagttttccactttggaccattttggattttggattttcagattatggatcctcagcctgtatcattataagccttaacatttcaactggaaaaaaaatatgtacggaggaaaagaaaaagaaaaatcatgactagaaaacagatgaattccaagtcttgagattttcactgacaatgttttaaaggtccgataagttgaactcaaatctcaaaaatagg

SEQ ID NO: 13952 - DNA, 18456 bp, Human
gaaaagtcagtaatcaaaagaaatatcttgatgcaatgcctctttaaaagaaaaaaaaatgcaaaaaatccatgatgaataaaatactaaattttaaaaagagaaaggatccgtgcagtgccatcgtaagccattttggagcccggagcaaaaggaaatatcaccttgcccaagcggtgcccctacagctcatccgagtagggcccgggggtcgaggcattcggggcccagtgggggacgaggccagtcgaaggtctcggaagtggaggctccgccgagctccggtcggggagtgcagggatggcccccgggaccggaggtgagagctcgggaaagccgctccgcccggaacaaaggcatggggagagggtgagcttgggcgggagagacccggcgggtaccggtgccctcgctgcctgggtcgggcttccacgcgcgccccggaatggaatacgctactctgcagcctccgaaactgcgagcgagtcctgtaactcccttgctctgtgattaattctcactaacaagacttggcaagatgtcgggcgaatgatttttggcttctgcacggtccccaccgcgtgcgtgcacaaacccccagccaaaagccgcctctgggaaattaaatgcaaaagagaaatggggatggggagggctgctacgtgaccaggaaaaagggatgcccagaaacatgaatcggacccagagctgctgaagtcctttcaaaaggtcattctttgcgggtacattttccagggtccagctccgcaacaaatgtggaccctgtcatttcctgaaaggataattcacaactatgcaagatagggtgaagacgtttcccaaacccgaaaaccttgtttttcccccgaccagggttaaataaacatcttttaggaagcgtggacaggagcgcagcctgctctcctccctcggaacaccattccggcaattaatgcctccctttgggtagtaaagcaacaaaccccacacctcactccgatcctgggcttcgggcgggaggactttctctttcatcttccaagcagggggttgcccacgttcttggggaagctataaaactgatttaatggctttagatgaaaatcgatcacgctaatgcatacgctaacgtctcaggaatcgcatattcagaaaggactggccgggccgaaagcgcacggggagtctggggctaggaggtgtcaggccccgctgggtgggcagcagcgctccggtcccctctccacttgggtaaccgggaaaaacctacggggctgtcacgcggggaagcgcgaaggtgccaagggatgaaagctcaaacccgagccctggcctcctcagccggctatttcctttggcgccgcccgcctagcggcggggtgcagcggcggcacaggtgccggtgtcgggctggaggcgcggcgcaggctgggcccgcgggtagacggcgaaaggcgccgcgcgctccattcacaaagtccgggcgctgcccgccgctggcggcgggtcggaggccgcctccctcttcctctcggcctcggttttatgaatgggcctgatggcgagcacccggcgccctgtttactccgctctttgtgacgtcgagttcccgtgaccgggagccagcggccgcgctccattcaagctccggggagggggtgggaggaggggcccggagggggcggggagtcagcgcggggggcgggggacagcgcggggggcgggggacggcgcggggcccggaatggaacggggcggggcctggcggggtagtacctagcgccccctcccccgggagcgcggaggagcattaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggtaaacgagggctccgggcgctagctggagtcggggagatggagggggtcttggcggcctgcgccttattggcacgggaaggagtccccggcgtgattcgtggttgcggggatccccgcgcgcccctttgtgtgtgttggtgtgtaggggtttgcaaggtttctgtgcaagtgcgaggttcaagtcctcagggaaagtgcggacgggtttctccggtcacctgcaattccgcaccgtcctagcgaggccccgtttattgacattaacggtcctagcctcgaggatgaagcgactcctctgcgcggtccatcttgagtcccgggaacagtttccaagtaccacggggcgcgtggggacaagataggcctgttggtttggcgtgctggggccctacactgagccggaccgggagaatcccagaggtggagaaaaggtgaagaggggtgggcgccgaggtacaattggccttgccagtttcactgaaaacaagaccctggcaaatgcagaaagggagattgggttgcacacactgtgtagagcgatctgtatctgcgttcccgctgcccaactccgagctcagcttggaaggtggccaatccccgtcccgggctagatccaggctctgggagcgggaggctgaaggactgggtatctgggggacgccgggcggaaccggtcctctagcgcctgcaaatccgggcagcggagaatgatcaccttttgttcagcccggattttcgactatctgatggcggcgcgtgccggattttagcgagccctggcgaaactctcggcggcgagactgtcttgtcacatttggtagtcggaaatcctggaaaaatcgcgtgctgtccgagtccctggagggacctggcgcccgccacacctgcagggcagggtgggtccgcggccctcgggctagggagcgggcagggcgcgtggggtccgggcgccccccgccgcgctgcgcctccgcctcccgccgccgcattccgcgcattcttccgcgcgggtagggtctgcgcttccgagcccggtaggcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctaggtaaaatgacagccctctggtgggtggcgaggtgcctggccaacataagagaagtactttaagggctgtttcctcctggagcctgcactgcctctcgtagtcggccccgacgcgggcagggagaatcatcttctgcatctcaaagtggacatccttgcagatggaggtgtgcaggcctgggccacagatttagcttcggtctcttctagaatagcccctcctagccagaagttcagcttctgcttccaaagggagcctgcccttggaagcaagcacctaaaattgagaggtgggggaatcttccagcctgctctgttgtggtgaacatcgttgaggttaactgggccctattcggtttagcttagctgattttgacatatgtgttcagcagaggccatctttaacccagttcctcttcttcctctttgccctctaatggaaaggcatccctagagaggtcagaaggaaaaagtcagtatctgctcccacagctctgcgggaaggggctggggaaggaaatcaaggtgtctcccaggtctccagatacacctcccttccatgcctggaagccagtgcagtggagcaaatgtggtttcccgggagggggctctggggcagagacctaaaggggaattttgagaagcaaaggaagaaaaagccccttagattatctttagtaaatgcctgaattggtgaagggttggagaatttgtttcctactggagtaattcattttattttccagcgagggaatgtatgtatgtctcatttcaggtgtgcctgtgcgtgtctgtaaagcaggacaggaagccagtggaaggcttgatggttggtgtctgccattcttggaggggttaggagaagcagtaaaagcaacaagagtattttcagaagtgatagtagcatgtccagccaaagctatctaattctattaattgcattttaaaattcagtttttctatttctgccacgttgaagggttacttcaaccacgttgaactggttactccatgcaggtggcaggaggtaaacttcgcttaatatcaagaaagtacagcctagcctttacatttcctcagattacccgacttttgctaaaagcaataacgaaaaatctaatgttttctatctttgctagtaaaggatttccagtggggtaatttttttaaaactcatttaatttaaaatcttgtaaggcatttttagagtcagtttggaaattttagtttttcagattttatcacaatacacttcttgaaatccctttctctctcattcgtaaatccttggattagagtttgagactcccctggtcattagagaaagacaaaaagagctttttcttaccctattctttgcctttattaaccccaaataacaaaataatctgttatgcaaaaagattgcaggtataaaaacattaccttcctttccacctacctaaaacttccctcagcctttgtcagttctaatttaaaagctgtcctggagctgttggagaaatggggaagatcatctagatattccagtttctccttccactcaccctatagtaccggatagcatccaatagcccagggcctgaccatacagcccatgatattaccctttctgtagaaaacagtcactaaggccactgatgaatgtggggggagaggaacacaattaacagctctggaaactctggtgacatttttctgttttttctctctctagccccaccattgctctctctgtcttcagttccccaggagggcaatggcatcaaacagcacagctctgggggatgtcaatattgcataccttttctacctaaagggaaaatgactcgcttttctgcttgcaaataaaatagcctttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggtgagaagttcacttagttggattttaaatacagctcagcatttacataggtgcttactaagtcaacagtcacataaagtagagttcccaaaggcaaatggccttcaaacaaccccagactttcttgcaagagcatgacttttctggcaagagcaaggccatgagccctgcctgggacctggcactattctgagtgttgggggcataatggggaaaaagtggcagccacattaagattcatgaccaaggccgggtgtggtggctcacacctgcaatcctagcactttgagagactgaggcaggcagatcacttgaggccaggacaacatggcaaacttggtctctacaaaaaatgcaaaaattagccgggcgagatggcatgtgcctgtaatctcagctactcaggaggctgaagcaaggagattgcttgagcccagggaagtcaaggctacagtgagccataatcgtgccactgcactgcagcctgggtgagagagtgacagtgacagaccctgtctgggggaaaaaaaaaaaaaaagatccatgaccatagtcaccaccaaaggacagtcttccccatcacaaatcccagtaacagtcctattatggtgatattatcaatctgccctttgtaaagtacttttacatacattatctcctacttctgcaagggacgggggagtgtggtggagggcttctaatgaggggtcctcatttccactaaacttggaaaattgcctccctgtatgaggatgtgagaaggaggaggcacagtggagttgaactgtagatggagttattcttaagtaagtctgatgaaaatcacactcctttttttcttccagactttcaaattgtaaaataaaggtgataaaatgagagatttaggaatagaaaatatattcttaaataaggacatgggaaaaacaggttgaaattagtaagaaacctcttatggaattacattcagtaggacacagacacgttcaatacattcatttcatacattcaaagggcataggaaaaacagaattcattcattcagaatggcacatttgataatgaaattattcaggagatagaaatgcagattttaggcacctgctgcttcagagctggcaaaactgacacgcaaataagtagatcctggatatttagaagcagaggatattggaacttaaagatcattataatcagaaattcttacattttgagagtgggaaaaaccagagttgaggagggaacatacttgtccaagttccacaagttgagttggacttacacctggatctgtctccacttctccttgcacacctgctaggggcacgggaaggagcccagcccctttgtagacaatgagaataagctttccctttcatgattttttgggataaaactaggtgatctaaatctagctcttgaaagggctgtggctatggtacttgcatggatttggggatgggtaggagggactgagtggaagtcaccttagaataatcttttttaaccctgcccacagtaagaaacacattttaatttatattgtgacccaggagagggatacatgcacatctgaagaaaagttccataaaatgatatcctctttaagggcagtgcatcctcctaattcctattctattgtattccattttaaaaatgtgggtcatgactctttaatgacagcctggattaggaaaccaatgggtagaagcagatttggtgaaatatcagcagtgccctatttggatcagttctgtttttgcatgaaaagtctgtcttcacttgatgaaacctgcaggcagtgccccctggagaagggcccaccaggaaggggtggaaggcagaggtggcatagactgacacccagagatgacttactggggcatggccctgtggggggtggacttgagcagcttcttccaccgatggataaatgctaacttgcatgcatcctcccgcatcaccttcactgtgtcctccgggctccaccagcccagaacatatcgttctcacccatgagtgctggcctgagtgcagcccagggcccaccaaaaggaaccccctttagtgtggcatcttgtgaaaccagccacagacccccaaaagctggccaccactgtcagggacgagaaccttccagtgtttctgccccttgagcgaatctgcttcttcaccttgttccttttttttttttttttttttgagatggagtctcgctctgacgcccaggctggaatgcagtggcgcgatctcggctcactgcaacctccgcctcccaggttcacgccattctcctgcctcagcctcccgagtagctgggactacagacacccgccaccacgcccggctaatttttttgtatttttagtagagacggggtttcaccgtgttagccaggatggtctcgatctcctgacctcgtgatccacccgcctcggcctcccaaagtgctgggattacaggcgtgagccaccgcgcccagctcaccttgttcatttttgcttgttctttaaaactccctcagagggaactgacttttctgtaatcatttttctgctgccttctaatggtgccttttccagacagttgcgatgagcctgggggagatgacgaatggccctctcaggccacatctagcctgttccccaccaaatgggtcacttgggccctccttgccccccacaccactccatggccagcagccggtgccaggtccctgacaagggttctgctgagtggcagccatggccatgcctgggagagaagatggaggtctggaggtctccggaaaccaagagacaggtttccgggagagcaggctgtcaaatgcccagtaccttaccagcattaccctgtccccggttcctctttggcctttgaggatctctgctgagggcatccgagggcacccctccatgtaggcaccgagaagggaaaacttcatgatctgtctccctgatgccaggcacagagcctggctgtcagaaccagtcctcataggcctttgtgcaggggactttcatcacttacagacgaggaggaggctccgagaggttcaggaggcccgggctgcacaggtgatacatgctcagggtggggtgcaacctcatggcagagcctgtgccctttcggaacttcactccagtgccctgttccataccctcagcaatggagacaacatcctctcagctgctctgggctcttcctgcttctccagccctgagggccactctgctctgtgaccgtggggcctgccctggcactcctgggccacccaaccattcacttttgagtgcaggcgatagcttgtctgtcttggtggtgagtttttgcaggacaccacctgtgtctaacatgttgttttaaaatgtgttttaatagctcaaattatgtaatagacaaaaggatcatgtacttagaattttttcaaatcctagagaagtatatagagtaacaagtgatggcttgggatacaagtgatcaaccactgttaatgaatgagtttcccttccactttctccgaaagggagcatggactgaagtttcccatcacagaagcccctgaaggacttcagctgcagacagatatttccttcctcttccctcatcctctaattactgcattttgggcagcagtggtggcagccgaataaggaaaggggtttatgatgggagggagggggtgcttctgtgatgaagtggctgccgaggccaccagcatgaccgaggctgacggtaccagccccaccagcaggttttccatccagggaggctggtcactgtgactcagcaggaacaagggcctgtgaccagagagagatccatttatatcctgagggagggagaggaggggaatagagaagcctccggtcagagaggaaaaaatgtacaccctgtttctataagcctcatgatgtggtagagaaccgtttccttcctctcagtaggaagcagtctttagggttgggatttggcgcaagtgactgactcaccgtcacatgtctgcacattggaaaatttctatcaatggccctagggcacagaggtcctatgtcactgtcatgaagaccgcaaaggtagcgacatccaggactgttggccaaattgtcattggagtcagttgaatgggtttgttggaatggtggttctccaacgcacaggccctactgaatcaattgaatccatttctggccctacagacactgtaaaataaaaataaaagcagggccatacattgatagcactgtggattggaagttggccgcaaaaggaagtcccagagatcacaagaaagccagagatagggcttgaaaggttgtctttttggatggcctccctgtggcctctccctgtatcccacctgcctccacccctcctagataggagcactcaccctaccccagctcagctggccatttatcatcatcttctttttttatttaaaagatctcccttctctggaagatgatcccacagataaccattccagggcttacccactctcaggtcaggaaatactcccttgccccaaacctgtacatagcatgaggggtttatttagatttaagcccgttttcctcttgttctggtctcttggtgacggaacagctattcatgaggacgtgcaatggacatctgttccattgctgagatccagaagagtttgtaccagggtcattttttcccttctttctcacattggagaacctcccctgaggaagggctggaatcaggggtggcaggtgtctctacaggtacttagtgtccttggaagcccagcgtgacctttgcttctctattttgtcattgtcctgaggagctactccacagtcacttctgcacatccccctgcacgtcttcctttgtatgtctacctctctaacccaagtcttgtccataaagcttatccttccagctttgctgcagtcctgacgagtgtgtcctctgcatctctggaaaccactccatggccattctctaggtccacagcgccacctagtggccaatatggagcacgccagcccctgccttcctagcagtccgcctgagtctgtaggagtcgagttctttctgacttcctgctggcttagtgaccccattaacctgagcttctttctcctttacaggcggctatgagaggttttcctccgagtacccagaattctgttctaaaaccaaggccctggcagccatcccacccccggttccccccagcgccacagagcccttggacctgggctgcagctcctgtgggaccccactacacgaccaggtagactcggggggcagggcttggaagtggggggcaggaacagcgtaggggccagtggatgccttcttttcagagttctgacggtgttttttgtctttgcttttgagacagtcttgctctgtcacccaggagtgcagtggtgtgatcatagcttactgcagcctcgaactcctgggctcaagggatcctccctggtagctgggactacaggtggcactaccatgcctggctaattttaaaaggtttttggtagagatgggggggggggggtcttgctatgttgcccaggctggtcttgaactcctggcctcaagtgatcctcctgctttggcctcccaaagtgttgggatcacaggcgtgagccactgcatccaatcctgagatttttttaagtctttgaatgttatgcctcaatttggggagaatgcggtgaacccggagtattggggtgggatgttaggtaggacctatttacttcttggaaatcttccccttccctctctaaatatcctcctaagaaaaaagtctaaagacatgactccctggcttggcctctaacgtcgtgtccggacaagtgaggaggcctccagaagccctgggggacctgctctctgggaagctgaggtcattctcctctgaagtagcaggccatgaaatacatctcagtccccgacaggcaggctgctcccacgtatcagccgaatgaacatagatggtcacccaccctccctccaagaaaacctgcttgagccactgtgtttcttataagcccaccctccagccctttcagttagatggactctgctgcccacatctcatgtgctaaatttaagccactgttgcctcattttgccaagatcctctctcttgtctgtgtggccatgagggcatcagcttatttatttgtttatttttagagacagagtctcactctgttacccaggcttgagtcctgtggcgcaatcatagctcactgcagcttcaaagtcctgggctcaaatgatcctcccatttcagcctcccaagcaactgagactacaggtgtgcaccatcatgccagcttcattgtttgagagatgaggtctcactgtgttgcccatgctggtcttggaactcctggctcacatgatcctgccacctcagcctcctaaagtgctgagattacaggtgtgagccactgcacacctgtttttgatatgcccagtgaatacatatcaaaacaaataagtatctaaaccacacagcaaatggcttgatgattagcagatataaactcagtgtcacagatggtgccataaggccggcattgtcctgccgcttattttgccatgggggaggtgcaggagagtcccacaagactttacctgccctggcctctctgctcacaagtagagggcaaaggctggagaagtcccactgggcctatcacccctccaagagttccaggaggctacagggggaggctgggagggccaggcccagcaggcattctccctgggtttggaaaggaaagctcttctcagacaagcttccactccctgtgccaagcactttaccctcatgtcattcaggggcctttgtttccctttctgtgcaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcggtaggctggccctgctctggggttcctgggtttgagggcgggtgggaaggataaggaacccctgtaagcctgggttgaaggtggacattggaggcactgaatccaagggtccccattccccctcttcctcattgggaaggcttatacattggatgttgggttgggagggaggagggaagatggacctacacacaggcttagcttgcagagccagtccccttccccttgcatggcttcagtgcctagatggtaagagtttttggacggggaggaagacacaaggagcattgagtcatagtttttattttatttctatttatttatttattttgagacagagccttgctctgttgcccaggctggagtgcagtggcgccatctcagctcactgcaacctccgcttctggggtgcaagtgattctcctgcctcagcctctggagtagctgggactacaagtgcaccaccacgcccagctaatttttgtatttttgtagagacagtttcatcatattgcccaggctagtcttgaactcctgagctcaagttatccaccctccttggcctcccaaagcgctgggattacaggagtgagccaccaccctggaccccactgttttgtttctgcaaagggaaatccttgaacagataataggatttaaccagcttcagcatagtgattcgggaaaatagacctcagaattgggggcattctagagacctgcctacatgggttttcttcctctccagtccttggtctagcacggctagtccttccttcagagccccccgaccccaggggctggccggtgcccctggtcggggctggggtctgcagaaacgtgcactaacctattgaaccctgtccccagatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgt

SEQ ID NO: 13953 - DNA, 8134 bp, Human
tattttttagtagagatggggattatccatgttggtaaggctggtcttgaactcccgacctcaggtgatccacctgtcttggcctcccaaagtggccgggcagggctgaattcgccccctcaccagctactgccaaccacggatgaatggcttctgcctgcctcctgccctccagatcttaccagggcatttcactgggaaatatggcaacagcccttgccactcaggggacagcatggcaggggctgggaacgaatgttgttgccaaacgacaagacccagctgggcccagtggctcacacttgtgatcccagtggtctgagaggctgaggcaggaggatcacttgaagccaggagtttgagagcagcctgggcaacacagtgagactctacaaaacaaaacaaaaaaaattagccaggcatggtggctggtgccaataagcccagctactggggaggctgaggctaaggctgaggcagtgagccatgatcatgccaccgcagtccagcctggtgacaaatgagaccctgcctcaaaaaaaaaaaaaaaaaaaaaaaagaggaaggtgagcgcagtggctcatgtctgtaaatccagacactttgggaggctgaggtggaggttcgagaccagcctgggcaacatagcaaaaccatgtctttacacaaaataaaaaatgagtcaggtgtggtggcacatgccattggtgccagctacgtgagaggctgaggtgggaagattgcttgagcctgggaggtccgaagctgcagggagccgtaactcaggcatcacactccaacctggctgacagaatgggaccctgtctccaaaaccaaaagattccagctcgaaaaataattgtggggtggcggcaaaagctcctgactggccttgactttagagtgaatcaatgaattaattaagggcctgcctgttagtgagtctcctctgaaatttagcccagaaatttcctaactcagcaagatgaagcaggaggtagaaggaactaagggggcaataagcaggaggaaggaatgtccccatgagggtgacatcttccctgagagccccaggacgaccagcaggaagccaggcggggggcaggcaggaggactccagaaagctcggcctgaggggaggcccgtgggggtggtggggagtggtgcggggaaggcagaggctgagcagcaggtgaggtcccctgggttttgggggccaagcctggggctcggggcgagcaagcatgagtggagaaggggctgctgtggttgggctggggtggactccccacctgcgtcgtccaaacattagtgcgagtgcacccacacaaacacatacacaatcacacacaacatgtgagcaatgggcaggactggtccggccccactcagtgctgtcaccattggccccacagctgcccacagccctagagctctgggcccagattcctgccagccccacctgtccaggccaaggtaagatgatggagcaagggggtgccagggcagcaaagccccccacgtgcccctttcccacagggcccaggctcctggcatcaggaggctgaacccaggccctggcccagactgtgtgcttccagcctcccctcctctcgacaccagaacacagcctggccccagcttctgggaaatatagaaaaaaatgggtgaatgatccagtgacagggtgtcttgttccacacaagacacagtgagcaggggttgggggaggggctcctggctgcgggaggcacaccacactcacccaaatggcatctgtactcaataccgcacccttccctgggggacacctggtcccaacctgagctgcctttctcaggaccccagccccagcccggcccagcccagccacaccctgccactcccttcagccagtgtggcttcaggtcaagaggctgggcagggtcaaggtggcaacgaggggagaagccgggacacagttctccctgatttaaacccgggcagcctggagtgcagctcatactccatgcccagaattcctgcctcgccactgtcctgctgccctccagacatgctggggccctgcatgctgctgctgctgctgctgctgggcctgaggctacagctctccctgggcatcatcccaggtaatgaggctccccgagctgcccctacacaacacacacacagggcaccccccagcccaggctgacctgatctttgctctccccctggccagttgaggaggagaacccggacttctggaaccgcgaggcagccgaggccctgggtgccgccaagaagctgcagcctgcacagacagccgccaagaacctcatcatcttcctgggcgatggtgagtgagccaggccttccagccctgcagccctcacagccccggcgcccggaccctcagtggttccaggagagccctggggcccaagcctcacacatttctgttccttcagggatgggggtgtctacggtgacagctgccaggatcctaaaagggcagaagaaggacaaactggggcctgagatacccctggccatggaccgcttcccatatgtggctctgtccaaggtaagtgctgggctaccttagagtcctccaagcacagaaggggaatcctggctatggagtgtggtaggagggagggaccctaaacagctggggctccagtaaggagttagaggcagttggaatcccagaggacagagatcagggtctgggtctccgtgtctgccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgcgacccccaggccaagggctggggctgggcagagagtagcagggagggggcactagctcagacccaggcaaccaaaagccttatctgggccagcagggtctggaggtggggttgtgggcgtagaaggtgcagcccaggctgggccattcccacagccttggggaggggagtcaggggctgtgcatgaggagggggcacggggccagccagggccccaaatccacctgccccatcctctgttcccaggtgatcctaggtggaggccgaaagtacatgtttcccatgggaaccccagaccctgagtacccagatgactacagccaaggtgggaccaggctggacgggaagaatctggtgcaggaatggctggcgaagcgccaggtgatgggggctggcgggtgcagggggcacagcagggggagggcagaggtgtggggctcggggctgtgggctgaggcctggctctctccctccccacagggtgcccggtacgtgtggaaccgcactgagctcatgcaggcttccctggacccgtctgtgacccatctcatgggtaatgacccccttcctgccctggcatccctcagatggcctcagatggcaccttctgagcctgtgtgcacatccgccagcacccgcccacccccagcctgccagtcaccacaggaccccttgtcccacaggtctctttgagcctggagacatgaaatacgagatccaccgagactccacactggacccctccctgatggagatgacagaggctgccctgcgcctgctgagcaggaacccccgcggcttcttcctcttcgtggagggtgcgtggtggcccctggggagtgggggttgggggttggagcagggcaggctcagcatctcccccctctggccttcctgcaggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcggtaggcctggggagagtggcaggtgctgctgcagcaattaagtgggtgaaatctgagcctcagtctcctcctctgtcaaatgggagtaatgctggcaccagccctgtagggtctcctgaggactaagcccctgaccaggcaaaacgtggcggtgcctagcacgtgggagacactccacagctgtgttcagctcaaccacagggacccctctctctgcagggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagggtgccaaggatggggggctggcgggaaggggtcacctcctgtctgcctggaactgaatgaaccctcctaccggaactgaaccctccaaccagggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagtactacttcctaggaggaaaatcatgagtgcctgtgggcacagtgtctggaggggtggataacgcaggccaggaggggctgctgaggagcagatgattgagcaggagacctaaacagagtggggcttgagcaaggcagaacagcagtgccaaggccctggggcagcgccagcaggtgctctgggaggccaagggctggatcagagggtgggtgggtagaggggtaaatctgagggtcaagagggtgggtagtgttggggagtgtgaagtctgagtagagggatgtggttggaggtctttaaggagtgctgtgacccgccctgggtggaaaataagtattctggctgctgccagaagaagggtcttgtcttttgggtggatggtgggggtggtagagggtagcagggagaggtgagaactggggaaggaactgactccaggtgtttctgatctccgtccgaaagcattcgggagcacccatcccaacacagccatgcttggtgagtaccacacctgccccaaaagaacattgaaaagaattttttttatttgaggcagagcctcactctgttgcccaggctggagtgcaatgaccttgtctcggctcactgcaacctctgcctcccaggttcaagccattatcctgcctcaccctcccaagtagccaggggtcaacaagtgtgcaccaccatgcctggctagtttttgtatttttagtagagacggggtttcaccatattggccaggcaggtctccaactcctgacctcaggtgatccacccgccttggcctcccaaagtttgggattacaggtgtgagccacgtgtctggccgaaaagaattaaaggtgaaatcagccacattttccagcaaagtttacactattacaaaaaatacaaaaattagccaagcctcgtggcccatgcctgtggtcccagctactcaggaggctgtggtgggaggatcacctgaagtgaggagtttgagaccagcccagccaacatggtgaaactaaaactggtctaaactaaaacacggtctctactaaaactacaaaaattagccgggcgtggtggtcggcacctgtaatcccagctacttgggaggctgaggcaggagaattgattgaacctgggaggttgcagtgaattgagatcataccactgcactccagcctgtgcgacagagccactctgtcttaagaaaaaaaaaaaagcaagcattttgtgctcactagaaatattagcatgattgaatgcttccttgcatatgaaaattattttaacattgtaaaacatctatttggcaggcatggcggctcaacacctgcaatcacagcactttggcaggaagagcgggtaggatcgcttgagttcaggagtttgagaatagcctgggcaacatagtgagatcccgtctctgcaaaaacaacaactgagtccagggaggtcgaggctgcagtgaaagaagattgctccactgcactctagcctgggcaacagagcaagaccctgtctggaaaaatatatacatgtatttgaggacctggctctctcaggacagttttttttcttttctaattctaggttttagtggctgtcataaaaatatgggaggtgaacagaaggtagacaccattagctggccttactaaatcatcatactcattgttacattccatccaccaaatatgcaaaggttttggtaaaatccagctagtgtatttctatcttcccagttgtcagtgggttagaaagttcctctttctaaccaatgtggaggtgctgcatgtttaggttttacatgagtgctcacacccaaggacttctatattttaaaagtgaagacattttaaaaacagattattctggccaggagttgtggctcatgcttgtaatcccagccttttgggaggccgagacaggcagatcacttgaggtcagaagtttgagaccagcctggccatcatggtgaaatcctgtctctact

SEQ ID NO: 13954 - DNA, 5516 bp, Human
cctcccaacacatactctgcaggcactgcctagggtggctgagagcataggacagcggacacgaaggccaggtgccagggcctgatacccaaccttctttccttttgatgcagtgatgggctcagtggtcccctctcacccttaggcactgcagaaggtgtgggggtcggcctgggaaggttgggagctattaataattgggcttggctactgggtcccaaggcctgggtgcaagtgtcgggtagcccattggggcttcatccctctgatggcatcaggccctctcccttcatgcaaagtctgccctcaaaagtgctgatgggctgaagggccttcaggagacccccttttcagcaagcagagagtgcacaaacctgcagaatcggcagtggcagctcgaactttgctctgtgcttcaaccactgctcattaaccagaaagtttcttcttccctcccgttccctcctcaagatctcccagatccctgtttcacagaaaatttttgcttatttgtttaatgagaggaagttttgtgactggccagggcagggcagagagggcagggcagagaagggaccttttgggggctccagagaaggggtgggggcaggtgcttgccaggacagaaggaggtgaaaatctcagaaaagtcaccgtttgtgccaaaaaaaatccccataatcattctcatttcggcttcgtcacccccaccgtgctgcagtcgggcggcgggggcgatcgaagctgcagttttatagctgtagaggaaagaactcgtaaaatgctaacagcttttatgcgctgcggcataaacaacaacagactccggctttattgcgttttatagtttcttaaagagtttacagccgttttttggggggccggttatccagccaattccctccacacgatagttaaacctttatcaataataaggaaattgatcattaaagctttaaatatgactacctcgtttgtttgaaaatacgtttaggagaggaagctgtatgatttgataacttgtattaaaataccaattacatttataggaccttttaaaactcggcgcaattaaaccgtgttcttttacatttttccgaagcgaccctgacatttagaaagactccaattgcctcgttaaaatcgcgaaattaacagcgtgcctacgcctggcgcgttgtgtatgtgtgtgtgcgtgtttttttccgtgactcccccacatcagtctttgggggtggtctgcgaaggtatttgatttgttgtgaggcgagagatatctcattaatgtaggtagttaaacagatttaatccgtattcattctctctcaccccctctccctctccccctctctctccccctctccccctctctctccctgggtgtttttttcttcccctcctttttttttttccgctctctcctcactccctggcgctctctcgctctagctctctctctcgctcgctctctctcgctctcaccctcgctctgcgttctgtccgggaggagtacgaagaagccaataggatgcggggtctctaatggatgcaaatgatcatgaaaagacagtgcaaaatatgaaacaactcatttgcagggaagtaaatcaccgaaaactgtttatgaactggcatcccttcttcgaaatgtaaagcgaggacctctttaagtggtggtatatttttgtttggggggtggggggtggggggagggcgagcgagccgcggctgccatgcaagcttagacttttggaggcttctctgtccttttctattcctggaaaccacaaaaagtgtgtcggcttcgagatcttcttcgccttttctttcttttctttttttccctcctctctttccctctcctttcctggcgagggtgactaggagccggcgaatccgcgtttttttctctctctccctccctttccccctccccaccccctccccaacagcccccaactatagcctccgccgccgccgccgcctcaaaattcaataaaatgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaaggtgagctcgcctcggggccgacaagggcaggagggggccggaagggcccaaggccgggcagggggcctggcaggccggggcgcatttcctccagcttctggaagacttgccggctccgttccgatcgcctgccgcttttcccctttctttcttatctttctttcttctttcttttttctttcccttgaagggggtcgcttagaaacatttcctgaatctataaacccctcaccctgccttacttttcttcttcttctcctcctttttttccccttttactgttttatggggggtagtgaagagagggtggtgggagtgggggcgctcaacttttgcacttctcaattgctttatagtttaattaccctgaagaaacttttcttctggggcagaggctctgggggcttttcaaggtgggtccattcgtccccacccggcttttttattcttattttcccccctccttcacatccttcctcctaaagtttatggcacttctaatagatctgaaccacctcctacacaactctggtgctggttaccgggggagggggctcccctttctggctcccttagattcacttgtgtctaatccccctcgcccctcctccgccgccgaccgcggccttcttgcgccccccccgcccccgcacggggtagaaggtcccctgcccttattataatggtctcccaggctcgttcacgaatcttccaaccttctccgtccctgccccctcccccaccctcccctcccctctgtctcgccctttcccccattcccagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgtgtcctcccaagatgtgtgtcgggaggtggggtggggggcaggcataaaggtggagtgcaggcctgctgagcatactttttttccctcggactgttgttgttgggggagcaggaggagaagggagaccgctcttccctgcctctccctctcagggacttggccaccttcgctctgttctgaggccatggctctctgccttccttccttcgctgcctctgcttctctggtagtcacgctccactgaggcatccgcctccgggaaccgggagagcagcgcgcccgggccaacctccacccttcctttctctccccaccctcccaaccccctttttcttttactttcaaacctttttttttctttttctttctttctttctttcttttttttttttttgccaccagaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggc

SEQ ID NO: 13955 - DNA, 53789 bp, Human; identical to SEQ ID NO: 12137
  misc_feature (1)...(53789): n = A,T,C or G

SEQ ID NO: 13956 - DNA, 29771 bp, Human; identical to SEQ ID NO: 12754
  misc_feature (1)...(29771): n = A,T,C or G

SEQ ID NO: 13957 - DNA, 18520 bp, Human
taaagcaaaacaaacccaaaacaaacagaagaaacgaaataagaaaaataagaacagaaattaatgaaacagaagagaaaaatggaagaaacaagagctctgaaaagttcaacaaaattaataaactaagaaaaaaagaagacacaaataactaatattaagaataaaatggcctggcgtggtggctcatgcctgtaatcccagcactttgggaggccaaggcgggtggatcacctgcagtcaagagttcaagaccagcctggtcaacataacaaaaccccgcctctactaaaaaaatacaaaaactagctggtcatggtggcggacgcctgttatcccacctactcgggaggctgaggcaggaaaatcacttgaacccgggaggcggaggttgcagtgagcagagatcacagcactgcactgcagcctgggcgacaagagtgaaactctacctcaaaaaaaaaagaataaaacaatatggctgcagacactgcagacatcaaaaagataataagggaataacactattaacaactctacacagataaatttgacaatttaggtaaagttgatcaattcctcaaaattgcaaagtatgaaaactcatgaaataagaaatagattatttgtataaccttataattattaaggtaatttaatttataacttaagacatctcaaaaaggagattctatcaaacatttaaagaattaacataggttgggaatggtggcacatgcctgtaatcccagcactttggaaggccaaggtgggtggatcacttgagcccagaagctccagaccagtctgggcaacataatgagaccccacctctacaaaaaatacaacaattagctgggcttagtgacacacatgtgtagttccagctactcaggaggctgaggtgggaggatcagttgaagctgggaagttgagactgcaatgagctatgatcacaccactgcacttcagcctaggtgacaaagcaagaacctatctttaaaaagaaaaaatgaaaatgaataacagttctacacaatctcctccataaaatagaagaggtgaaaatacttccaagttcattttataaaattaatattactgtgacaccaaaaccaaagatggtgccaaaaaaagaagaaaactaacattaataactcttatgaatatagacacaaaaatctttaacagaatgttagcaaagtgaatccagtgactgatatataaaaaagaattatacatcaagtgtgatttttttccaggtatgcaaggctggttcaacatttgaaaattaatcaatgtaatctaccatatcaacatgctaaaaatgaaaaatcatatgattgtatcatttgacacagaacaagcatttacttattctctcttgtcttctagctaaaccctgcccactggtgttgccttttattggaaatgtattttatctccattcttcatcaagatccttgggccttgggtcaagacccaggtccacacacggagattttctagggtccaaatccaagttggtaggccctgtatgcaaattagtttcacttcctctgagtaaccagctctgcaaaccaaagagtgaggagctcttgataaactactagagaaaatctgacaccatccttatctgtcaacaaggggcctacattcagaaacctgaaagaattactcaagtttagagacaaatatgaccatttttgtattttgaaaacaacagaaaagaaatacttttgtacactctgttagaaattttaagtttggacatttaaaagtccaaatttaaaactcaaaaaaatggataataagaggggacctgtttgattaagggagaaaaaaatagtttgcattttcaccttttgtgctctttcactgagatgagcctatttcagattacacttaggaacttccatcaagcagcgggagagcctacttttcctgtttaataattaccagactacagagaaagctcaggacccagccttctgatctaccagtcgcctgtgtacctttgtactttctacagtgaaagttgctacaggatctccctttctcaataaattcatctgcggtggagaaaatcagcatgagtactacaggccaagtaggtgcagtcttattctttatgttgtgtcatatctttgtcagtttgtgtgctcatctctttaccaacatctcatcacccagctagtctctgggctcctaaaggtgagaggctgtcataatcatagtatctctcctcctcctctcctttttccttaattcccttttgacttccctcagttctttcatctcttcaataagtaatgtccaagccctttatcagaatttccagagtcaaagatatatccccttctccaaggatctcacagagagacaataattataaaagagcaattataaagcaatatacaaggatagtaaagtagaaagagaatgggagcctcaaggaaaagctcataacccagcttggcttcccagaggtgataccgaaggggaaatcactggagaaatatgaattcaccaggtaaaggagaagtgtgtgcaggcagataaaacaacataaggagtaatacagagactgagaaaatatcccatgcaagaagcttcagaatatgtttgggggctgaaaggtaaagcctgaaacacaaagtgacaggaaataaggttggagagactgacagagagaaaatcctgatgtcagcggatccaggtaagcaaatggtaacaacatcatttttagataggagattggtgtgattaggattatatttcaaatggcaatggtataaaggtgatttcgaaggtggtaaaagcaagaaagagataaagcagaaagcttttttagtactagcagcagtggagaaaagacacatatcctagaaaaatttagactgtgaagattgagggacagaaaaattgaggctacttcccaggtttctacttgggtgagtgaacacatcgcatggctgctagttgaatagaggtagcagagggaggaatatattgagtgttttgtccactagagcgtggtggaaggtggagatgggaagaagaaataatgatatgttcatgttttaacatgttgagtttgagatacctccagtaccttcaaacagcaaatgaatacattagcctataacttagggagaaatatgtcccataaatatagtttactcacataaaggtagtggttgaatctgcaaaaatagataagaccacacagaaagagaatttatagtgacaacagtggtggcctgaaatcagaacctttaagaactaccttgccaccaacaacttctccaacctcaatctgccaagagacaccatttgatgattgcctccattcgttgctccataactcacccttccaccccaaaactgatttttcccatgcttaggatcacaaataactcccacactgtaatgccattcctaccctgaaacagccaccaggccactttattcatagtaatataaaaagtatgacacctgcaatcccactactgggtacctacccacaggaaaatagtatattaaaggtatacctgaacttgcctgtttattgcagcactattaacaatagcaaagatatagaatcaacgttaagtatccatcaacagatgaatggataaacaaaatgcggtacatatacacaatggagtactattcagccgtaaaaaagaatgagatcctgtcatctgcagcaacagggatagaactgaagatcattatcttaagtgaaataagccaggcacaaaaagacaaatatcacatgttcttacgcatacgtgggagctaaaaatttgaacacatggaggtagagagtgggaaaatagataacagagactgggaagggtgagtggagaggatgatgagaagtgggtgaaaaggtacaaacatggccgggcgtggtggctcacgcctgtaatcccagcactttgggaggccaaggtgggcggatcacgaggtcaggagatcaagaacatcctggctaacacagtgaaaccccgtctctactaaaaatacaaaaaaattagccaggcgtggtggtgggcgcctgtagtcccagctactcaggaggctgaggcaggagaatggcatgaacccggaaggcggagcttgcagtgagccgagatcgtgctactgcactccagcctgggcaacagagtgagactccatctcaaaaacaaaaacaaaataaagtacaaacatacaataagatagaaggaataaattcaatgtttgataccagagtagggtcactatgctcaacaaaaatgtattatactcagataatggacaccctgaatacccttacttggtcactacacattatatacatttaacaaaatttttcatgtaccccataaataggcacaattttttttttttgagatggagtctcgctctgttgacagactggagtacagtggcatgatctcagctcattgcaacttccgtctcccaggttcaagcgattctcctgcctcagcctcctgagtagctgggattacaggtgcaggccaccacacctggctaatttttgtatttttagtagagatagggtttcaccatgttggtcaggctggtctcaaactcccgaccttgtgatccgcccgcctcgacctcccaaagtgctggaattacaggcgtgagccaccgtgcctggccaataggcacaatttttttaattaaaatctttaaaagtatgacatctatcctcttggtcatgttacattttgtaaatatagttggtattttcaaaactaatttgaatacagaggctgatagtacaagaaaacttaaattggggtcagaaagactaccttcagcatatatttattcttttttttttctgcagtgcggaaagttggactaatccaatttaatgattctataatcactaatatagcaatcttccaactcccaagcttaaggagcttctctttctgcccctgtattctatttcccaggtcatcagatgcaaagcagccatactctggaagcctggtgcaccattttctattgaagaggtagaagtggccccaccaaaggcaaaggaagttcgcataaaggtaaaaaaaaaaaaaaaaaaaaaaatcacaccaaaagccaaaagccagagcttcttactgtaagttacatattcttatccggatattcaactcagaaaaaaaaataataaaactacatatctttgtatttctttttcattaaacatttccatcaatttttaaatccagccagataaaaggttagggaggtaaagcataggctaactgcccaaaggataaaactcaggcttatttacagctattgtactaattattaatttaaaaaaattctaccttcaaaccctattttaatctgtacttgtaaatttttatggcatccttcataatacttgtcttgaaatattttgaataaaaattgattacagacaaatcatctctgaatctggaaactcaagttagagctggaagggccttagggatacctgatattttacagatgcgaagactgaagccagctgcggtttagtgactggtcacacagctagtagagtaaaaataaagactaatttttctcggctgagcatgatagctcatccctgtaatcccagcactctgggaggcagaggcaggaagattgcttgagtgcaggagatgagaacagtttttctcaaccttggttacctatttggaatcagctggaagctttgaaaaatgctgataaccaagtcccatctccagaaattctgcaattgtgatttaattagtctggggtgcagcctggacatggaaagtttttaaattgccttcagatggttctataggcctcctccaaactagaaaatagtttacctgacttgcagttcagagtcctttgttattattttaattataacaataaagaataagtacagtttaatgatagattacaaagagacagtcattttctaagtcatctcatctgcacagttcatgccttcttctcagagagccttctccatcctacatcccctatggagtaagcagtgggctattgggttgttcgcatccactccccacccacagggtcacaactcatgcaaccaggtttggaccctcactcaaagacattcaaccattatcagacaagctacacatctgaatgtctcaccagtgaatttgaaccaagatatgggcactatagcagagtaagtgatggtaggcaatggtgaggttgggcagactcatcactggttaactgtttttaaccacgatcagcaaaataaatggagaaagccaatctgcagagaataataggtgaatgcaactatgcccatattgaatcaaagtaaagagataaagagaatgactatttggtaaatgtctaggtctatgaggtctgacagcactttctacagttgggttgcaggcaattcaggcaattttatggtattgttccaataatcctccttttacatgcacaaatttcaatatatttcatttcttgactaaggagtatgtgcatgtgaatgtgtggctatgtgtatgcaaacttcatatttgttttagaaatgaagaaactgagacccagaaagaaaaatttacccccaagttcacacagctgagaagggggagagccagtatttcatccctgaacacttaaccactgttctggagtgtcttcattttaaactgtctggctaacttacaataaagtgggattatgacttgtacaaataacaaaactataaagctcacttgtaaaataaattaaggttttaattaaattataataggaaacattattcctttgcctcctgtgttccaatttctttatttcatttcattttagagacagggtctcactctgtcacccagactggagtgcagtggtacaaaatcatagctcactgcagcctcgaactactgggctcaagtgatcctcccacttcaacctcccaagcagcttggactacaggtgcatgcaaccatgcctggctaatttgtttatttattgtagagatggaggtctcactattttgcccaggctgatctcaaactcctgcccttgagtgactctcctgcctcagcctcctgagatgctgggattttaagcataagccactgcactcagctcaattcctttatttttatagtcgttctttctcctccacacttccatctacaagatcaatgaagccaattgagacctcagacatcaagtcacactgcaattttacagcttctcttctgaccccattctacccacactccccagtaaattttcaatcatcttgattctgaaatcagctaatgaaaaacatttcattgctttaacaaattattattgacccttccctagaattaaaactgataagaaatgaatgcagtgtataaatggagaatatcaaactagcaaaaagccttacagtcaacaactctaaaacaccattatctgaaacagcgggaactgcagtaccctttgccttccatacaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtaggaattagcacctggtaataggaaacagcaacaacttggaaccaactcgagaaaatgataagcaccccttaagtatgtcaggatcaagtgaaatgaaaggtgaaatgtttccaacttcttagaaaagtagggataaattacttgtaagttacataaaatactaaatatattgtattctttgcatttacattttgaaaataagaaaaaacaagaagtagaatgcactgaaactggacttgaaagtacaaatgagacaaaaatttatgaaaaaaaggttgactgaggtaaactattgaacaattatttaaatgaggcatatgataaataatcaaacacattagtggaaccaaataaagaagcagtccagaattgaatccaaataaacataagaagttaatgcagcatgaggtttgtctttcaaacttaagaatagaaacagattattccacaaattgtgttgaaacaactagatagttatccgggctaaaaaagtaaattgggttgccatctcattctttatataaaaaaattatacatgcatctaaaaattaaatgtgaaaagcaaaaccatagaagtactataaaataacatgggagaactgtattatcttggaggagggaaggaaattttaatcaatacaaaaaaatacccagcagatataaaatagatatttatatagataaatttgacaatgtaaaaattacatagattctgcatgtttaaaaaaaaccccaaaagtcaaaacccagtatgacaatggaccaattttcttaatatagaaataatttctttaaaagcaatttttaaataaaaaaaggcaaacaaaatacatgtctaatttaaagaaatatatatatacacatatatgtgtgtgtatatatatatatgaatgctttaaacacattaaaatatgcccaacctcagacatattaaaaataaaaaacattttaaaaggctgggggtgggaaaaatggagagatgtggtcaaatggtataaaatttctgctagataggaaaaataagttttttgagatctattgaacagcatggtgatcacagttgataataatgaattatactatatttcaaaattgctaagagtatacatttcaaatgttcttaccacaaaatataagtcttcaagtgtttaacatgttaattactttgatttaatcatcccatattatatacacataatatcacattgtaccccataaatatataatttgtcaatttacgataaaattttaaaatgcaatgaaaaaacactttttccctagcagatcggcaaagattaagaagtttgataatatatagagttcacaagaatataggcagacagctccctcatatcttattgtttggaacgtagatttgctcgactctaaatgcagcaatatgtaatatcatttaaatttatatattcttggacacaacagtttcaattctagaaacttattccatagatatatgttcatgtactcattttctattgctgctggaaaaaatcaccacaaatataacagtttaaaacaacacaagtttattatctcagtttctataggtcagaaatctgagtgggcttggctgagttttctgctcacgtttcaaggtcaaaatcaagcgagtagccagctgggtccttatctggagcctctggagaaaaatccacttccaagttcattcaagtagttttcagaatccaattccttgaggctataggactgagatccttatttcctcaccagtggtcggctccctgaaattgctcacatttcttcttctgtggcaccttccagcctcgaagcagccatggcccactaaatccttccacaggtgttaagtcacttttacttcctcttctgccttcatctgctcttcttcttttgatggctcatgtgattaccttgggtccacctggataattcagtataatctccctatcttaatgacaactgattagtgaacttagttacatctacagagtaccccttgccatgtagcataacatactcacaggcatgacaccacaacatagtcacagtttctagggatttgtgcaggatatctttcggagggcattttagaactctgtctacaataagatactcattgcattactggttttagtgttggggtgtagagaaacaaagaacaacctaaatatctatcagtgttcatggcactggttaatgatggagcactatatgtactaaaatagaaagctccatgatacagtgttaagtaaaaaagctaggcccaaaccagggtagatagcatgcttacctttgcatttttaaaggggttacagtgctgaaaaatatcgtggttactggtcagagtacctgtctctaagatggggaactggggaatagagtaataattttcacttttgtgcagtttaaatttttaccatatgtatgtgttactttttaaaaaaataaaaataaataaaatagaagaaactaaatcttcataaggtttttaactaaaagtataaaacaaatttctctggtttacagtgttagaccatgggggcagccagtaaaatacatcacaggcaagctcttctaatcatgtcctgatactttgaccactactagagaaatctgcctacctttgatctctaaggtcaagaagaaagggttgatgtcaaacacagagaacagcatagaagcaattttttttctccctaatccagagcttactctgttagtatgtggtatccatactattttaaattcaatccctgagagaggaaattagtgttgaaaatgttgagaagagataagacttgactgaatggatatatgacaaaaaactatttcatactcgaaaaggagcttacaaaagaggcaaatctggggccagttcctcaagattcagccactgagcccagggctgggcccagatgctaaagacattctctctttttgtaagtatttgatattctttgtggtatcaagcacaactgaatgtggaaataattttcagctgtcatttcttcttgggtgccttgctgtcaaaatcctgaaagacagctatgtctttactttaaaaaataatatgttaataagacatgattttgctcttttaggtgacaaagttatcacactctttctgccacagtgtggagaatgtacctcttgcctgaattctgagggcaatttttgtatacaattcaagtaagtttttactaatattttctttttgaaaacttaattcactttcattggagaagatctaagctttctaattcaaaataaactttgtgttttgttttttgttttgtctataaaagacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgaggggcatttatacccatttggaagggaattattgggatatggagttgaaaggcctcttgcatctttgtcatctcttatcataccaaaggaaaaatcccaagcctgactccaaacatccttgagttctctgctatctacctagtcatcccacacccccttcaacatttttcccattccctcttggtgagtagtaaaagacagattaagtctggatgccattcacaagtggaaagatcaggaattactggaaattaaatctaacatagttacaacatgactctgtggcctttcatattccagtttatcctttctttccttagacaaatattttcggagccattcactgtcccaggtgctagaattcagcagctaacaaaactcatgaagctaatattatattgcatgatatattaggtagtgataaatgctaataaaaagaaaaggagagtaaaggaaccaagtgatgaagtaggtgttactacattagacagattgaccaggggatcccactctggctgaatgggctgctattgaactcttatttctaaaacatcactcaaaccttcccggctcccttcctaaaggtgctgttgaattttagaactttgcattttccagtgtccatcagtcccaatactatacagagagatagaatggaaaaaaattatttaaattagtcctatgtaggacagtactcaataaaaaaaaagcctttgccttcacaaggtattgacccgataagttatgaaaaatttacagataccgagagagagagagagagacagagagaaatggttgtaggaagatagagataattttaaagaactcaaaaatatctggaattaaatacactgtcaagtaagtcttaatattcaatgcaaattcatttaaactactactcagactaattcctgggacttgaaactctactttcaggcagttttttgttcctgtgccaagagtattccatatctagaaatatttttgaaaaatcaaaactttgtagttataatatgttatgtatgtaaacatcatttgcttatgactcgttaaaaaatacatgcatatagacttagccttcccaactgagtaaaggtgtatgttctctttgctttttgttttctgagttttctgcctgtatgtgtttaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggtatgtaatcctctggagtgaaaattaccaatacttttaccagtcatcgtttagattatagttgaatgagctttctaaaattccctccactttgctctatttaattttccttgtgttccatgacatctcagctggtgccgtctgtgtactcttacaaatttgttcactatcccagatactaaatctagaactttcatataatttcaaagccagaagttttaagcaagataagattaaaatttgattaatgaccttataaatcaatgtgcttttcactttcagtcgtctttcatgtcagatctgagataagtttccaagaaaaatatttactagtcacgattaaacgggttcatttcaaaaatgaaggggaaaaaaagtggtggtttttctggctaaacgtggtttatataaaagaatagaaagtgaggggaagttacttaaaaatctaaggcttgttttctttggggatttgaagaaataatgtattattaggttgcatggctctatcgtctagtcagctgtatggaaactcaacaactgcctcttccaacttgggcccttttcccagcataaaaaatcttttcatgattcaccatacataaattcctttatctgtaagaagaaacagcaaaacctttctcacactcttactctgagaaatagcctttgaacataacgaatgtaacggtatctgtttctcactttgctatcatcttattatataaatatctgtcttcttagatgtctaaaagaaaaatgtcaattcttaccagccacctgcatcagtaataatttttataaaaattatttttattattatcactactgtggatgtttttactattttcatttttgttatttccatttattgagtcctaaagtgccaggtactatactaagcaacatacaacgtcttatatgtgtttcatagcatccttacaagataaatgttacttcaaatgagaatagggagaatcagaaaagaaagtcatagaccatttaggagttaagctgaaattaagatgtaggctcaatcctcacatacatcttttaacccctatactgtattgcgtcactttctaacaggcagctgccctcgcctcctgcaatgagagctatggggtctgtgtggttgttggggtgttgcctgccagtgttcaactcaaaatcagtggccagttgttcttctcaggacgttctttgaagggttctgtttttggaggtatggatgaagcagggaaaggtggaaatgcctgaggaggtgaaggtgggaaatagaaaaatgtaccataaacgcttaagaaaggacataaaacaacagctttatattacagattttttttttcaacatatgaatacccaatataaagggatggatagtgggtgtatctagtgcctcttggaaagctttttctcatgcaaagatagagaagaggtttcttaattgattggtaaagaatccagtgtccaacatttaaagcaaactctaaattgaaaagaaggcaatattgtaatctataactacacttcagcgaaattatacacctgccagctgggattctttggagaatatacttagccattagttgtcattgttcaactcatgtaaaatcttatcccaaacaaatgagttgtcacgctaccaactcaaatatattaaacacaatggattcttgatttaaaagaaatactattgattaaaaaaaataagaattattttacccagaggaaaaatatcttatagaatcctttgattttctgttttttacctgtcctggaacatttttatagactttagaagactattttattgaaaaagtagaagacaaactaaattaaataaatctgcttaagattctgggctcataagcaagaaatctgaaatttacgaagaaatgtatttatccagaaactctgggcaatctgaatgcctgggcaaaaagagatgagaattagaggagtgcctgaattacttgcacaagtgagctgtctgtagtccccaagtaagctatggcagcatgttattacagatattagaagccttacctaattcatttataaagagtagatacatggcaggaccagcaaaaaaaaaaagtaataatccagttatatatataatctattaaatagaagaactgtaatttcagttcttctatttaagatcattgaatacatccattgccatttctctctattgtatttatagatgataatgttaattcaaaatacacatactcagctaagtcttataaaaataagattaccaatattcttaaaaccctcagtgaatgaaactaattcactggccactctagcactcatatagtgatcattaatgtaaattagtttattccacaaatagtatagtcctctggttcaatgattttcaatcaacaatagcatttaacaggtgttggacagtcctgctaaacctcccacaatgtgcaaaagaaagaatgttccccacccaaaatgccagtagtgcccttgttgagaaacactgcctagtcccgtctgtggtcctagaattttctttcctatgtcatttggttgaaataagaaaaaaagtggagggttgacatagatgtaaaaatgttttatcagatcaccaatcaaaatataaaaacaaatagaaatatacactggcccttcatgtcatgacatagaacagtaattagtattcttggttacacataacagaaacaaacttaaattaaaaataaatctattagaagagtttgtggtagtttggagaagaagttggggagcctaacctaagctagaaccaagaaaagcaagtaattgtcaagatcctatcacagaataatccgcatagaacactaagcagattacgccacattatactttgcacaattacaccacacccaccctttctagcaatgagcagactgccaaagtctgtgtggtaactcactgagcgtggcacttagcacagtgctaaatttaatgtgtttcttgaaaatcacgggaatagagaaaatacaatgctaaactacatcttaccttagctaactccatctttgcttgttcaattcttacttccagaaagcacattttattcttatattgctttgtacacattcttttcccaagagctttcactgggactgctgccacagtgagagttcttcttttcctttaagctatttgactcttttatgaagtggcagatcaaaacatacacatgagggaatgcacacacaaaaaaatgtgctatatttaacatttgaattgcttctttccatgattcccaagaccttggcctttgttatacattagatatagattcactgctccccagagattgcaacatgacaccaggaacactcaaggcaaggtccacattctatctgctttgaattaattctcctctgtagtaccagaagtctcctttaggaacacagccctctatataatgtgtgtggttggggtaggcattctcctgatgattgaggcaagtaaacgggacaggcttagattttctcagtcaaagccaacaacttcagcagttactttgaatgacctttcctttataatgaagcctcatgtgtaaaattcatcattaatctgtatttccaggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagtatttaagtgttcacctaccgttacttttgccattagcattgtatttccaatatggattttttttttacatgacatattaatggaagtcagcttataaaattgtagctcaagtttaaaaacataagaaggtagttcacaaataggccattgttgtatttgttgttctactttgggggagaagaggaattattcataggattcctaattctgaatcctatctttgacccaaaaaacagaaaccagccataacccagaaactggcattccccacacgagtataagcttgcttacctactttttacccttggagtttcatgtcattttaaaaaatcttcccatggcttatttaatcttctcatttttcacctaaagagaaaaaaaatctagtttactgctctacaaagtgagaatttgaaatccaaaacacaaatgttgctctaaaaatgttccaaccttttttctcttcttctttttttcagtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttg

SEQ ID NO: 13958 - DNA, 6536 bp, Human
tggattttgaaaggatccctctggcaggatggagagggcaagagagacaccacgggagaggctgttggggaaatctagattggcgttgctagccacctgggccgggggtgggtggcaaagaaggtgtccaggagtggtcagattctggatctcttttgaaagtgaagccaacaggatttgctgagagactggatgtgggctgtgggagaaagagaggagtcaagcatgacctcaaggtttggggcctgagccaacagaaggatgaactcctccatcttgacttttgtctcctgagaaggggagtcattctgtgtgcttcacatgtatagaccttgtaagaaggaacttccaggcatatggcaagaacttcctaagccctggttctcgaggggctggctgggtctgcagggccagcctaggcactgtaaggtggtttgcaaaaacgcaccctggtctccacccaccacatatgctcagaagacaggaacatttgcttcaggctccacagctgacaaagcacatttgcaaacactgagcgctgtgacgcaatatctcagccctgctgagctaaaaatcctggactcattgccctcatgttgcaactgagaaaaaaggagacccagagagggccagtgactcccctgcagtcacaaagtcgatccatctgtggcagagggggaagctgcatcagggcagtttactgaagggcggaacctctcccccacctccccacactgtttctaacttctgctaagagtgcagcgggtgtgcatgggttaatccgccagccagctccccagaggccatcctggatgatgggctcagtgcacatgcctccagaggcctccaggaagggcgggaagaggaccctggccaggccgaaacagcaggccccgggggcagggagggctccacacacgtgatgcctgtgtcacatatacacatatatgtcactgtgtgccccatgcccatacatggccttgcatgggtcccctcacagccttccacatcctgcgtgcagcccagcccccacccagccccctaaaccacgcaccctgccttcctgacgcaggagcccagagaggcatttcctgtttaggggctgcctcctccccctctaagcccaggttcccagggccccaggctgagctggggtgaggggagggcagcccctggccccctcactcccccaacacccccacacgctggcccagctggaaccagaaagcttgagtatagggggagaggctgacgcaggggctcagtaaataaatgagaggctgaggatgcctgtgcctgggtgaccaagctgtttccattcaggccgaatcggaggtcttcatatgtcaggccatgtagaatgccacaccatttttgtatgtgcacctagggtctcagcatgtcagaatgtgtgtacgtgtggcaagggagtcatctgcaagccagcataggtccacggtgaggtgaagggacaaacagcttggcagagagtgcactcttgcatggggttgggggtgggggaggcgcatgcgcgcgtctgtggggcaagaaaggagtgggcatgagggtgttcccgtgcatggcgagcagctgggctgagactgctcccgggtgtgatggggctgctgtgtccagatttgggtctctgagtctctgggaagcgacctcaccccacagccccgagccccaacttgagggtcacagagctcggcaggcaggcttttcccaccccctgactctcagccccatggggcctggggcagccgtcaactgcgccttctcccctcctccgcccccaaccttagagccccccaccccactgcttcctgctctagcggcccccggggaagagggagcagggagctggcagccgccccagcccactccttacaaggcctgagcccggccccaggcccgcccccggcccgcccgcaggaggccccaggccctccccctgtcaagagctgccgccagcccggggccggaccagtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaaggcttctgacccccactggtgcttaagggaggttctgggaggactcagcaaaaaggaggggatcttccttcagtttgtctgagtcctcaaagagataaggtaagatccctttaagggagggtatgcctcagagattctcagggaagcaggagcccagagagggcagagccttgcccaaggtcacacagttgagcccagcagtgggaggtttggcatggggagaatttcatatttattccttattttaccaaagctccaagaaggtggggctgaatctgggggacggttgtggaattagggcatctgctgaaccggactggggtttaggggtcaaagtaggctctggggctggtgattcagaggagtgaaggaggggtctagtgggtgagttgctcctttcttcagacacttcccttcccatccctgtaagcttcgcggaagttgggggctggggctcagggtaactcaaggggactgccaacccctggtttgtgggtgctcttggaggcattcctccgcttgctccggggaggaggctgggatgggaaaggccgggaacctgggagagatcccatgctaactgcttggacagccgcaggagcaaggcctccttttgccagggccgcacgttgctcttgtccatgttggctgggggtggtgggggacagacagagctcagcagacctgagcttgagcgagggctccggctgctcaggactgaagtgtcccaggaactggagggcctggtcaaagatcacagcctggtgggagtgacctccctcatttcgggctcactgccttggggggcgggggtgagacctggggaggggaggcgccagttcccaccgcctctgtaatttttcagttacagcctcttgggggcctctaattaggacggggcagagccgccacgaccacccgggcaggcgaggaggagtggcccagcgcccccttcgggcctggacctgagctggaaggctgagctgggccccagggaaccaggaaaggaggggccggagctggggatgaaccagggggtcgcggagggggcggagggaacgctacgcaccgcccccggtccccgctctcacgttcccctaactcaaaccagacgtccccgccagatcctgcacagctttaacctcggagacgccgtcgggcaggtttgctggatgccaatgagggttgcgaggcggcccagacggctgagtctgggaaggaggtgaggaagcctggggagcgacaaggcctgcagagacgggatggtctggagtcccctccgtgacctcgggtagggatctagagcgcctcgagggcaggaaacagttaaatacactgcagtcggaggcgggggatgggagtggggaagggggcccagagccggctctttgtcatctggtaatgagcaccagatgcggagctgcgtgcgggcctaaacagacggcctcccagggcagagccccggcctgcgcccagcccgggctcagcccacttactcgcaggccccgcctcattcgggcgcggcggcgaactgcatactccagcggtatcagcccggacctgggagctacgagccacgcctactcgctgcagaacagaagagagcccccgggagctctccagaggccccgcccacaaagccacaagccccgcccctgccaactcaaagattccagcagcgattgtgcccgccccctgccctcttggccccgcccagtcccccgcccacaacctacaagccccacctcctccgctcggcgcgcgcagattggcggaactattagtctcggcttctaggaggtatgaacttcgccccgagtttacacattctcttcacgcggcgctacaggccccgcccaacacaactgcaagcttcgcctcacagagccctggacactgcagggaatccctcagaggtcttaactctgtcgggggatgatgtaaactccgccctccagggaaacgtgtgaagttcccctcaacctcctcttc

SEQ ID NO: 13959 - DNA, 4336 bp, Human
gaccccatggatgggctgcagggaggcaggtagaaaaggcttttgggttttcaggtggggggcagtctagcctgatcagaaaggaggaaaaggccagggccagatgtctgggtggagtgaagggaaaaagtgatcccagaagaaggattagcccctgaaagtccctgaagtaggagaagggtaaaggtgtggttggtgaaggaaagcaggttttcccagattagcaaccagtcagggggaggaaggtgagagtgggagagtcataagtaaattattctgaatgtgtgtagtttaatggaattgggaaaaagatgggggaaatggatggaagggtcttggactctgagacaaggggtctataatcagtccatttcattatttctagcttccaccttcaccaaggcagacaaggagggcccacctcagctcctctgctccccctccctttcccacctattcatgtgtgcaagagtgccctgtcccacagaacacggggaacaaccatctcaatgacaaggacagcaggtggcaaggcctcaacaggactcagatgtccccccagggttaactcatgaaaccctccatgaagcctgctgctcacccctccctcaaggcaagccctgcacctgggtctgaggatgagggtggcagtgaaaattaggccagtgacatcattttcagccagccagtgccaaaaaatatcaggtggtgttcatcaaaaaagctgagccaaccggtgatgaggatggtagtgtgagtcatgtgtgacaggtgaggaatgaaaacagagtgcccgagagcttctatttccttgaggcagggctcattcatcttataaaagccagctggccattgccttcacaccaaacccaagggaccacacagcccattctgctccgtataccaggtaagtctctgattgcaacaaactggcaattctagtgtactttttcattattagaaattagctaaaggcaaatatgtgtaagcaggttaatccagggtttcaatgggagatagagaatagtggaatatctttattttaagttaaattacagtctggatttgaaaggaccttagagatggttagggctcccacctcagtagatagtcattgaactgggagtcctggagaagattgttcaaatgcccatgggaagttcatagcagaactagaactcaggcccagagcactctcagtaacactgcaatttccccctgacaagatatttatagaaattttaatttattagatggatctctactgagcatttattccatttaaggcagtatgctaggcactttggacaaatcaatgcctaacgtacttacttaacaaacataaaacctagcaggaaggtaatacatatatataaataaatgaaatgcaaagtagatagtaattggcatgacggagatgggcagagaagggctgtgcacttttgggagaccttgctcaaggagaccctcctaggggtgtcaagtgatgtgagctatgatggaggggtatttggacaagcagagatgggaagaaaagcatttggaagggactgtgtaagcacagaccagaagcaaaaccatagaggcttagatgaatataaagccatcctataagtcacaggctttctacatggtactaggagaggaaagtggtctgatgccattttccaaaagacctaatatgcggacctcatgtccctcagaagccagctttagtagggcatttttccagaacagatataagttgccttgggtaggaagggagccaagaagagaactccaataaaatggagcagaagaaattgccttttagctcctcctcttcaaagggcctgaaaattatccaagcttatttcatttttaaatgtaatgggggagttaagggagatgaaaggctttctcttctaaagggtcctgaaataaaatctgtttggcattgaatttgtatccatctttctttaattgaatcactgtgtcagctttctgtctctagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttggggaaggatcaagtgaaccatccctagtcttccttcaataaataacttttaactccacatctggctgtgcgtcactggttgattcaacctctgttgccttctcagcgtgaagtaggaactaacactgtgaaggctggttgtgaggtctgtagtcagaaggtggccgatcctgacactgagaatgtgtgtgaatgtgtatggctgctgtacacacaggacactcctgggctggaagtgggagtatgttcagggccaccaacccaatctgttactttgggtaggcagagctagagcaaggcttttttcttttaccttaatgtttatatcttaatgacttgcagtgagtcacatgtgagtgtagatggtgcccgcttcaagccatcatcatctttgtttagttgattcctttttaaaaattattccaaagaaacagtgcttgtgcatagtccagcctagtgatctgttctgcactcatcttccttttctgatgcccccaatacatggagccaaggacttgaacactcacaccatacccacaaacacatatttcactcccacacttcccacacagggatatactcgcatgcacagacattcaaacacacacacacatacgtagatctccaaaatcccaacactcacacacacacactccttcacacacttggatctcccaaaccacccaacactgacatacacacacacatgcactttctctctctctctctctctgtctctctctccctctctctaacttaatcaccttagtcctatgttttttcatcgagtgcctgctgtgaagatacctgatgctgcagcaggaagaaggagagttgaatccataccacctgccctagaagaaccctaagagaggtgatcttcagtctccttcccatacaaacataagctctcaaaaaagtacacacatgctcctctctccacacacacatgcatgagcacgcacacactgtacttttgtaagacataaaagttgaatattttatccaataactgccgaatagacacatttgtctcatcagcacataaaatattacagaccacatgttataccacaaacaaatctcaacaaattttaaaaatcaaaaccatatcaaggatattttcttacaacaataaaataaaactagaaatcaataaataataagaaaaactttagaatttttgcaaatatatggaaattaaacaatatgctcctgaatgatcaatgggtcaatgaagaaatgaaaaaaaaatttaaatttaaaaattaaaaattttttgaaacaaataaaaatagaaatacaagataccaaaacctgtaaaacatagcaaaagcaatagtaagaggaaaggggttttttttttagcaataaatgcctacatcaaaaaaagaaaaaaaaaagctttaaatgaagaacttaatatgcataccaaagaactagtaagcaagaacaaaccaaacccccaaaaaaataaagatagagcagaaataaataaaataaaaactaaaaagctttacaaaagattaatgaaacaaaaagtggatttttttgagagaagactcaaataaataaaatcacaattgataaaagagacattacaactgatatcacagaaatgcaaaacatcctaagagactattataaatagcaatacacaaacaaatggaaaacctagaggaaatgaataaattcctgggcacatacaacataccaagattgaaccaagatcaaacagaaaccttgaatagaccaataatgagtaatgagattgaagtagctctaaaaagtttcccaa

SEQ ID NO: 13960 - DNA, 6608 bp, Human
ggtttgttacatatgtatacatgtgtcgtgttggtgtgctgcacccattaactcgtcatttacattaggtatatctcttaatgctatccctcccccctccccccaccccacaacaggccccggtgtgtgatgttcctcttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtatttcatggtgtatatgtgccacattttcttaatccagtctatcattgttggacatttgggttggttccaagtctttgttattgtgaatagtgccacaataaacatacgtgtgcatgtgtctttatagcaacatgatttataatcctttgtgtatatacccagtaatgggatggctgggtcaaatggtatttctagttctagatccctgaggaatcgccaccctgacttccacaatggttgaactagtttacagtcccaccaacagtgtaaaagtgttcctatttctccacatcctctccagcacctctccagcacagaaagagtattgaaaataaatgtagatattctactcaggaaacaaggaaactttttatctttcttttaacttagaatttagaaatgataataagatgaaactaggtttggacctttttcaataattctgaccaccgttcagtaaatttactgtataagaaaagtagaggtttggggttgaattttgttttattttttcccaaagatgtctatctctgatatcttagggcctggcaattgtttttggtcataggtgggctctgaataaatgtcagttgaacaaatatataaaaaccaaacaaaggaatgttatttcaactgccttcagagtgtcacaacaaatatcaatgaaaaagaaacaaaaataaagactcaattaattctccagtgaacacttcagtcctctaaaggtacttccctgtgtccacccaaactgctctctaaccgaacgcaagcaaggggactccaatgctctcaggccatgaactaatgaggagcttcatgcctgccctcagtctttcttcatacccagggcaaagctggcccacagacttccagacatgctctcttcgtttgggtagagatggggatccaagtcccctatgtatttcctccagagccacctgtaaaacatgggtgaaatctacctgccctctagctcaccacttccaggtcaagcccactcatggaccactttaacagtgacagttggcttgactggggaaactgaaaaaaaggagctttctttagattttctgataatctgcattgccattgctgctcctttttcagcagcacagagagttggattatggagggttgcctgcttattatgcagctacatccaggatgctgagtgtcttctgatcatgatcaagagcagagtgaagagatacaggcggaggagaggatcacagagaggtagaagtgggagactggtggataggtcactaggcaccactgagtgactaccatcacttctcacagattagattattgacaagccaagtatggatttgatttctacaaggccaaaagctactccatcttctagccagaccacagactttgttttaagccaggactcgttttccagcagttagtgcaattagggaggttgggaggatgtacacaagagcagggagaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcaggtaagaagagtgcaggtggaaagatacctatggtagggcaccagagggctgagaggaagctctggggaggtcctgggggaagggagcagtactcttctaggatgcccttggaatatgcctttcaggctagttccaggcagagaattcttgctctcagtctcagtttttgtctctgattttggagaaaggaagctggccccacaggaaaagggtattggagtatgtacaagctacctaactgtctctcatctctgggttccttttttccctttggcatcacttttcccatccctttacattctctctacttgtcatttccctctctctcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaatgtaagttcgttgctctaagctgataatttgcctgggaacaccaactattttccaaagtggaagatagtatatagactctgaccatcatttaaccttactaaccttgttccccactctctgactcccactccctcctctgcttcacccttcaccaccacccacactccaccatatacacaaaagggcctgcatgtacatatctcaacatgaatatagcttcatgtctggctctttggaatgattgtctcctctggatcttctgcccctcattcctgccctcagactcagcctttctcaaccctctttctgcccttctttatcctttgcctgagtgttgacatggactggcctgtacctaaccactttcacgtgaattatttatgaccaatctcctatcttcctgatagccttcccatctaccactttcccattagttatttcaaagtatctttattatcttcaaattttcttcccacaaattttcttcccctttgccagtaaactctagtctccatatgatttcccagcaaatttttcttcccttgaatctctttactgtctaaattgtttgtttttcttccttgtcattctttccataatgatctctcttccctgtccactctcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaaggtgagcccaactctctctctcccctcttgttcctagtactataactctcatatttgaatttgcctctcatcatcattttgaaagacatagtgagagactagagaatgagatgtgtgggttcaggactgtttcttagacaagagaaagaagtgattactaaatcactcttagtattattacaaaggcacctgagtctctgagctctggcctggggtgcccttcaaaattccattttttttctatcttcttcttcctagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtgagaaacagctgaggctctgctgggaaataatgaaaatagccctggggcttttgagtgtggggctgaggaaatgggtaggaatgctaggtacaagaagggtaaaactgggacaatcaaaataaagaaggatagagtatgacagtagttaaattttaagaaaatggaagtagagaattagacatactaacagaaaaaggaggaggaactagtgatttagtgggagagggttgggaggagatcacagacaaaggatcaggaggaattgaaatgagggctttggaaaacccagatgaaaattctaggaaggtcccacccttgtgaaatgggaaatctcagcttggtggaatagagtattttagggttggtattcttattctatccccaaccaggtggatattccatctttctcatcctgatctgtttgactgtgatagttaccctggtcatattggttgtagttgactcacggttaaaaaaacagaggtgagctttttcttgttctttgtttcttcagcctgtaatcaattcattcctttttcctctatcttctttttttttttctctgcctttcccctttatttcctttctttgagattaatatcctcctcttttcccacagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaagtgatgttgttttactccattccctctctgatatctctgcgtcatttgactgtgctcttgctaaaactcttcctctctccctttgtctctcaccagaggtgaaggaggcagatgaatgcctcagactccacagtgattggaatgttaatgaatcttcagggatatttaggaaaataataacataagggctatctcctgtcaaagtgaggagaggtttgaactggcattcctacttccctgagccatgtgtatctatgtgtgtctttgtggatgtgcatattcatgggagaaattcatattttgagcaattagaaggaggacatagggtttgagccagagctaaggcaatgaagcaaaagagtgattggatgccagttaagctacatgcttgtttttatttattagtgtggcttattattgttattattatttacagtttgtttttctttagtttttatatggattcttacatttacataatttacttcatttgagatacatttggttgagcctactggagagcaggaatctggtagaagtgcagtgtttatatacatgtccagtcaacccctcccttggatggaataattgagcagattgtgcatatttcttttctttttttttgagatggagtctcgatctgttggccaggctggagtgcagtggctggtgtcagatcactgcaagctccacctccggggttcatgccgttctcctgcctcagcctccccagtagctgggactacaggcgcctgtcaccactcccggctattttttttttaatttttagtagagacggggtttcgccatgttagccaggatggtcttgatctcctgacctcgtgatccaccccccttggcctcccaaagtgctgggattacaggcgtgagccaccgcgcccagccggttgtgcagattttttagtggaagttataaacttcatgctgggcattttcaagtaatcagcaagggtcccatgatcacacatccaggctgcactcttactcatgaacaaggtatgaggccagccttttcactgttg

SEQ ID NO: 13961 - DNA, 13146 bp, Human
tggaagtcaccactgattcctccctcactccatcctcactctgttcactaaatcctgttgaattcacccagatggtcattcagtgagtacatttcaagcacctgctatgtgccaggcattgtgttaggtatctactgcgaagcaaaaatagacaaggtccttgccctcgtggcttacagtccagctggggaaacaatatcatgaaggaaatgtatcctaagttaagagagtgtttagtctgggagacagagaaggcttccccaagaaagggggagatctaaagggtgccttaagaattaaatggatgaaagtcataggtggggagttcaatttctaagcaggcagaaagtcctgtgtatgagctctgaatgaggtggaaggaatgaggaatgtccttcaagggactaaggaacggcctctggaaagtgagtggtcttccaggaaggccatcgtggctgaggggtaatgaattgcaataatactaggatgggagaggagagtggggaagtgggagaggccccattgctcagcacctggtaaagattttggtcctttttttgagaggacagagaagacttttaagatgagtgggatgatgggtggggaaggttgaggaatgacagatttctatatgaaagtcactgtggctacaatgtggaaaatggattagatggggcctgggcagaggtgggggaaggctttcccattggcttcctccttgccatccccatagccatgatccccagtccagatttttgttgtctcttcttgtcttgcagcagaaaaccccactactattgtccctagcaacttaccttcagtgtggctgtctcacttctgacaaaagaaaagaaaatcaacaatccttcgttgggctcaaaataaagttcagagtccttagtctggctacaggtcccttcaaacctggcccttgtctccctcaccagtgtcacatccaaccacttgtcatcaatacctgagctctagttcatacaagggagactcgagagctggaccgcagtttgaggtgaaaggaccagaggagtagaggcaccgagagccaaatctgaggccgaatcagaggtctaggatgttaactgaacagaaagtaaaggaaactggccgaagcgggggtttcaggcagttggcttccagcatcttcaggcggttggctacaagaacatcaaagaccaacatttgggaagcactcagggacaaggcatccagaggcttggatgcaagaccaaaggtgtagttgatgggaggtagttccccaggacaggcccccgaggactgacagatgggagcttaaggacaggacccccaaccagtagagaaatgaggttcccgaacagccatgaccacagctggcgcagaatgggcaggactcagagacttgtaactcagaaggtcaaggacaatggctgatttgaggatgacttggtaggaggagaatgatgagaacattctttatattctacctgtctggagacagaatgaattctagaacaaaaggagcaaggccaagcttccaatcaaggctagagctagaaggtcatggagaaaggcgtgggcagctcctgccttcgcctgcaccaagttcaacaaacacacagtcatagccatggctggtccccagagcacacacaaggcaaggatgttagtggccagccccatgcaccccgatgagctatgctcgcttgggagacccatcctccttgaaggtgagtgaaatctcaacacgagtatggttctgagagtagctctgtaactctgaggatggtctctggagaccatgactgtgtacagttcacatggtaaccagaagactatgacatacttcagaaggtggtgaggtcatagaacacaagctttaaagtaagtgaatcatgtgtgcctcatttatttttaaaagcaacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaagtaaaataacttatttttaaatttttatagtcggtatattagccttataagttggaataaggaaaaatatgtgacaatcaatagttgaacaaagattaaaagggttcaggataatgaccctggtgacttaggaaagatttaaggaaagaagagtaaatgagtccatgatgggaattgtagggttctcaaaagacaatgtaatgatgtcgattggcaaggtcgtcggtggtttatagcaagaatgccagtatgataaataatgcggctttaatgaagggaagaaacagggggtgtcattaaaaagccattggaagcagcaaactaaacatttttcctggttatgagtaaagtgatttgagtatatttggacttacagaaatgactacaggagaagtaataataatagatcaaatccttaatgtgtgccagaggctttacaagcaggagagcaaattgaacagtagaggcattgccttggttttgtgggaatatcattctcctatccccccactccaggcaaagacttaccttgtatctggaattaggtctatcatgttggcctcccctctaactctagcaaaggtcttgcaaataaactatggcactgagttgtagctttcaggatagacttgaaaggatttttaattgaattgggtaattaaaaagagtcagttttttaaaaaaaattttgttttaggttatattttctttttgcctggagaaacctttccttttctcactttttacatatgccatttagtctgttactgttgatgaaaaagatggttgaaagtgctgtccctggttaaataaataatacattcatgcactggaataataagtaaatatagaaaggattgatgaagcatcttacatattgatgtattaagtcaaacaagcaaagtgcagaaaaactgatagacagatgacagatagatagatagatagatagatagatagatagatgatagatagagtctcttgacaacagtgacagtgatgtttctttggaaaaagcaataggaggccgggtgcattggctcatgccagtaatcccagcactttgggaggcggaggcgggcagatcacctgagctcaagagtttgagaccagcctggctaacatgatgaaaccccatctctactaaatacaaaaaaaaaaaaaaaaaattagccaagcgtagtggcacgtgcctgtaatcccagctactcgtgagactgaggcaggagaatcacttgaacccaggaggcagaggttgcagtgagccaagattgcaccactacactccagactgggtgacaaagtgagactgtctcaaaaaaaaaaaaaaaaaaaggataattattgtctaggtcaccagccaccaatggtcaggaatgaacctccctcatagcctgggagctttcacctgtaaattcatctatactctttgaaccaatgtttgtttttatttcttagggcatcaagtcacataaatcgctcacactgtgaggcagggactctttttaaaatatttggtccaagttaaggtttccttgtgagcagatcagtatccactctcctcctacttttggatacttgaatacccttgtccaggtctttccagcctctgtcttcctggcttctctcctatccccagactctaccgattaaaatccctctctgtcctgtgctgtctactctcttgatgcctctttcagaagccttgtttcttggcatgcagtagaaacagcttcaagcttaattctcggcagtgtagtttaggcaagaggtaatgttttctctggtttgtgatgctcttcctgacagcgtctgggtctttgcctattttttctctgcctgcaggcaatatgtgaagctggtgatgtctttacattaatttctggatctcggaaatgataactccaagtccattgtagaaatgacctcaggcttgtcctctttatctcttccaattcacaccaccttgtgaaattctatgctctatttctgacaacttgacatttcactctccagaagggcttagtgtcacttgcaaacctaaatattcaattttcctgaatatgggtgaaaatgttaaaccctgattctagcctcagtcccagaaggcccccaatgtagtattttttcttctagtgcagtgccttttattcttatctctaagctagcgcctgatccataactaaatagatgcagaaatatcatgttgattcaattttttaaaacaatctttggtgtgaaagcttgcccaaggctttttgagtttagaattcatattcacatgaccttcctcccctttaaagaatgcaagggggttggttagttatgacatatcctttcagatggcaggctgtgttgtccagaaggttctttgcccaatatgaagtaaagactctctagtctatagttgccttggcccccttgaaactgtttttctgtgtcacagtcaatctgctgtgtctctgggtcctcctttaataactggtaaaaagcctcaactaacaatttcttaattgatcccacaggtttcttgagcactcctgactatatgttatttgattgatgcatgtgtgtggtgttttcttagactgggcatagaaaatccaatccaagctgggtgcagtggttcacacctgtaatctcagcactttgggaggctgtaacaggagaattgctcaagtccgggagtttgggaccagcctgagcaacacagggagtccccatctctataaaaattaaaataaaaaaattaaccaagtgtggtggcacatgcttgtggtccccggtactcaggaggctgaggtgggaggactgcttgagcctgggaggtcaggactgcggtaagccatgattatgccactacactccagcctgggcaatagaaagagaccctgtttcaaaaaataaataaataaataaaagaaaatccaatccatttccattctttattgggcagctgcttcagaagacaccgtgttgtcagtgtcttccttagtagagacccaagtaagcacctttgtttctgtagcttctttgatatcctcttttcctccccaagaggcaggcggtgtccctgtctcttcctccctcttctggatttagaggggctgaggggactgcattggtttcctttgtcagaagccatgccaccagcctgatttaagttgtaactgattcaccaccacatttcatgggcttccctgccctctgtcttagagccggagaaacaaaacccaggccctcctcaatcttgccctaggagtttattatctaattcatgggtgccccatgtggccaggacaccaagcagtcctcgtgagcaaatgaaccttgatttacagctgtactctttaccggtacctagaaacgaatcctgagaccgtgtttctgtccacgtacccaagtgtctgtggttggcacgaatctcagtgaaaaattcccttgaaatccccacaccaggggcactctcaaaacttcaaaaatctgccttctcatttcttggttcccccttcatgctctgaggatgaggttttcactgaatccactcttgcttggtgaggctgatgacagtcaggcctcatggtgagctctttgtggatttagaggtgccttgcccaggtctaagccctcagagaaaacattctagtctctctcattctctgacccagaggtcggagtataagtgagccctatggggctttctggctggtgaaaggctggctcttccactcccactgaggggagctctcccttgttaacctctgtgtcctctgcagaagtggaagtgagttgggcccttggctgcctctcatcatagactcttcacatccatagttctcagagctcagtcaccccttggctgtgggggtaagagtctctccccatctaggccaaatgcattggtatgatttggtttgaccttgctgtttattgatataagacttaaagcttcagattagggcaagtccatgtaaggtggggcctggtgcagcttgattaagaagacatacactttattgagtgaaactgttactagcacttcatgttcatttaagccttgtaacatgggtgacatgttgggtgatattatcttggtcatcttacagacaatgaaacagagtcaggggccatgttcttgatcactaggtggtggcagagccaagacttgaagctgtgtgtgcccgagtctggaatccgtgagcttaatctctggtcagtggttctcgaagtgtggcccctgaagctgattagtagcattacctgcagcatgttagaactgcagattctcagctccaccctagacctgctagctctgaaacctctgaaactctaggggtgggatcaagccacctgtgttttttgttgttgttgttgttttgttttgttttgttttgttttgttttgttgagatggagtattgctctggcgcccaggctggagtacagtggtgtgatctcggctcactgcaacttctgcctcctgggttcaagcgattctcctgcctcggcctcctgagtaactgggactagaggtgcggacaaccacgcctggctaatcagccacctgtgttttaacaaaccctgcaggagagtcagatgcacctgtgccatgctgcctggctccctgctgagtgacattgtcctcagtatcaacccaaaagcctggagaagagagaaaaggctggaaaataagagaaaaggagaagaaaggagaagagaaggaaaaagatgtgttggaaagagagggattgagtttaaatgggtctttgggatggggctaaattcaggagaaaaagcaaagtactccaatgcagcctagaggaaggcctgccccacctggttccctgatagaggtagacatttttcacatcttcattactttattcatgacccggttaaatctgatttttatctttgaaaagatggctgggtatgcagctgatcattgctgtgggcagcatgtttcatattcgggagtttggttgtacatccgggtgaaatttagcattagcagggaggagaggaggccgcacagagcagcagacacaggcactggctgtctgctagctttccccagctttcctaagaggcttctgcaaaggagctgatttccctatgtttattgaggctaagcttcgcccccatgataacaagtataggaggcaaactccctttgcgcagaaccccatagagccatggaaaattccaggtggggtgatggggacatcaccaggcaggagtcaaattgcaagttcagagttgagtctgatgagtaaaatgtggcttctgcagtttcccctaaaccaacacatcttccctgataaccactgacttagaagcaagaagaaaaagaagtatgatctggccaagactttttgggcaacttcctgaagacatttgtgagatccttgtgtgctgtcgcagagccacaggagccaaagtgaccagaatagagaaaaaagaggaacccaagcaacaaaatacatgaaattgtgccctgggacccaggttacttagagatgaatctgggcgctgacttgggcttatagacctggctcccagatccagcttctgtggaggtcaagagggctttgccaaaaccagctgtggccatagccagggccactagcaaggactcctagttggggcccttggccctcctttaggaggcctggctgcatcatcctggtgggatttgatgtttctcatctcatatgagaagatctgagctgaacaggagaagtttgattctcagaccatgcacacaccgtgggagagtcttgaaaggcccagagagtgcccatcttgctctgtgcttccccttggccttggctgctctggctttaagcctgtaatctatccagagagggtaccatgcctggagtttgggctggttccctgaatctttgtgagctattttctgcccatccagcaagatagagtgcttgttctcctgcttacctcacaaagataaagatttcaaacagttcaaaattctcctacttctcgttagtgtggcatagggtaccctggcacacccagggcaagaaagacaatcatgccccatgccacccccaggtttcatggggccagaggtagaaatggggctgaggccgggcgcggtggctcacgcctgtaatcccagcactttgggaggctgaagtgggcggatcacaaggtcaggagatcgagaccatcctggctaacacggtgaaacaccttctctactaaaaatacaaaaaataattagccgagcatggtggcgggcacctgtactcccagctactcaggaggctgaggcaggagaatggcatgaacctgggaggcggagcttgcagtgagcagagatcgcctcactgcactccagcctgggcaacagagcgagaccccgtctcaaaaaaaagaaaaaagaaaaaaaagaaatgggactgaatacagtcctctgggtgtattacacaagttgtttctgtttgcctcagtgtcttctgggactgaattctgtttgatcattttataattagccactaagagtcttgatctgtaactttcagtacaagggtagtgagcactcaaactgttatctaatcatgttagggcttaagtggaaaatacagataaaaatcagtacgtatagcatgatttcataagaacacatacaaaactctctctctacatgtatatagaactacacacacacacacacacacagacacatactcacacacacactcacataaagtcaaacaccaaaatgctaagggttatatgagattataggtatttttaaaatagtccatatgtttacttatctgtattttgagtcttctacaatgaacttgtataacttatgtaacaaaaagaagtaactgcataaacaaaattcaacatacaaaagtgatatagtgataattacatctgcatcacagttattattgtaaagattaaatgaaatatgcctttaacatgcttagcaccttccacagcacattgcaaaaaaaaaaaaaagaaaagacaaaaccttaacatcctatgtgccaagtattattgtaaatattttcttgcattaactgatttaagcctcacaacaaccctatgatgtaggctatttttattgtcccagttttacagatgaggaaactgaggcaccgagaagtaagttatccacatgttagagccaagctttaaacctcgatactccagttccagagtctgttcttaggcactttgctttactacctcttgacggatcataactgatcaattagtgtgagctgctgttgttatttttattaaggatttacacaatagaattagtgaatagcaacaaggtaggaaccacagtagctctgcagtgaggacagaggagagccctaatatgtagcattttccaatttccatggtgtaaatatcctcatcatgactatgattgatttcaagctatcagcgtgcagtactaactggggatcgggaagagatgtacacgatcagctcttgctagctgatgtgatcctgattatggacaccactgagaggttgttctgtatctgatcaacacggccccacccagctgactgcctttctgctagtgctagctgtccagaggctagagtgacttcccagcctggaggagccaggcgctgggcaaaagactttcacacaacaccagcctgggcagagccaggccagggctctcctgccatcattgtttgattgagctttcaggctgtctctgtgcaattgcaagaggtagcacctgtcccatgaaccagtagggctgggttcgaaagctgacagccatctctaaaatgcagattttaagtggtatcttagttatatcccattttttaatctatataaatataaaatataatttttatataatttaattatagttatatacacaatttaattacagtaataataatgagagtggtaataattaagcaggatttataatgtatgaagcacagtgctaagtaaaatatcataatctcatctaatcctccaatagccctatatgatgcaggcattattattgttatcattattattatctccattttgcagatgaggaaactgaggtacagaagggttaaggaacctacacaaggatcaataataagaggaggagctggtatttcaatacgagagaagatttggaagggcaggcagcacgcattcattgttaacagctgtgtacttgcggggcagtgtgattcgcatgggtggactcacactttttacttcatgcatttgtgtaaagtttattttcacaatggctagtattaactttggctatttcaaaagctagaaatcaaaatattgcttctcaagctgtgtctggattctgaggtctgagctccctcccaccctatcccttttctcaattccagactgagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgcaggagccctgcagagttagtgaacattggaataattagtggatgggaatagaaggacgatatggtgagatccaccctcccattccctcctccatactcaactacctccaaactccaggagaagacactcttctggtgggcatccccagacattgttttccagatgatccagtgaaatggcctagcccagaaaccaaatggtcaaagcagaaacagattagttagagttgaaggaaacactttttcaaagctactgcagtagggagtctggaaaagagactcctcgagcacagtgggattgtggttttactggacaatgatcaggatacaaaaactacggggtggtaggtgggacgaggggcatgtttgctggccaaggcggggtggccatacagcttgtcatttttcaacattcttgtggtttgggggattggccagctctggttagtatatggatgccaaacaaaacattaaaaaaaaaaaaagcataaacataccagctttggtttgcaactggcttgagatttattacaactatctctttttctgtttttttctttttcttttttttctttcttttttttttcttttttctttttttttttaagacagagtcttgctctgtcctccagactggagtgcagtagtgcaatctcagctcactacaacttctgcttcccgggttcaagcgattcttctgcctcagcctcctgagtagctgggatttcaggcgggcagcaccatgcgtggctaatttttgtgtatttttagtaaagacagggtttctccctgttggccaggctggtctcgaactcctgacctcaggggatccaccgcttcagcctcccaaagtgctgggattacaggcatgggccactgtgcccggcctcttttctttttttttagacagggtcttgctctgtcacgaaggctggagtgcagtggtgcaatcatggcttactgcagccttgatctcctgggctccaatgatcctcccacctcagcctcctgtgtagttgagactacaggtgcatgttaccaaggcaggctaagttttgtatttttggtggagacaagattttgccgtgttgcccaagcaggtcttaaactcctaagctcaagaaatccgttcgcttcggcctcacaaaatgctgggattacaggtgtgagtcattgaacctggcctgtctcctttccttaatttctgaaactgcttttagacacagaagttcaattcaaagttcaggagtggaaaagtacagctttcacaaaatgatagcgtaagtcacctgaacttggatctgcctggaggacacagcccatgagccattctttattaccaggattgaaataagtgtaaagaaagtacgagatgatggggaacaatcagaatgaggatactggctggtttcaaacctgactctcagagggaacataaaaccctccagtttgcacagtaagtctcttcatgagtttcagctgcatgtgggtgaaggcagtagttctcagcattggctgcacatggggatcactgggggcgctttaaaaatatggatgccaaacaaaacataaaaaaacaaagctaaactaaaactaaaaactagaaaaggcaaaaattaaaacaaaatacagatgtctatgtcctttctccagataatctaatgtaatagacttgagatgcaacctgggcattgtgacttttaaaagcttcccaagtgatttaagaatgcagctaaggttgagaagctctggatgggatattaaagctatcccagccttttattttaaaagcttcctttaggccaggcacggtggctctcctctgtaatcc

SEQ ID NO: 13962 - DNA, 23381 bp, Human
aaacttaggagccatgcaaaaaacccaggtcagttatcttctgtattagaaatgataagcacaaactgtatgcttgttcaactgctttccaaaataaaacattttttgatagtttgaaattgggtatataaagaatatgcaattgaaataactcaacttttgggtgtttttgtttttgtttgtgagatggaatccctgtcgcccaggctggagtgcagtggtgcaatctcggttctcactgcagtctccgcctcccaggttcaagcgattctcccgcctcagcctcccaagcagcttggactacaggtgcacaccatgacacccagttaatttttgcatttttattagagacagagtttcaccatgttgatcaggctggtctcaaactcctggcctcaagtaatctgcccacctcagcttcccaaagtgctgagattacaggcatgagccaccacactcagccaaaatatgaattttttggatagtcttgaaatttgtatcttatttatctaatcagtttgtttgttaaatttccattttattttgcactggattaaaaacatcattattataaatatttttgcattgctttacaatttacaaagcactttcacatgcattctcttatttaatattcacagcaatcctgtgagttatatagagcaaaattagtatcctcattttatagatgaggaaactgaacctcagaagtgtaaggtcacattctgtgtaacagatggcgcaggaactgtgagttggtggctactgcattcccagtactggagacaaacctagcacatcacaacacccagtaaatatttgttgaatggatagatggaactcaaaagcaggtcttctgattccagaatttcaggtcataggacataaaataaaattcgaatcaactcataataatgttgagtgatgctgataaacaagcctttcctggcaaccaggaataatctacaaatataagaagtcgaaagatgttcagcattgctcatatttaaatacagaccaatcaaaacaaggacatgccatttttacctatcagatttagcaaagataacaaaatgggctattctgggaaccagggaagatgtgggaaaaagacacacactggtgtgccgcatgcaaactcttgccacccacttggagaatgtgttgctgtctttcaatctttcagatgcacgtaaccttttccctaacaagttcacctttaaaaactgttgctaccgactcccatatgtactcaaagatagatgcataagaattttcacatgcacgttatttgcagtaataaacaaccaaaaaccatttaaatgttaatgaatagactaacgatagtgtagaatattgacaggatggaaaactatgcagccattaaaaggaacaaggcaagtcagcgtgttgatatggaacaatctccaagatatattgataattgtaaaaagcaagatgtcaaaaagccaaaggaaaacctatactgacctgtgtttgcctatgcatagactgtctctggttagattcagaagacactattaacaattgttcactggccaaggggattggggcaggagagactttacacggggaacctttggatactgtttcactttataattaaaagataattcgagaagatatatcaaggcctatttcttggaggccagagcgctcctaacccctgagcctgcctcagcctctggctcccacccccgcagccgccccgtcgcctctgagcaggacggggccccactcacccttcccggccgcagacagagcgcgggcgcccgggggagccctgcagcgggcagctccgcagcaggaggccccgcagcagctgcgcgccgggacggagcatgactaggccgaggccgagggcgcaggcgcctgctccgaggccagcgggcagcctgaggccgcggggccggcggggcgggggtcggatcctccccccgggctgggggcgggctcctagacggccgcgcgcccgggaacccggcgcccacagagccgcggcaccatggcacctgctggacgcccgggggccaagaaggtgagtttcgtcccctcgatcctcgcggagctcctggccgctgggctgcgagcgactccgttcacacccggcgtccatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggaggaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaaaggaaatatatcacaaactgatcccaaccatatacaaatatttatatacacactgtaaggaaggacacaataatggtagtagttacacaagatgtggaatattggtttaaaaagcatgttttaggatattttttcaggttataaaagcaaaatgtgagcattgaaagaatacagttaataaaaataatcaaagaacattgtgcttttttctctcaactttctctaatgctatgttcatctttacagttcatatttttaaacgtttttaaaatgccctgtttttgttcagtgtctttggggcctctactgttacaacaccaagattatcacacactaatccatgtgaatgtgtacctgggagttaaggtgttaatgggaaggaactaatctcacctctctcctcagctagcaggtacattttaagaattcatttaattgccacagacaagacctccaattaggtctcaaatccaaaagagcagttctgctggcaaatctaggaaaaggggaaggtattttagacagactgggtttttctgatcacctcctactacatacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagctgactttagatcgtactagtataatggtgaggaacaacagacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaatctaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctataatcccagctacttgcgaggctgaggcaggagaattgcttgaaccctggaggtggaggttgcagtgagctgagatcgcgctactgcactccagcctgggcgacaagagtgaaactctgtctcaaaaaaaaaaagaaagaaaagaaaagaaaaatggcaaatttaaaatggtggacaaacatccagataacaaatgaaaatgtcctccctttacttggtttcataaagacacagtcaaaatatatactacaattttcttaaaacctacctaattgtctgctaaagagtaacattttttcttcttcaggacaaaaattctagcatgtgcaatacatctgacattttcaaaacagtcctgtttatttgctaattcttggcatagtttcttaagtgtctactcattttagttgttatatgtggtggtagggatatagaccaataagatatgtcacctgcccccaagcctcttacagtcaaactgaggtgacaagtaagtaaccagatactgctgtacagggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaatttgattcttttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcctggcctaaatttgattcttaacatggtgaacctaatgaagtgtatgggattttcaggaaaacagtttgtacacagtaactgtacctctgactttctcttctgtattcctgtgtagcatttattggtcacattctgctgtgattatttgttgatttattggccttccccaaagtagccagactttgagcttgtggagggcagagaccttgtcttattctgatgtttatcccacttgcccacaactatacctgacatgtggaaggtctcaataaacgtccaaaatttaagaccttttttatatttcaaaagtacaaattgaaaagagtgaattgcatttgatgcagggaggagaaagaaagagatgagaatcagtaaatattaacatttcttctgcattcagctaaaattcagctttagatataaaatatggaaaaataaccagagttgagagctctctctgccaaaatagtgtttatgtttaacatagttcacacagctgggctccatttgcctgccctccaagtgcacagtaaaaagatgctgtaggtagagtgacctggtatttacctctagttaaaccccttctgatggaccttcttgcactgcagaggaaagaaaactaaccactttgccagactcctttgcagctaggatctggataagaactagcatccccaatcagatgcaccagtatgagtctgggaaggtggaagcatagcaaatgtggccatagtgcagcattccagggtcacgtgaggggcagctgaggtcgctggagcagcctccttctccctatatgacagctgtgtcctgaagccagcagttcaatagtggcttctcttagttgtggcagagggtgcagccccagccggccaattcagtcatgtttttctaggggtcatttctggaagcccagtgtaaattttttatgtacccatttctcaatattaaactcctttctgcttagtcagagtggtttgtacttctgcagctaaactgaacatggggagaaagctagaataagccccctctctagtcatgccattcgatggagattaagagattattcaagccatatttgacctctcatgtttggttccatactgttaacaggactgtcctgggaagctctgtgggaagatcctcacgtctgctttaatttctggttgcttttattagatccaggattgacccagctaaggacaaagactcctgtaaccaagatcaaattagcttccctcttattctttattgcctttatggccttccagcctcctgggaaaagattgaagaaaatagtatatcaagcaatatggccaaaatgtgtttgggatctctttgttccttggtatccaaggaagctcgctcctgacacctgggtgggtcactttgtgtggggagtaagcaaaggagaaatagcagatgccagacactagaacagaagcagtttctctccaaaatctgttccccctccttccgaaggattagcgttggagctggacacatggacattcactgatgatacttcctggcttcccttgcagcaaggtagagccatgtggctaaactctcacgcaggaaatgtaaatgtcaatgagatgagtcacttctaggtctgagctaaaaactttaggatgagctttgccacactgtttcctcatcgtttgagacagagtatgaacgtgactctgatccagtttcccccatgctgaggaggacagtaccctagggctgggttggcaaacgctttctgtaaagggtcagatagtaattatttttagccttgggggccatacagtctcagtggtaactactcaactctgctactgtagtggaaaagtggccattagacaatatgtaaatcaatgggcagggttttacctaagactgtttttacaaaaacaggtgatgtgccagatttggtctgtgggctgtcatgtgctgacccctgccgtagggaatggcaaagcaataagataaaaggactgtgcaatttggtgcacactctgtaaaaaagagtcccccacaaacagtggctttcctcttacagaggaaaaagaaactacttttatttaaagccactgttgtgggggcctcttttttacacagcttagttttaccctacacccaacacgtaggccagtaagctgcctatgtaccctgcttgatgtctcccttggattcaggaactgagggggtttatgttgatttcatagaacagataagactagttaaaagaggcatctgaggcttttctccctgatccattcattgctttgtgtccagctatgggcaggcctgaaatgaactggcctattatcaataaaaggttgcatcttccactgatgcagcctacaaaagagggatcaggattgctgtggggagttgggaggagtgggtggtttgcattgctcagggaaggcatctctgaaaaggtgacacttgaccaaagaccagaaagcagtgaggggatgaccctgcaggcacctggggagatgtgctttagaccaagtgaaatgggaaaagttcccttatgccccttgcagggtgtgtgatggaggcgtggatcacttcttcagcaccccacagcttaaacccctagggggagcatgcaggtaccccatggcagcatctaggggtgaatgtttacagctcctgaagccccagtgggtgtgtgttacagtgtgctctttcagcttagctgtccactggcagcttgtgttaatcagctcaattagaccctccgccttatcgaaaggacagagggctttctgtatcccggggttcttgccagtgtactggaaaaattggatcacacatgggcttggagaatgagtgcaaggttttatcgaatggtggaagtagctctcagcagatggatggggagccagaagggggatggagtgggaaggcggtcttcccctggagtcaggccgctcagcagccagactctcctctgattacccctggctgaattccacttcgtctgtgtcattctgccaccgatggcctgccagagtctgtgtgttcttctgccagtgtgttcctctcaacgtccagctgcttgtgtttgtgtttgctagggtcttgaggtttttataggcacaggatggaggtgtggcgggccagggtggtcttggaaaatgcaacatttgggcgcaaaaacaggagtgcctatcctcaccagggtctgtgggcacaggcctgaggccttcctgtatcaaaaggaaactgcaccccatggctaactgctctgaatggaaccttttaaataagttatgagtgggctaaataggaaggtggtaaaatagaaggaaaagagagtaggaatttagaagctagtctgattttttacttacttagctctgtgatcttgggcaagtcaaccattctgagcctcagtttcctcatctacacctgagaataaaaactgtctgtcctgcctcactggcagagttgctgggagtgccaaatgataagacacgtgtgaacacactgcatgactacaaagcgttgtgtccactaccgttctgttcagtggctgacacgaagaaaaattatttttctcacctaacaagaggtccaggggtaacagcccatggctgccgcagccacccaaggatgtcttaagaaatctgcctcatatggctgtcagatgactgctgtattcccaggcattatgttggcattccagccaggaaggaggaaaatagacaaaagggaagggagtgggcgtctatgtcaggaaagcaaaacttttccagaaatcctccaccagcttccgtatgtgtctcactggccagcactgtgtcacagggctgctcccagaggcaaaggaacctgggaattttttgaaagttaggggcattgtccccccacacaaaaacaggggagagaatgcacactaggtagacaactagctgtgttgtcacaaacatgttgaaaagccaaaataactatcgtggaatcagtgctataatttgactcagattaaatgttatttaagaataaatagtctcagccctttcattgtacaaaataggaacctggatcggccaagaaatatggtatgctcaatctttctgaaatattattagagcacatgattttaacaaaactacagctctaagaacgtaataccacttcacctaaaattagaaaatgcttttaggaaaaaaaaaaaaagtagagcggagcttaggtgctttttttctcttcttcaggggattttggagcgcctggagagtggggaggttgtgattggagatggcagctttctcattactctggagaagagaggctatgtgaaggctgggctctggactccagaggcagtgatagaacacccagatgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacacccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctggggaaaaaaaaaaaaaaaaagagctagaggtaaagaactatgatgggattagatagttacctgaaatgaaaactttaattctcttctaactctttttttgtgtgtttgttctcctaaattaaagtgagaaaataaagccaaagaatgaaatgggtgtaagagaacactagctgagactggaacttttgattcactctgattttatgtatattcacacagcgtatcagataaacctagggtcctgtcttgattcttccactgaccagctgtgtgaccttggacaagtcacttgacctctccaaggatccatatcttaatctgtttcatgggggcacaacatgggctaggtgtgaggactcacaagttaacccgtgtgaagtgcccgtatcatcagtacgatggccgttatgattggtgcatcggacacccagagttctgtggtagagcaggaccaagttttgttcctttggtgcttaacaggatgttttcatctggcccaagaagaacttgttcttaatgttaaaagacctttttgctaaactgggaagaaagtgctggaataacaagagtaaggataagggaggaggggcgaaagtggtgaaggagaggaaggaatgactttcagatagccaggaaaagcttccagactgctttctgatgttcccaaactgcttgctctgactctgatatgggtgccacccacatgcattctgctttctatgagaagctcctcactttactttaagggctgccaatgctgactatagtagaccagctatgtcctttacaacacaggtatagaataaacctctctagaccaagagaccaagggttaattggccagtcaggccttaatctctgcatgtgactgcaccaagtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacgtaactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgatccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaccttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaagtaatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttccctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatggtttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaacgtggaaaaaacgataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctgatgtggtggtgcacgccagtagtcccagctacctggggggctgaggcaggaggattgcttgaatccaggaggtctaggctgcagtgagccaagattgtgccactgcactccagcctgggcaacagagtaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttgtcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcat

SEQ ID NO: 13963 - DNA, 8436 bp, Human
aagggtccagctccacagctccctctccccacattgagtatctgcacaccaatccctaccttattccttccagcccccatgcctctcagattacaggtactgcacccaccccatgccatcgcttaccatccacttcatccaggatgaattcatcagaagtgatatccaactccccaagttgcagtggttcctggagcccaggaccacccgcctggaaagggataagttaatgggagtagggtacggtgaaagacagaaagaaaaaatataattggatatccccagtccttcaagtgagaaggagctgcttttactgggagccacaggtactgctttgaaaaattctaagagtctcacgttgtacccactctcctattttgtgctgatgggtaaggaatacgacaaggagtgagacgatccagtgagacagtggaggtagcccagcatggtggtgggctccttgtagtcccaactacttagaagctgagacgggaagattgtttgaggagatcaggagttcaaggtcaacctgggtaacacagggaaacccgtctaaagaaaacaaaaaaaggtaaaagacaagacagtgcagtggaggccggacgcagtggctcacgcctgtaatcccagcactttgggaggccgaggtgggaagatcacgaggtcaggagatcgagaccatcctggctaacacagtgaaaccccgtctctactaaaaaatacaaaaaattagccgggcgcggtggcgggcgcctgtagtcccagctacttgggaggttgaggcaggagaatggcgtgaacccggaaggtggagcttgcagtgagccaagatcgcgccactgcactccagcctgggcgacagagcaagactccgtctcaaaaaaaaaaaaaaaaaaaaaaaagtgcagtggagatgaccgaatgaggaaagctaggaattgcagaggatagagcagaacttgcacttaaatttaagaccctcagactcctgccatcttgggtgttctatcacacctctggggaaccccaggctttctagaaatgtcaaaacacatagtgtttacctgcatgccaggtgcaatcttacacatattcatctaatcctaacgacgatgtatacaataggttctatcttcctcaccttaaaggtgtgagaaatgatggcacagagaagctggttaacttgcccaagggcacacagcgtgtaagtggcagagatagaactcaggcagtctggcttcagaggccatgttcttaacctttacactatactacttcgtgactctaccccaaaatgtggagtgaagttgaaattttgtgccccagaacatgagtttcagccactagggtcccgctcagggtcgggtctgatcacagggaagggtacggggagccaaacaggtaatatcacgggtagcagccaagttcccacccttgtgcctaaacccagctcaggtctttctgaagctaggagcaccggaactacggaggagaaacagctccgcgctctcaccagcgggccctcttcctcctccatatctgaggtcccagcccgcaacaccagttcccgggccgcagccgccatggtcgcagcggcggccattccccgcagcctcacttccggcaactgtcagtcccggcgagtccgttccccggagtggagctacaagtcccaaagggtcttcctcagcgcgaaatcgttcccagatatttgagttaagttgtttgactccagctgtcccctttcagctctaaccacttcacccaactgcaaatggaaatatggaagtctgaaacacaaactagccccggaaccttcgctgttctcttacctatgaaccttacgaactgtaaagaaaggcgcaccggaagttgtggtacccaagccatactctcataaatccagccaggtcgcgctgaaacagtttccggaagcacttctcctagatcgcaccgcctcttcctcctggaagctatataatgatatcgcgtcacttccgctctctcttccacaggaggcctacacgccgccgcttgtgctgcagccatggtaagactggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaaggtaagtgaagtagggtaaggaatagggaatgtaaatgagaattgggttgtgaagacataagcaaaaatgaagcaaggctggggagacttgagtctcatccagatcaccttgactgctggattaagaaaagaaagtggtttagggagagactgacccctttagcatttaccacagaaaataagtgattaaagccaagatagtggtctaaggtcaagccaaaacatttcacctggggaagtggggaggaggtatggttgctcacccgaattcgctaagattttcctgaaccacgagcttgtgagatttcttctagattcggtttctttacccatcccaccatcataacagcaacccttcctgcgaaatttatattccctgagaattggaggattattgggcatcttgagggataagtagaaataccaacagataaaaagtgtgaagaagcctgtagatggagggtggaagaagtctgagtgggacatttactcagatgagccataattgacactcctttcctgtcgaagtgtgaaggagtacatccatctttctttggcttttaagaatcgaatcaatgaatgcaagaatattatttcacttgagtatttctctccacaaacctaatgaattcttggctttctagatacataacgttctttttttttcccttaagtcagaatgtgtagttagttgtggaaatagcctaccagtatgtgtccatgcgtgcagggctaggcctgtcttcttggcttctgttgcatggtaggtacttaggcgacgttagggaatggatagtagtagggatactgttggctctgttgaggaatttgtagagggaaattccttctgttgggtgctctgtgaaactaataaggcagtgtgaaatactgtacttatttcagagaccggctgtgaggcttaagtagaggtgcagcattcataagtgtaatagagaataaccttcatggatgtatctaactaaaaattagaaatcttatttcatctatatctcttcccacacccattttgaagtaaatcttttcacttgtaaacatataattaaatttgaggcttagtgcagtggctcactcggaggctgaagtgggcggatcccctgaggtcaggagttcgagaccagcctggtcaacatggtgaaacctcgtcatttaattaataaataaatttgaaagaccctgctctcttctgaatcaacctaataatttgacccttggtcatgtttatttatttatcccgagacagagtctcaccccgtcacccaggccggagtgcaatggtgcaatcttatctcactgcaacctcagcctcccaagtagctgagattacaggcacacgcccagctaatttttgtatttttagaagagatggggtttcaccatgttggtcaaactggtcttaaacttctgacctcaggtgatccacccacctcagcctcccaaagtgctgggattataggcgtgagccactgcacccagccacatttattttttgagactgtcgcccaggctggagtggcggaatcactcttcactgcagcctcgacctccagggctcaagtcaatcctcctacctcaactttccaagtagttggggctacaggtgtgcaccaccacatctggctaatctggatcttgctgtgttgtccaggctggtcttgaactcctgggctcagtgatcctccagcctcagcctcctaaagtgctgggattacaggcatataggcatgagccacggtgaagccaacccttgatctctttcttgcagataggaactgccatttgttttagtttcctggagcctactgtaacaagttcatataaactaagcagaaaattactcttggcgctggaggcacttaagaatcctaccttgcctcttcctgtcttctggtggttgtcagtaatccttagtgttccttggcttgtagctgcattactccaatctgttgctgtcatctcatggtcctcttcgtgtctctctcatgatttgtcattggatctagagcccaccctaatcaaatataacgtcattttacctaattatttccgtaacgaccttatttccaaatagggccacattctgatgttctagttggacaaaatgaggggcagggctcagtattcagttcctccttcactctccaaatcactttggttcatgagttcagatggcatgggtgctagtgctggtgttgatgtgatgctaccaatgtaagcattagtttctttttataataacttgggcagtcagttctgggcactgacaaaattgagtttgtgatcttggaatactttgattatggggatacagtgatttgcctaaataattgtgacccttagagattctgaggaactgacagcccaataccttaatcaaagcctgtaactcataagaccctggtttactgcatcagcttggagtggcaggccccttgttctcctaaatgcaagaatcagaaggcacttagtgacaactacatatgctgagcaatgggggaaaaaaaagatactgcctgctttcaaagggttgtctgtaatactaaattctgtgttcatgattcagtcatacccctgaacaaagttacttttttctttttttgagacggggtctcactgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggcttcctgtcctttctgtccattctaatagggaatgttaaagtgctgggtcctttttccatttagagctgccctactcagttgcccacacagtgctattagttttagcagtggtgatgctgcagaccccccagtctccctatatgtagctagtgatgtccctctctgtaaagagaaatgtgagggtaaaacagttcagccttgaggggctgacccagaccagtttagagaccaacaccctggggttggtgtgcagcatcattgtggagtgggttagctgagcctagccagttgcagttaaggtgagtttgcaggtcttggtcactctgggtttttttgtttttgtttttgttttcttttaaggggtcatctagtcataagggaaaatccttcgggctgtgaccgaagcaacaaaggcaaaaacgcggacgttggttatgaagggtgtggtctccctggtggagtacgtcggtgggttgggatggggagcggctggacagaccggtctcactccgtttggtgccactccacccgcccgggtttccgcgccctgccgcgctgctccgacgccgcttccggcggggatgggagcgcgcaacgcggaagcgggcggcagaccggccgccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttcca

SEQ ID NO: 13964 - DNA, 46745 bp, Human
  misc_feature (1)...(46745): n = A,T,C or G
ttttaattgaaatgaaatgcatataacatatatcagacattttaaagtacataattcacggcatttagacattcacaatgttgtgcaactgccacctctatctagtttcaaaacattttcatcaacccaaaagaaaatcagtatccacttggcagtcgatccacacaacctcttccctccagcccctggaaaccattactttgctttttctctatctatggatttacctattctggataatttgtataaatggaatcatataatatgtggcctttggtgtttggtttctcttacaaataacatgttcttgcggtttatgcaagttgtggcatacatctgtacatcattcctttttattgctgaacaacattccattgtacagatatggagataccacattttgtctatccatgtatccactgatggacacctggctgagttacttctaccttttgactgtcgctaatagtgctgccatgaagatttggattcaaggatttaagtccctgatccaattcttttgagtatataactaggatggagttgctgggtcttatgatcattctatgtttaactttttgaggagccatgccttttgaaatatttttaaaatttgaaattctgcaaagaaaagccagaaggaaactgaaaacaaaatgcaaacctcaatgaaatcaaaggagataaccagtctcatctcatttgaataagttcaaatctgggcagaagaaatccaaacagtacacttctatgtttttgaaaggctaagagaaaagatatgtaattctaccaaataactaagaaggggttgctgtatctccaggatatttttaacaaaaaaatcacacctaagccagggctccagtaggagccatgtgactggctataagacttttcaaccaaagaaaacagtcaagaggacaagcacaggccattaacaggggcggccttctgtgatcagagaaggctgaattcccgccctggttctcatttttagtaagaccactcttctctttggaaagatacaagtctctaatgtcaaaaaatgacagcactcttttaaaaaccatcttgtgtcccaacccttaaaagactatttctaattagttctaaactgtcagcactacttaagaatggcttgctggaaatttagcctgggaccaagggaaagatacgaaagcatcagaaccaacccagggtgcacatatgcccttgtcctgcatctggtgtttcagcatttttatgaggcctagtcagtaatgatcttaaccaggaggacagtggcaagatgggaatgcagagggactgtaacaaaggaggatgcacgagtgcctttaaattacatgaaaaaaagaaaagttatctgaagaacacagaaagtgaactacaaatgacaagactgagtctttgcatacaagcaagacactgacatgacaggaatggctggcaaatcaggtaataggcaagtgacttggcagcattcactgggcaggtgttcaattaggcaggaagtgggctgaaaacaactcaattaattcattgtgcatgcctgtccaagagaacaagataaacctaaaacatcaatggcagaccagagattaactccacagctccatcttttgcaaaagtaggggctaacaaagatgcatgtgcaaaatataaaactacaccaagatgagctctggtgagctctttaaaagttcgaactaaaaccaaggcaaagaaggaaacaaagcaagaaggtggcttattatggatccagaaaagccattcctttctcatgagtggctctcaatggccagcctcagatataggcagtcctcagtacttgggttgagaagtgtgacaggtgcaaacacaaacatatttaaaaagtcaacagcaaagtgatgggctcacccttacttgtaatatcccctatgtgtgaggctctcccaagctaagacttaactccaatgccagacctatagtctgaatacactagaaaaaaatataaaaccatgaggagtcatttggcagagccagaaaaagaaagctacactacgaacataaaatcaagcaaagaaaagcaaaggttagcagggccaacatctggcagagccactataggtccttactggaaaaggggactcaaacccttgcagcccggatggcatcgctcaggcctgatgagaaacaaagcatgctgcaggtggggcagaacgtttgtactagaggcatctggacaactcccttgttttagagaaaagaatcctgaagtttaggagttcagcaacatacccagggcaactgttagcaacagcacagccaggtgtataattctgggctcctggaaagaccttccactaataatactgatgatgataatgatgacggtaacaactcttattcgctgaagagtttaggagcagacattgcattgagggttttacatgttaccccgtttaatcctctcaacaacttacaaggtagcaattctcttattaacccactttacacacagggtgcagagaggttaaggcaccaaagtcaaacaccttgttggaagcacaggcaggacaggaacctaaatccagctaaaagtttctgctcttgaccattatacttaactatccctaaactatattgcttccaaacaaggcagaaaaggctattttcaactaaagtataaaccagcaagttttgaccattagataatttttcacatatactaccttttcctatcaagatacaaagacaatcaacacttcgggatataaagaacaaaattattttgactttaaggagaaagaaggctcaagactctccagcctggaaaagagaactgaacagagacccagacttgcaaattaggggctaaagccaaaaccaagtctctttgggatttctgtccagtgcctttcaccttcagcatgtcacgtattttcaaggacttcgttctaagtgcacagtggtgctgctaggctcagtgagtgatttcagaaatcagtatttaccaaatcttggagtttccactaaaattatcactgtgtcgacacaaaaccaccagtttaagcctatacattgctatattcagttttaggaaactgttgtttttgatgaaaatacaaagcacctggctttcctaagaaatgtcatttatattctcagattccacatgcagccatatctctggaagatgctgttttctctaactggcaaaaccaggacatctctttgtatgcacacacctgctctgttgcaacattcacttcctttcactgccacagccaaaccacagattagagctacaagtttagatcaagatcaataaccatcacagatctgcaactctagaaggggctcctgcagtgggcctggctccagctggtgccctgggacccaacatgagtcacttaatctctcttaatcataaaacgaagggcagcagataatgcttactaactgcttatcagatgccaggcactgtgctaaagccactaaactcgagctaactcatctaactgtcacaatacctgaggtaggtaccctcatcataccctgcctaaagatggacaaagtcaggcttaaaaaagttacccaaagtcacacaaccatgacactgcacaaacagaattcaaacacaggtttctcagactttagaccccaagctcttaactatcacactcggtgtctttctgctttcctcattcataaagcaagggtaagaatacctgtcatttccttgcagagacagtattctgcaaattgtccttaacatcattctgactattcttccagtctgaggggtgaactgttacaaattctcccagacagaccaaccaatcagctaagtactcagtactggactaaggatgaagggaacataaaagagagaacatccctgccgccaaggacttcgcaatctagccaataccaatcgaagctataatctctctcagatattttgatcattgatccacagtcagaagtgtatttctattatggcctgggagggatgcacctacacacagccttactgtgtgtcacacattgttatttttcactgttctatttcatttaaaaatgtatcaacccactaaatcaattctctgactgtggattgtgattaacagtttgaaaagccccaactctagcccctttttggcacaaactttaaaacaaaacaaaaaaatgtcaggaagttcttcctcagactagtttaagtttcttgggctatcgggttaattggatttgtatcgctgaatatgtcctcagtggcagatgcaccagcatatccgatctgtgaagggtataaaaagtggactcctgcaggcccacattcaaatgctgactctctggcatgttagctatgtgacttctccagatcttggtctataaaacagaagataattccactcacccctctggcttgttacaagggacctacctggtactggttctgtctttctcagcagaggggctgtgggcatgggaggaagggagacaagtctggtcatgtggcacgaccagtttacgcaacacaagacctgtggtagccaattccacccctcggcctgctaccatgttaagtgattcgaaatccttcaaatcttttatgcaggcatccattgtattccacatggaagtacaataaataagatgcctaagatataacagggcataggccaagtctccgccattgtagagcttgctgttaatctaggcaggtggccaggtaaacaggtaactgtaactgaccgcaccaggtggtataacataagtctgggagtctgatgagagagtgtctgatgagagagtgtctcatgcagggaagtctagtccttgatcccatttgcaattcccttagtgtcaaaaaccacaccttgcaaacttctaatttataacacataaagacttaaaaaccactaccaccacactgaggacaagaatccttgtctgtagccacagcaataagagggctatcaactccagttctatctcccctacgagatgctaagttccttgagacctgaagtaagagaattgctcaagatcacacagcaaatacacaaaattggaaaccccaaagatcaaaaattgcaggtcactttgctggttcctctggaatttcccctatacttgtctaggctcaaacataaaaactaatgtggaaaggagagagaggagaagggaaaaaaggtctgtcactaggtgaccaaaaatgtaagagctggccaagcacggtggctcatgcctgtaatcccagcactttgggagggccgaggtaggaggattgcctgtcccagctactcaggagaatttcctgagctcaggagatgagctgtgatcacgccactgcactccagcctgggttacagagtgagaccctgtctcaaaaaaaacaaaaagacttacccactagacgctgattaggtctttgaagaggtgagaccacgccgggcatagtggctcacgcctgtaatcccagcactctgggaggccaaggcaggtggattgcttgagctcaggagttcaagaccagcctgggtaacatggcaaaaccctatctctaccaagaatataaaaaattagctggacatggtggcacatgcctgtagtcccagctattccggaggcagagacaggagaatcgcctgagcctgggaggcagaggttgcagtgagctgagatcatgccaccgcactctagcctgggcaacagagcaagaccccgcaagaaatgagaccagaaaacctcaaatttagttttttaagtcttttcaagataattatacaatcagtgaaagtgtgtgtgctaaaagtgctgacacgtccaatatgtaaatttaaaataccccgctttctaaaatcgtgttttggcatttcctcatttttaaaaatactgggcatttctgagaggctgtgtggttaacatggacttccttagttttggtttccagtaaatgaagcatatatcagcaccccattccaaaaccaaaagaatgagaaaaccttggaaagattctagctgaaacagggtttttaagcttcatcctctccttcttgttttgggggaggaagtgtgcagggaagatcagttactaatgcccttcaggggaggggagtttctcaggcctcaacctctgtagctgagatctgtattttcttcaagccatcctggttgaaaaataaaaacaagcgattacaacacattgagcctgggtgatctcacatacactatctcatatatatcttaccacagcctcttttagattgtactatcatcaccaatttataggacacagactcagaaaggttcagtaaccagctcaggctcacaaagccaggaaacggccgggagggaacctaggatgggaccacacattcctgagggagaagagaaccctactgtgtacacgatccccagggcatttgaagagggcattctttcactttcggaatacaagctgattttaaacaggcatcttctcggttgtgttttatgaaacttacaggggaagctatggtatagaagtatgctacctaagagtgacttcccttaagaatccccatctgtaaaatggagatgatgacgaccactccctgggagcactggacaagactttctgggcaaagtcctgaaaactctgacactccacaaacacaaatgacctggagcagcagcattactgccaggcccctggaagtagcttatggggacaaactgaagagaaaggcaaaacacacactccccgctacaaaagtgcttagtcctccaaaatgcagggaaggcacggagtactgatgatgaggaatggtgggtcaacagccagtgcacacagaggaggtggtgcatccaatgcgttccccacctatgttaactcacagatctcgcctgctcactgcactcatccaaggtcttgggcaaggacccacagaaaaatagtgaaacaggaaaaaaatccaacaaagggtataaactcagaattctgtgatccagtcacaccagagtgacatcataaaacataactccagttccacaaagacagatgcttccctgggctgggcggcccacatccccaacacccacagctggcctctactcagaggaaggttgcactcaacccacaatgggccaaggagccactactgtactgccactcccagctgtggtcagaataccctctcccagggctcctgctgccacttccagctgtggccagaacacctcccagggctcctgagaccactgtgctatgcagcaaaaggccacactctgatcagaagatcttacgtttgaatctcaagcactgctacttacacactgggtctgtcagcaaattactgccccactgattctcaggtcttttcctctgtaaaatggagaaaataataaccactttctgagcttgttgtgaggattaaatgagataatctgcataaaaggcaaggcacacagcaactgaagctattatccaacttgaagcagaggccagctaatattgggtaaaaattaaatttgattccttgaaagaaaaaagttccatagagttagtgaggatcagcaattttcagaaaatttaaggaagtgaggtggaaaaattccactccccccattcctaaagggttttgaagcccacccactcctggctctcctgcaggaatagagaactgcagtgtctccagactcttcccactttataaatacaccctacgaccaaccagagagtgcttgctgccaaactcctgggcaaacgtgaccaacaggattggacccggaaattagatgtccaagcagcccagtcatactcaattcaaaatagatatctgtgacctacttagtcttcgagtaccattctcaaagccaaaaaacaagacagggccactgacttcagcagagccctgcatgggcccctgctttcctgtcagatgaaacgtgcactgcaacagtgatgactcaagaaattatctcaggatagctggacagaaaccccagcttggaaagagctgattcaaacagttgtgaaaaagcaaaaagtcacagaagtcctgccaacagtttatcctctctgactatccccaataatccatcttcatccacttggactgagggttacacctctcatgacagggacttctcaagctgtctatccctaacactcatattggtttgagtatacatatcttcccataaaacaagggattctgcctactgtaccttgatgttctacaaagcatcaagcacagaaagggtccaatgaagagcaagcaccacccaagggggaccccctcccctccccaggggcagaccaccaggttccagcccactcacacgcttggctgctcaagattagagaacagaaacagacaaatatttgctaaaaaaaaaaaaaaaattaggaagacaaacaagaccagggaaagttgctgtgtactttcaaccaccgcagttacagaatgatctcctaaattacaactcatttcaccaaagagatgagagttttggggagagtgaatccaaggaatttggcagggacaagttccagtgaaatcctagagcattcagcactaggcagtacaacaccaggtagacagtggaacattatacttcaccagtgaagcgatggtagaggaaacaagctgctgccaaaaacaaaaatgaaataaagcaaacctgctgctcttcacatccgcatccatcctcctcacatctccaaggtcagccccactgttctcacgcaccattgtacactcaaaattctcatcagagaaacttccttgagagccctgtggtttcctcagcactttttccctacatcatgacatttaatcatcaccaccatcctgggaggcaggtggaacaggcatttttatcactccctgagaaatgaggaaatggaagcctaagtatgtctaccacacggcacaatcaggactaaagtacagactaattcccaagttcaatgtgtgttctccaaaataacccagacctgacaaggccacatatctgagctctaggccattgccctttccactgcactgctgaggaccttctagagacagaattccgacacacaaccctctcagtacagcagcccactcttcaaccttctcaagacacaacagagctcacaaaccaaccttggcaaccgctgacaggcagcacctgcgtcagccacacaccctaaatcgggctgaccaccacctcactggcaaacacaatccaacccctagagtttcaaaaaagagacatacactagcaaatggctttctactgtcaaatggtgggcagaggcagaagagtgatcatggactccaactgttatataccacagatcccaggaacctgggacctttctgagtatgtcagttctgggttcaaatcctgcctctgaagctgactagctctgtgactttgggcaggtagctttgtttctgtaagtctcagcgtcctcatttatcacataaggggttccaaaaaaaaatctctcaggggatgtggttaaggccacaaaactatacacttaaaaatagttgaaaaggcaatttttttccttgagacatggtctcactgtcacccaggctggagtgcagggacatgatcacagctcactgcaacttcagcttcttgggctcaagcgaccttcccaactcagcctcttaagtagctgggactacaggcacacaccaccacgcataactaattttttaaaaatttttttgtagagatggggtctcactatattgtccaggctggtctccaactcctaggctcaagtgatcctcctgcctcagtctcccaaagggctgggattataggcatgagacaccacaaccagcctaaaaaagcaatttttacgtatatttcaccacaataacaaaaattaggttaatatttgtttgcttttaagaaacaggatgggttttgctatgtagccctcaaactcctgggttcaggtgatcttcccaactcagcctcctgagtagctgggcctataggtacaagtcaccacacccagtatattttgtttttttaaaataggaatgtcataggttcacagtgagaattaaataagatactgtaatggcaagttcttacattgtctggcacatactaaatcctaataaataataattaattatcattaataattttaatagttataaagacagtacatgctcattgtaaaaaaaatgcttaaaaagccctcctataatatgaaaatccagagatgaccactaaaataaagtactttatggtctttttcctacacatagatatttcttaacaaatttggaatgtaattgatataaaattttgtagttatgatccattcttttctgccttacttataaatacaaaaacttctcacaacatcatccagaaataaaaagcctttgttcaaggaaaggataaaaagttgtgtgaaacttgagaaaagaacaaggagatcaggttgagcaactggagacaaccgcctccagagccagaatggagatttagccaaatcctccaccacctgctcgtctctgcctccaagttggcccagaaagcaagaactctgggggtctggccagacaggccatcagggagcaccagggctgaagcatgttgagttctggggaagccctgtatttatcaggctggctgggataaaaagttcatgttccctgtgcctaaaccggctctaccttccaggagctcgcactgtgaccagggagacaggtgcaaggggctgcccagagtgggtggagaggtgaagggagacccccatgccaatcatttcatccaaccctctaggttaaagatgagagaactgaggcccagggaggcaagtaacttatcgaaggcagcagtgatgaaatcagaacttaatgttccagtaccaatctggataccagaagaccaacttctcagggttctaagtgaaatcacagcatgccgcctactcagagcccagcaaagatgccagggcccacatccaatacatcctgtccatcaacaagtacgtatttactagatgttgggggcatgtcagcagagacaaaagccacccctgggcataggacaaggaggctgtcttatgggaggggaacacgtggagccctgtctggctcccactcgtgggcaaggcctttctgttctaactataacaaggaagcaaagcctgcctccacagattctgaaggaacactacctgagtcaaaacttcctgtagcactctggcagagaaaggctgtgcaatttaaaaggcagttcctctaaggaagctcttttgatgtgctaaggaaagaacaccctaaaaataacttctggaattacacactcacaaaacacatttgtaacactcacttttctagctaggaatcatcttcacaactttcattttggatgggtgtgttttgtttgggaggaaggaggggccccaaaggcaactcctgaaacactacggaagagcagctgctcctggcactggagaattctattttcatctccacttacacataattatcttctaaagcgatgctccccagaggggtcacaatgacatcggcctcccagataacctccccaagcaggctgcttctggcactatcttggtaagtggaggcaggagagtctgaaatcaggcccccgcacagcccagagagagtctgaaatcaggcccccatatagcccacttcccccgagccctcattacacaagggccaggccccttcctttggaggcaaaaaggaaattaaatgtcaaccaaataaggatatttccctttaactccaaggccaaggaatctgaagtagtgattcccccagtaactgggcaaactgaaccgacgacacaggccacagaccagcaggccaggcccgctgagggccagcctccgcctggagttccttcttctttttaatgaccaatactcagattgcaggctgaagtgtttttatgacaaataagaacaacaatgtgtgaacactttgtaggccagtaacaaggctggcagcagagggccctgggcccacgtaccaagaccacacagccatctactcactgtctccaaaggtcctcttggatgttcctccctgtcccacattttcaaggccaaatgtggcctgctgaccaggagagctgactcaactcttttcacagcatagtgattttatacacagaagaatcctggaagcccagaagaatccacatagcttgcacactgaccttggcattttctaaatctacccaggttaaagaccacctgaatggcaggcatggcgttcaccaggcaggcccaaggctgaaggggtcgtggggggaagagcccaccagttcacacgtgtgaggccctgcagctcacagcagggcagctaagcacacagtttcctagcaattcctgccaccacagccttgtctgtttgctctctcttcttcgtgtttgtggtttatgtgtgggtgggtgggtaggtgaaaagcatacagaaaggaaagggtggtggatcaagggtcagtacagcactaacattttttaaaaacctgcctagaaacagctgctgcaaaatatctaggcacacacacagctcagctacatccatctgaacttagaaaagtcctcaatgagctggcccacactacctgctttcattcatgctcacaggcacaacagtggctcccatcttactagaacaaaggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacattcctggaggcttttccagaagcaacagtgcctgattttccagcacgcaatctttaagtgtcttcccagtgcccctccccagtctccaatccacgcctcagcagcacaggacagactgatcttaatacttacggacccttgattcctcagatgaaaggtttggagaaatactctggcaagttacaccaaaattaaaatgtcctattaccataactagcatccgggagaaacagagaatgtgaaatcaggagctcttgcttccaggtaccacaatgccaccactggtggcatgacgcttacaccaccctgagctgagccatggtccttgagggtttggttccctcatcttctatagttgctatggacccaccactcttaacatctacgatctcagcaataagaatcaagaagccaaataaccagttctcactgctaggggcttaagcagagggagtcgagccagagtcgccgcgatggtgttgttggagagcgagcagctcctgacggagctgaccagacttttccagaagtgctggacatcaggcagcatcatatcaccttgaagaagtatgacagtcgaaccaaatccattccaaagaaaggtactgtggagggctttgagcctgcagacaacaagtgtctgttaagagctaccgatgggaaaaagaagatcagcacagtggtgagctccgaggaagtgaataagtttcagatggcttattcaaacctcctgagagctaacatggatgggctgaagaagagagacaaaaagaacaaaactaagaagaccaaagcagcagcagcagcagcaacagcagcacagtaaaggacatacatttcctgctttcaccaattaaccactgaattgctattttttccttttggccacatagctaggtttctggttcccccacagtaggtgttttcacataagattagggtctttttggaaagaatagttgcagtgtttataggatagttgtggtaagaatctagtttattttgcatttggctaattggtctgtgctgcatggttatatactcctggattatagataaaaagtctccgtagacatctctgtgaagagcaagctatcattaaacatgtctgtttatcaagaaaaaaaaaagaagccaaatgatgaggtttgcaacctcaccaataataaatgaaatgcctactgaccaatgatccatttctttcacccaggggaatggcagcccattaccactgacaacaggaactagcacatctcttgagagcatagtatgggtactgctgcaacattttaaatgaatttaacatttgatatgccaattctactcctagagaaacatgtgcatactaatatgtatgaatgaagatataatagcaaaactaatgagttagtttatatgtctaccagtaggggaccaattcataaattatgacataactacactggaaaatattttgtaggcaaataaaagacaaattaaaagaacagagaagagctacatgcatgaaaagctctcgaaaatatactatgtgaaaaaagcagtatgatgcaatcagattcatgcttctaaaagaaggaaaaccatagtgtatttgtgtatacaggcttgacagtttcaggacacggatccaactgctaacaccagttatctctgaggacctggaggagctggcacctggggaggggtgctgggtgaaggggaatgtgacaagtctgctgtgtccttctgcactatttaaatgcaagggcaggctgcaggagaatacatttacatattacctatatgatttcagaaaaaaagcacctaaactgattaaaaaaccaccaccaccaaaacaagctacttatgctgatgtgaaattgctgcaccaatttgaacaggtttctatgctgcacttccaggtcttcccaagactgacaaagttcaagccaatttctgcagtactgatgacagactgaattgggactaacaaggaagaaggaaaatgtgggatgcaaggaaaacatctgtaaaagctctgtggaagctgcaaaccagtcctaccctgaacctgctcatcaccaaaactcactagttctggggccttcctccctctcatccctataggatgagaaataagccaaaaccggaatcaagagagaattccctttcccacggcagagggaggcctccactgtcaccagcagagctgctcccaggcaaagccaaagaaacggcctggccaaactccaccttcctgacaaaggcaccatgtgccaggctcctgggattgcagggacagccaagactggcagccctgaagcccacgcatttgagtccctccacttcggcaaacagcccaggaatcttttcacactcactactgaaatccaaactgaaccagtatacaaatcagatggtcctgccaacaaaacaggaacaaaatggaaaaaagggtgataaatcaatgatatcctggctaaatatatacttcttctttctgcttgcaggggcactgctatagatttaaacctttgataaatatcttttttgcttcccagtaataattaaagcaaacacacccaaacacgcacctaaacacgaagcaaaaagaacgagaaaagggctttgctcaggacataatgttcaagaggtaggcatgacagctcatatccacaggcagaaatgctcttctcccattaaaacatgtacctgtctggcacgggttcttaccccacaaaagaaacaactggacactctaggggactgccgagaagtgccctcagaacaagaagaggttccctctttgagggaaaagtgtaaacatcaagcagaaagtgggtgagcagactcttgcacggagtgactcaccggcagagacagcttgttgctggagatgctgggagcaggcaggtccaacagaggtaacctggcttcctcctcgcagcgagaacacagcccaaataaagccagaatctgaccacctgacctccggcctgaccagagccagcacaaactctcagaagggcagggatgttgcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatggcttctaatgaatcacccctactgagttgtccttctgtagctccctcccacgttgaccctggagttggccttgtgacttcctttagctactgggacatgaacaaatatgacacaagcaggggctttcgatgtgcacttgtgccttgctccttgctttcttgaaatgctatcctgagactgccatgaagaaacctggtccaactccttgaagaggaaagaccctgagaagagaaagccttgctgtcccagctatgcagcccaccagctctcagccacatgagtgagctccagggaaagccagccaaaaatagtccagccaacccaggaattgtgagaaataaaatggtggttgtttcaaatcactaagtgttagggtggtttgttatacagtaatagataactgacacacagatcactcacaggcactcctgcagttacaagttctagatgaaattcacccaagaatcagtactcttgctagcgttttctgttatgaagcattcagttgaagtcactaaatctaagcttagcagagcatcacacttcatgtaaataccctctttgaaagttcttcattgaattggttactgagcctagtactgtttaaaatcctttggcagtcaacataacaatgggctggcaaaatcagcttgtaagctaccaaaagctttaaacgttagaactccctggaacatcaacagcaggtatcatagaggttaggtgtgtttatctctcccacttgattgtaagctccttaatgacaattacatttattggcatggttttatcatagatcacgaaacatcagagatggagttagagatcatctaacccaccacctcattttacagatgagaaaactggggctaagagaaatcatcagagccttacaaatatccaaggtcctggagctggctcagagcagaactgggatgaccaattcacagttctttacgctgttagttgaactcttctgtttttcctttgtgacatttttgctatttaaaatattcttcccatgctcaaaatatgtctgtaactttcctatgtgctggtgataaaatctaaacgattatacatggccccatgaggtctggtgcagcttgcccctacagagatattggtactgttctgcccctcactcagcacactttgcccaactggctttctttctgttccccaaaccagcaagctcttctctacttcacagaaagccccttccacatgctgttccttccactgacgtgctctttcccaaactcttcactttgctaaatcccgctttccagaacccattagagttctgtggtacattatttgggaaataatgtaaacaaaaaaatttggtggacatagaggtagctctcagtctcttcagccaagttttggaaagctcaaagaccaaacagctcaggaatcttatggagatttgattcctaacagacaccttgttgaggctcaaccagtggaacaagccactctggtttttctgtttttgcatcactccactcaagattccaaaccctagaagaacgtcagccttggttagcttggccacatgcctaccctcagccagagaagaacaggacaccttgaatgaaagcctccaaacataatcatcagggcattgttaccaaagaagggaaagttgatcaaggataacaaaaccagtgaatgtccactacataatctctcgggccttgccttaaatgtcgtcttctcagagaagcttttcttaaccaccccatctgttgcacgctttcatgacactccttgtttttttcactgttctcatcatatttttatagttacatattctcatgtgtttgtgtctctcgaattctccctccacgagaaaagggactgcgtttgcttgcccactactataccttcaatacctagcatggagcctggtgcatacaggaactcaataaatatgtattaaatcaatcaataaatgagcaaacaaatgaatgaataatataagccttgtgagtcttctgacttaatccatgtgatattaactttgtaggaagaaggagaaaagacaaagagaatataatgagtgtaggctgtggaagattctctctgctgggtccctttgtgatgctgtggggaggacaaagactcgtgtgcaggataaatgaagaaacacaaccttgtgcatcagagataagccatgtgttgtgctatgctgtactgtccttgagggataaattatgcaagtaatgaagtaagagggggaggcctagaatggtggtctgcatgtctcaaaatgtttgcagaagtaggaaccctcaaaactgctgcctgactgcagctgccaggagctgaggtcaggaatgtatgttcataaacctactcccttggcccctgttcatgcctggctgtgcattctctgtagcagaagttccagagttatctgccgatggctgcaaatccacagacaggtttttcacaactcagaggtaaaatgagagtaatcagagcaatgtaaagctaaatgtatgcaattcttgtatcaatgattattatatttgtaatcatttggatgtgggttttttgttttggtcattttttggcaaaataaaaagttgacagcctcagtttccattcccactcccaaaatgtttttgtaatggttttggtctatgaaatctgaaagcctcagaaattctcactttataatctcagagacctggacaatccctgcaaaggcttcagacccatcagaaaatcaactgttgttgttttgttgtttctcatgttttaatcatgtagcctgtttccttttctgcctcatacctacttggcagtcatttaactccagtggttaaaacatggggttaaggggacttcactgccagaatcacatctgtggctgtgggtcaggagggagctgggccttggttctgtcctgtccacaaggaagacctggacttgaggtctggttgttaccagtggagggtccaggttcttggcatttcgaacatttgaacaaagaactggagaaaacacacaaacaaagcaaggaaagagtgaagcaacaaaagcagaaatttattgaaaatgaaactctacagggtgggaacagcctcaagcaggtggctcaagggccctgggtacagaattttctggggcttaaataccctctagaggtttcccactggttacttggtgtataccctgcataaataaagaggctgaagtgaagttgcaaagttatttatttggtgtacactctatgcgtatgaagaggttatttcctgtcatagctgaagtagagttacagagttatttacttggtcgtagaaagttggggtttttccgtttgatttgcttctaggaagtccttagttttcctgccctgagactctattcccctgccttatggtcagtggccatgagtgtgtgtgtacactcacatgcatgtgtgtgtacttatggcagggagagtccttgggtgtccccaacactcttccaccgtaggggagctacttaaccctaagaggagatattgttcttaatccctgttttacaaagaaggaaaataagacttagaacgtttaagcaattcaccccaagcctggttaaatacaaagttcaaatacttaattaaccttaacctctttggtcatagttcaggtgcttgattggtgttacctgaagttaaatctgatatgaattcccagaagccaacattatggaaagacttttctagaactaggaaagaggtaaaaaaaatttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttatttatttttttttttttttatgttgagacaaggtctcactatgttgcccaggctggtcttgaactcctgggctcaagtgatccttccacctcagcctcccgaagtgctgtgattacagacacaaaccatcatgtttggccaagaggtaaaacttaccctccctaagttaagagggaaaactaccagcttcttggatttaagaagccgtagagcttgaagtcctgtacatttatgtaagtatcaagtgttataataaaaatgtctttttctcactggtagtaattcttttaaagacttcaaacaaaattatacctattcttggaaattaagtaagcatgcccattttcataaagctgtgaaatcccatataaggaaaagttttaagatctctgctttcgtttgaaaaaagcaccagagcgctactgaaaagttcaacccaaatcttcatgcttactgccctgttttctgaaatttaagtctctagctaaagaatgggaaggaattcctactctacccctgctgccggcaaccaaagcatgctctcaagccaagaacaccagtgaaccctttaaatttctccacaactttctccctgctggcaaatgtcaagtttctatttcaaaagaaataagagcgtcattaacatgcctgtcttcatgctcttctaactcctttcagaattttggggggttttgcttgagaaagtaagaccacactaaaatcacaactccccagggtgtatcattaaaggtggaactcggccaggcatggtgcctcatgcctgtaatcccaacaatttgggagactgaggtaggaggaccgcttgagctcaggagttcgagatcagcctgggcaacatggtgaaaccgcatctctacaaaaaattttaaaaaattaaaaaataaaaatagccaggcgtggtggcacaccctggtagtacccagctacttggggggctgaggcaggaggagcacttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagaacgtttctagtctatacttaactcttcaatcacttcacatgtatttacggaacacctagtacatgcaggcaatttatcgagttgtgtgaatataaaagcaaaaaagacatatactcctttccttccctagagaaactcacagatcagtggagagaaaaaatgtatataattacaaattttacaaatgatgttaagcgtgctgaagagaaagaacaaggttctatgagaaagttttataaagagaacaagttttatattgaaaggtcagagaagacctttctggaagtgatctgaaagtttgaccaaagagatgaacaggtattggcccagtgaggaacctcctggggacgtggtcctcctcacccaaggcttctctatgtctcggacaatgatcaggacaagaagtgcaacttctcggtgcatcattgctttcagagaggagtcttggggccctgtctccccagaggtgcagaggcaagacagggagtccccagcttcttccacaggggcttccttctctatccaacccacactctgctctctgaattcctgactcccctcagctgcagcacttaggtgagtattttactccaggtgagtattttgctagttcctgtgcatatgcagtctctgcacctaaactgtcagtgcctggagagcggatggctctatctaactctccttttttaatgctcatagtgtctacaagagaacttgattcatagccaccattcaacaaacacctgtttaatgggattgaattttcagcatttagtagtgtactaaacatctgatgtgaaataagagccaaattaggcaaagtaagcatgatttagaagtgcagagatggaaagaaaatggtatgaagagcattggtgtagaagtacttcctgaaacttgaaggaatccatctggtatcgctttgattgactttgttaaggacacaattcctaggttctgagactcctcaactctaagatgcaacagtcattgaacaacagtttactttttgaggggtgaaaaatggctgctttcaatgtttacatatattgagagccatagagccatattctgactttggaaacactaaaatgtttccaaaaagtatgttttataatttaaaaaaaagtcagtactcatcactactttttttttttttttttttttttgagacacagtttcactctgtcgctcaggctgaagtgcagtggcacaatctcggctcactgcaatctcctcctccagggttcaagccttccaagtaattgggattacaggcatgcaccaccacagccagctaatttttgtatttttagtagagatggggtttcaccctgttggccaggctggtttcaaactcccagcctcaggtgatccacccacctcggcctcccaaagtgctgggattacaggcgtaggccaccgtgcccagccacgttattattattattattattattattattattattattattattatttttgagacagagtctcgatctgttccccaggctgtagtacaatggcgtgatctcggctcactgcaacctctgtctcccgggttcaagcgattctcctgcctcagcctcctgagtagctgggattacaggcacccgctaacaagcccggctaatttttgtatttttagtagagacagggtttcaccatgtcgtttaggctggtcccaaagtcctaacctcaggtgatccacctgcctcagcctcccaaagtgctgggattacaggcgtgagccaccgcacctggcccacattattacttttaacaggactttgttttctcttttgcctacctcatgtccacatcaatttaattttttttttgtaatagtgcctcaaattccttttaggaaattattcttccttattatatacagcctgctgggttatttcatcaaggtgtgcaactttcccctagtgaagggattgagggacaccctacccaagctagactattcagatgtgtcaacagtgaccagaacgtcaaaggcctggccacagatggagcttactcattccaggcatgggatgtagacaagactgtccagagcttctgctacaaaaagcctctaaaaccacatggttccaaagtccatttctgttatttacaggcaaagaattctaaatgggacagtgctttttgctgatagtacatctaaaactgaagttcttaatctgaggtccagagacttggacatggttcatgggtgggtgtcagggttcaacagataagatataatttttatatctgctgatgagtttattttcccagtgagatggtctacaggcagctttgatcagattctcaaaggggtctatggctgaaaatggattagaaacaattgatcccagagcaggagttcttaataagtctgtgtataaactcagatgggcaaaaattatatctttgtttgtactaacttccattcatggttgcttatttatgaatgttggtaacaaaccacagtattattagcaattcccatgaatttgctaccagtagaaatcagatattttcatatcatgttacagtgttgcagatctcaaaacataatttacacctttcactgctttaaaattacagtgttagtagacccaagctagatcttgttattcaatgtgttaataaagaagcatatatattacttgatcaccagatactttaatagtttaaagctgcatcttaacataactgggttccttggtaatctgtatgctttagtttcttcaaaacattattctaagtagtccaagggcttcatcagactgccaagcctataataccaaaaagtcactagccctcttaggaaaatcttggtaggaccaagcctcctagccttacctttatttgctctacaaagccaggttctatctggtagttcctctcctttcaataacctgacatcttggttcccagcattgcaacttctgaatacttccaaagcagcaggcattgcctaagtccagaaaaacacaaacttatacaaaccataggacaaaacaagagcaaaaagagagagaaagagagagagatccagaataggtggatccagagaggcagaaagcagattggtggttgcaagggcctgcagcgagggggaaacagggagtgacagcttaatggggggattgaccccataatgggtataggatttccttttggggtgatgaaaatgtgttggaaattgatagaggtgatgatggaacagcactgtgatggtactagatggtaatgaattacatatggcaaaaaagctaattttatgttctacgaattagcattcattagctcaataaaacaaaaacaaataagaagtaaataaataaaaggcaactccataacaaattcacctgggaattatgtaaagtcctacttaggggaataaagaaaaaaataatcccaaagtttaacggtattctatttccctttttccccctcaacccaccctcccatcaagttgcttctgtacgctgcaatttgagatcacttacgaaattgctaatgtgtactttagcctacatattaaattccggtttgcacttatgcatattaaaacacaccactaaatactcatctgacaagctatattttaaaccccaaactaggctttattgtgcctggatgcatttttaatatacccactaaatttcagccagactgaagactggctggcaataatgatttataagggagggtagagtccctcactttctatcccagagtccgctcccacttgagggtctgggggttggcagccccctactgcctgctggctctgtggagcttttaggaaaagatttcaagcacgatctcacggcctcaaccaggatctgaaagatgactgaagggcttcccattctggtaatagaccccacccaggacctcagcatatcccattagagctcgccagcctccaacacagcaggattggattggctgtccaccggcccctctcatatcctcctccatcgttctctctctgccaggcttttgaagttccttttcctgctcacgaaccctgctggcaccacatagcctacaggatagtgtccaagtgcctcagtcgggaaagcaagaactgacctttttttgaagccccacacaatagaaagctttcatatcaagcaccccatttaacttcatgaaaaccacgactaggcttattatggccatttagggatgaagacactaaggcaaaagatcatataaagtcgcacaactggtcaagctttcaccacatttctatttctccttcctttccaacattttctctaccactcactcctttgtgtcagccaggcaggccccctactcactgtcccctgactgtcacaccttgcccacagggcccctccacctaagggcctcccctttctgcattccaaatcccacccattcctcaaggtttggctcaagtctccccttctccaaaaagctttcttagaccccagttctctccccatcctctgaatttccacttattacgccactactccttgaacatatccaggtattgcctggtgtggagtgtgtgtctggcctcctccagtaaaaactaaactccctgaggacaggaattgtgtcttattccttttgtatttgctacaagtaccctgtaggattgagagatcaaaaccgcttgattctctcaatcagcaagagattgatttttttcaggccaaagcattgatcctttttcccagtttctgtacttctccccctgtctcctgccacattccctacacaagtctcacggggctcccagtcatcctctccaggccgccctgcacaagagagccccgccttgcacagggctccttccctgctgcatcatctcccctagatgcagcctgcttcctttccagctggaggatgaagaaggttcttttttccttttacatgtctaatgacattgtttttttcagacagggactttgggaaaagtcatggcaatgaagtatggagcttattcagagaatgagcaggttgtgtcctatctccaggtgtgtgacagctgccaagagggtagtatgtggactgttttggcaggagaagggggttcagtggtattaagcgctcacaggaaaggacaggggctttgggatgggggacacagatgaaaagcactgttgcctgcatcatgtaatttgacagatactgtaagactccagaggttcccaaccatgtccctttgaacttataatgttttcttctttccttctgtgttcaaaattcctcacattttagtttttctctgttttagatgatgtggttagctaatattttgcaacaaaatttatgttttcttctctttttttctaccacgtcttctcccacaacttccaaaagcgccttattttttcagggatgtggcagggaagaaatcagggattaatcagtaatatctctaggactttgttttccaaagtcctctatcttttgaagacctaagagggttcacgaaggaggttaaagaaagaggcaattcatagagtaacttgagcatttgaatcaaggcattgggaataagaaaggatcctcccaagaccatacagccaaccccaggccaaggcagaaaagaaagagggtgtatgattccaaagaggaatagttgcaagctcagatgttcaaatgccttcaaagaatcagaaggtattatgaacaaataaatgagtaaagctggtaaagagacaagcgggnnnnnnnnnnnnnnnnnnnnnnnnnnnnnnnnnnnnnnnnnnnnnntacctgggggttttatgtcctaagtatataattttgtttaaaaaatgtatactatgctggtgaaaaaaacacatcttgggcttcattccacccactggcaatctctgaatctagctagttgtgatagccttgtaaaagatttttgtgcctcaagcatgaaataaaatctgcagagccagccacagtgctgtgcacctgtagactaagctactccagaggtggggcaggaggattgcttgagcccaggagatctgtgctgtagtgcactatgccaatgggatgtctgcactaaatgcaacatcaatatggtgacctcccaggagcagaggaccagcaggatgcctatggaggggtgatccagcccgggtcagaaacagagcaggacaaaacttccatgctgatcagcagtgggatcacatctgtgaatagccactgccagtctggacaacatagaaagaccctatctctaaaaaaataaataaataaataaataaataaataaataaataaataaataaataaatgatacagagaggcagtagttctaatacagccctgtagacagcagaaaactgtaaaccaatgacctggtaacaagggagacatctccccacatcagatgcctggggaatgtgaatgaccatggaactgtgatctaaattctgggcttggagggggcagagaaagtccaagaatggcttaggttaagtagcccttccccagctacaagcccagtgggatgggaaaaattaggttaatttataaaaatattttaaaggtacaatatttgtgtataaagttgaaattcctataactacaaacattgaaggatatgtttgggttaattcaattctccatacatctactctgcactgcctatatatctctgctgtgtgtatatgtgtctcttacatagatattgaattgagttgtactgtaatggatctgtcccatttgagtcttggaataaaataaagccacatccttgtgttcagaagatggagtcacatttagagtaatggacacttctggtgttggtggtcctgagaaacagtggaacttggaagaagtgagggattagaagacaggacttagaccggggtaaggaaagaatgtcttcctttctctgatatggctctcttgagctcaagctcccacaagtttagcaaggcttgaatgtcctacctggtaggggggatgaaaaatgactcttgccatttgaagctggatagggaggcagatctggaggggctcccccaaggatgggcaggtgcaggtgattagaacaaccatttattcacccaagagtttcatgaatcattctatgctattagcacaaagctttaacttaagcacagctgttctgaaagatactaaaagaagagaattggcccatccttagggtagaaaggtaaggacttttatgccacctaaggtcatgacagcagtggaagcagcaatcgaagacattccctagaagaaagtgacgttggaggaacaagtgttaggcctttacagggatcctttcacaattgcccaccttgagggatcacagagtgttattttattaagccagttggtgagttccttggtcagacacagctgaattctgagggatgactaagacagagcctctgccctctagaaaaagtggacacatttttatggtgggggagcttaagtatgatatgtcttaaaaaaaatttagagtgtttctctaaagaaacactggatgaatagaatattagggacaaaggtgtagctgggagtgtgttccaagtggagtagacagcaggaaccacggcatagacatggggagccccttttgatcaggagagatggagctacaccctctggctgtatcatagagacatgaaaagagtgaagcctggagaaacagctgacatcacaacaggcaaagcctcagttgcaagggaagacatttgctcttaatccgaagacaaaaaaaaaaaagactatgcactttgagacttcttagttacaaacaaccattccagggagtttaaatagaaaataaattaattaaaagacattacagacgtgtacttgtacaaagaataaattctgcagacccaatgtacagcacagtgactatagttaataataatgtactgtgtacttgcaatttgctaagagagtagatcttaagtaatctgatcaccaaaaaaaggtaattatgtgatgtgagagatgggttaactaacctgattgcagtaatcatgtcacaatgtatacatatatcaaaacatcatgttgtatatctagaatatatactattgttatttgtcaattatacctcaacaaagctgaaaaattgggggtaatttgagtaaaaatattgagatactgggtaatttacaggaactctgggagggcaaagaacaaaacttgaaaaccaagcagttaatccaccctctgtgctaattccatggaggcccacatttactaccaccaggcactagacgcaagacctcatctctacttccagaaaatggatcccactccatgtggcttcctggtggtgctctcctctgaacctaagtctaccgagagcagtctatgggcagaacaagggtcctgggcctgtgctccagctgcaagggatgctgggtaagagtttctagcatctgccttgggaaggcaggactcctaattgcacatttccctaaatgtaaaaaggctttcagaagatgctgagcagcagtaaagcatagaaaatgtcactacaattgccagtaaagtttttcgagaaggagagtaaacataatctaagcacatgttaggaagattaattagaggttggatgggtaatgcccacatgttttctgggaagactgacccaactggagaagggcaaggaagtcctgaatgagtagccttcattctacttctgcagaggactaattgtcactctgtggacagtttgacaggtccagggagtcagaatggcaggacagataagtcaggagtagggtaggatagtaagaaagcatctacaggaggaaaagactgaaggtgagtggggaagtggacatgaatgtgttgacaaaggtcagcctgaccagctccctgagttggggcaagcccaggtgaggcccagcaccaggccatggaaatccagccactacaatgccaagtgaaaggtgagagtttagagtttagactggtattggcagagccacatgagagatgaaggaagagcagccaggagctgcgagtgggcaggaagtggggatgagtggcgtccactgcaggttctccctgcaggacagagctccaagccagaagggaaaggaagcagaggagtgctctgaaaaagcagcagccctgcagccgagggaccgaggggctgaacggtttctccactgagagatccagttctcaggtaggaactgagaatcagaaacaagggagaggcacatcctgttttacgagaaaaatcaaggtcttcaaagataactgtaataggtttccatttgtctgtttttattgtggtaaaatatgtgtaacataaaacttaccgttttaaccaatataaagtgtacaattcagtggcattaagtacactcacagtgctatgcagctatcaccactatccaggtccagaacattttcaccaccgcaaatgcaaactccaccctcatcaagcagttgctctccattccccactccccaccagtccctggcaaccactcatctgctcactgtttctatggatttgcctatcctggatattttatataaatagaatcatgtaatatgtgaccttttgtgtctggtgtctttctcatggcatgtttctgaggtttacccatgtgatagcatataatggtcaattttatgtgccaatttgactgggccatagagtgccaggtatttggttaaacgttattctgggtgtgtctgtgagggtgtctctggatgaaattaacatctgaattgatggcctgagaaaggaggttgcccttcccagagtgggtgggccccatgcaatcaattaaaggcttgaatagaacaaaaaggctgtgtaagaaaggatttgttctctctctatatgaatgtcttccagtgagacattggtcttctgcctttggacttggactcagaatagaccttacaccattgactctcctggttctcaggcctttggattaggactgaaactataccatagactttcctggttctccagcttgtcaaccaaagatcttgggacttctcagcctccataattgcatgagtcaattctttttttttttttttttcttgagacaggatctggctctgttgcccaggctggagtgcagtggcacaatcttggctcactgcaacctctgccttccgggttcaagcgattctcctgcctcagccttctgagtagctgggattacaggtgcccgccaccatgcctggctaatttttgtatttttttttgtagagacgaggtttcaccatattggccaggctggtgtcaaactcctgacctcaagtgatccacccacctcggcctcccaaagtgctgggattacagggatgagccaccacgcccagcctccagttctttatgataaatctctgtgtgtgtgtgtgtgtgtgtgtgtgtgtgtgtgtgtgtgtgtgtatacatatatacatacactcatacatatatcctattggttctttttttttgagaatcctcactaatacatagcatgtatcattactttatttctttaatggctgcataatattccattgtatggatatatcacattttgtttatccattcatcagctgatcagcatttgggttgttttcatcatgcgccaaggttttaaaatcctggttccccatttacattgcagggtggcttggtcaaatcacttaccctctctgggcatctgtttcatcacatgttaaattattaggagggttaaatgaaatgaagtatgtaaaagcctgacatagagaggacaattggcaagcaatcaaaaattgattcccttaactggagttggaactcagatcagagtgggcccagcagcagcaataacttgcaatagatcagggccccttaaattcctcccaaatcagaactggacccacagccagggcagggtagatacctgcaggtagaggacaaagaagtcttaattctgaggcaagaaactggaccctcccttgccttcttgcctcttcctagtgtgcatgcttggggaattaggggttctaaatcaggaccctaaaacatggctatgcctctgtttcacaaagtcttaggcaataaatattgtgtggaaatatctcatgtttaaactgttagaaatattacacattttacagatatttgaaagataagcatatacttctatcatatcttatcttaaaaatgagtacccttcaggtttatttacaacttttgttcagatgattccatagcatgcacttacattatataaaacctgtgaaaaaataacacctatcattccctaaatcacagtaatttcagaagtttacacttgcattcatttttcttttaatgttctgtaaccataaatgtccctctcctaggtgtcataaaaggcaacataaaaagtgagtttaaatgcacccagtcttccttgctaaaggcacataagcagaatttcttactccacaatcagcggtgaaaaattcaatagctgacccaggaacacaggcctgggggtcacgaggcccttggtgcatgctccagtggggccctgaacatattcctcagtttccttatctgtgcaatccattcattcagcagcaatccctgaggaccacagtgggctaggccaggctgtagagttacaggatcaataagacctgcatccccattctcagaaacccatagtctagcaagaaagcagcaaaaaaacttaatgattattgtgtaccagggattgttcttccattttccatgtattagctcattaaatccttccaacaaccctctgaaataaacagtatttcctatgattcgactgtttgtgtctcccacccgcagagtcatatgtggaaatcctaccgggcaagcttatggctttaggagatggggctttgggaagatgatcaggtcatgatggctcatgaatgaaattagtgcccttatgaaagaggtctgggagaggcccttacccctcctgcttttgagaaggcaaaagtgagatgactatctatgaggaagcaactcctcaccaaacatcaaatctgctggcactttgatcttggatttcccagccttcagaactgtgagaaataaatttctgttgtttataagccaccagtctataatattttgttgtatcagctagatcagactaagacactattagtaaaaataccactattatcttcattttacagatgaggaaactaaagcacaaagcaggtcagtgacttagcccaaaacaaaccttggcagcctagctttataaagtccacaccattaattatcatgtgagtatgccttatgtgttttacataatagaccttaatgtgagtaacacaggtgcatacagcacagcaattaattttacctgaacaaagttaaggaaggcactggacatgactctgtatctcggccaagaaaaatgatttcacacagcagggatggaagagaaaaatgaagaactgagggaccagcaagaggaaacaaccggagatgtggcagagttggggacattgaaggagcccctaatggaaacagcaagaccaagcaggtgaaaataaagaataaaggcacaggtctcctctgaagctccttttagttctcaatcctatgacatacctaaaaattgcatctacaatccttcgtttagggacatgcgatgcttgtctatgcattaaccacgctgtggtttaagaagggattatctctatcctaccacctacatcaattttcctttaaccagtttgtataatgtgttgtatatttaaatatgcatattttaaatacttgatattattgaacaaacatgctgagcattagctcagtgcacagcatcctcttcattctgaccacactaccttagtggagggagtgcctcgtgtcttgcctgcagtatttgctttctccatccaagtcccctcttctatatgacattaacctaatcatgattttttaagcccctccccatttccaaggccattgcttccagcacaaaatctgtcctccttagcacagcactcaccacctttc

SEQ ID NO: 13965 - DNA, 7679 bp, Human
aagaacaaggtcttggcctttatagtccctcattagttcaaatcttcaggtcggagcttcccctggcagccaagcctcttgtgagcacttgtgaatcctttcattctgagatgctggagtttgagacctgtggactatgaagacagtgcctggggagagaggatgagaaagcaagtgaaagggtgcgaactggaggcaagttcagcagcaaaggagcctggcccccaatggcctctggggtcatcagggtcattgtccagcccaagtcccaggcccagaagaaaatcctgcgtacaactggcatgtacagctggcatgattggctggggacaaagcgctgggacccatggaagaaaggacagactgacctccggccttaagaggagagacctgggggaggagctgctccagcaggaaatgccagagctgggcaggaacaatagcggggtttctttagcccttgttttctttggcatcttagctgccacagagcccagagcccgctcctccaagtccttagcattcctgcaggctcctcccctcagccctgcctgacaaactgacagaggaggcacctgttctctacttcctctgcaccctcccgctggactcttccccctagcttagcaccacactaaaccctcaaggggcttttaaaattaacagtcacaacgtaaggagactttactgagccttactctgtgccaggcactgtgctaagggcttctctaacacacatggggatgggagtctttaatgcagctcctctcccgggatcctgggggtgggtcctccccctctaagccctagagagccctccagcctcgttctccacatgcccgacctggagtgggtgggaagagggagagggtggtgtgcgaggaggcagcaggtcacaaaggggttacaagctcagagggaagggggatgggaactggaagaaagtgtcacccagaccaggggtagaagaacttgactttggggagactgagaaagaccacatgtaagagagagagacatggaaaatgaggtagaaacagacagaaacaaagaaaggcacaaaaattaagaggcagaggaaaggtgaaaatagccaggagacagaaactgcaggatgagagaaatgaatagagagagacagagagactaagacagcaaaaggcaggaaggaaaaacagaaaatgagaaggtgtgagagagagagagatggagaggtggagaacagagagactgaaatgagaaagagacctctcggagagagaccgagaggaagaggctggcagagggagagggtcagagaccaaagacagagacaaaaagagaaatagggttttgcaaagactgactgacagaaacagatttcgaggggagagagatcaagaccaagtgagggtttgaaggagacttaggggaggtggaggaagagaaggagagtcttagatccagggtgaggggcttctagcaggaagagggaagacgccaagaccgcgcttgggaggtcagtggtgcgtctctaccccccctgctcccccactccaactcccagagtctcaaggcctcacgtcacacccccgtcccgtcccgtcgacaaggggaaccccggcctgggagagggcgcctccggggatccgttgcctagtccaggtactgcccagctaccgggcgtcgaggattgcgaagcgtcggggcaggctggcacggtgcccacttttcccaaaacgccagccttccaagcccagaagctcgcccggcccaggccgggagcggcccacgtcggacggccggaccgccctgcaggacccagcccggccgcccgcccccgccgccggcggtgagggaggtgagcggcgccgacctgcgggacgagcatcactccgacccagccgggggtgaggcgggtcaggatgctccggtcgcaggaggaaaaggaggagctggaccaaaagcccgaagagaagaaaaggggaaggccgcgcacggagcgcggtaaaggccggcggagctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgcgccgcgctggcccccgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcggtgagtgccctgggggggtgggagcctcgaccctggggtgggctcaggaccaggcctcttaccccacctggaaaaaaggggtgccgcagagtgggccagcccacacccttcaccaggaaggcaagagcctcccaaggccaggaaggcaactctccaggctgatatgtgctcccttcctgcccacctcctctccccctcccctcatgctggcccaccctggtctctctccaatgcctgctacccctcctctcctgccagaaacttctgcctcctcctgtctcacctttgagctccaccttcctcctgggcccctcacctctcccatcacctcagtggagcggttgagtagaaccaccagagaaaagcgggctgtcatcacggctttgggtgaccctggcctgtctgtgcttcattgttctcagcgcctccatggggatggttgtgtctgccacagcaggtgtcaaggggctcacatttagaaaccgtagataggaaccccctaatgtggggccagtgcagagcagtttctgttgagtattggttccctctttccccaacctgtgctcctcccctcaaccccgcacccctgcctccctcccacctcctgcagccccagagtcagcccccaaccccatgcaaactgggttcattaatcaaacacagaggaggatttgcttggccattgtcaagctgtgagtcagccgcactggagagacgggtttaaggctggcactggcatggggccaggcacgggcaggaggccgggatggggtgtgaggcaggcaaaccgggcagctgcccacaggatggagggtaaatgccagcttatgggggctgggggttgggcagagccattgataggcccgtgtccaggaaaagctaccctgacgctctgccctttggccacaggcctgagcttcaagcctgtgcaaactatgaaatgtacagtgtctttaacaaatggcttcgctggggcgatgtccacaggacttggcttccaggtgccaaggtgctctaagtgtccctggaggccaaaagccctactccccgagcccctggctatacagccagaaggtggccggggtcctaacccgctatccccttgcagctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggagtgagcagtaccgacattgggctggggtgagggtggggcaggcactcaaggcaaataatggagccctggagcggagcccacttcagatggatgagtccagcagagtttaaggcctggatttagggctcctggactctggccctactgggccccagaattgatccccccaaaacctctgggctgaggaaagatgggagtaagtaggaggtgggatgggacaggaatcaaacccaacctcagagcagagaagagaggagggcgtagttaagggtccatggttaaccaagcagctgggatccttggagggagaggttgccagcctgagtttgagacctggctgagcccctggactgcagtgtaaccttgagagagtccagattctgtgggagtggaccaggatgttgcctttctctccaccgccctgtctctatccagatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctagagcttgggggtgggccagggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacgtgtcccctctgaaggtttatttgcttctctttccggtgtggttggagggagcctgtccctctgggaatccgtttgccttctttgagggtctaggtgtctgtggtccatgtctctgtccctgggagtggtgtgtcagtatattcgtccccgaggtgggaggaagtctttctccctgaaggtctggaagtctgcatgtctgtctcctctcagggtccgtgggtctgtcctctgtggggtggggggcatgtggtcttcaaggtctggggctcagcgccctgactcctgccctgtctccaccaggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggcgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactcacgttccgcctctgtctctcctcagagtgccttgagacactctggcccattgcctctcctctttgtcatcccacatcctccaccacgatctccacagggtaccaggggaccccaggacaagtgctctgtgggaagaaagggagactgtgaccatgggaggcccagagaatcagagagatgggaacagagcagggagagactgagagaagaccgaatatcaaaatagagctagaggccaggaaggaggggtcctcactgcagtcaccctccacccctccccctcagccatgtcaatcaagtccctgccacttgaggagggcttggctggcacttgaggggagtaccagggtgtgacaggcagggcggaggagtgagccaaccgcagcccctcgagatggcaagggggtgaccagccaggttccatcacagccctgggctcgtttctctgcaccttgatctttcaaaaaggtgtcctgctgggagcctgtgcccagagggagcagccccccgacccccccagaagccacatgtggcccagcccccttttccagggcttctcatgccttggcccaccagtgtccccaccgtcctctcctctgggcctgagctctgtcctagcctgctcttgtcccactgtcactgacactccttaggtaacctccttaaactctcagagcctccctctcttcatctgtaaaatggggataaaatatcactttcctcacaagatagttgtggggaccagatgagggcatgagatgcctgggaccagtcagctttctgtgaggaaaaggcggggggtcatgcagtgaacagctccgcatagcccagcttcgcagtgagcccagcctggagtcagtaactaccctcattccaatctggccgtgaaacttggggcaacataagctctctgagctttaaggaccttatctgcaaaacaggggtacttttcccgacctcatgtgctatgtgctgtcgtgaggagaaaatgagaccacgcctggaggtaaaacgcttgtacaaatggtcaggcgccttggagtgagtgctcagtatagtcgtgttaatagaaacccacacgtgcctgcctagtctgaggccccagccacatgcttctgccctcctgggggtgtgtggacctgagcgcctgtccagcggggccaggagacggactgagaaggggtaggggaagctgtagttcttggccagcgagaggcagtcccaggggctggggtgaggagtggcagaccccccagccttctccacacttagagtctaagcatctacaagtgagaggtcagccactcatgtccgccccataggcttacagtaaacaccacgtggcattgcgtgtgagaaccccgggagcccagggaaggagcagccccccacccaccgtgtcccttcccacttcttccaacctgccccgggctgggggagccgggctgcaagtgccagctctggccagcagagggcgacgtcgtccaccgaatccac

SEQ ID NO: 13966 - DNA, 36047 bp, Human
  misc_feature (1)...(36047): n = A,T,C or G
tgaagacacagtgaacaagcagaaaaaaactagggctgggaattcagtttgggagaaaaggcagctaagctgacctttgaactttagggtaagacccttgggcagccacgtaatgaccagcgccatcccattcttcaaggagagcaccatactcaagcactgcctgtcaagagggagcaagagggaaactgctctagaacagaggagatgccttctagaaaacaagggtgggggaaagaatttttacactataacccggggctccttcactatcttgttttatttacttctcctgactccattcattcagtcattcaacagagagtttactgagataggtgctggggaagtactgaatgaaaacagactccatcccttccttcatacagcaggaagctgacaatcaattatacaatataaatttgacattgttaccatgatcatactgcaaaggtgagttatctgatgctatggaagcatgaaagaagggaatttgacttagttatggagctcaggccaggcttccaggacacagctggaatttgaaggaaaagcaggtgagaagaagcatgagaaaatgattcaagcaagacagcaaggggaaaaaaattccctcaacatctgtcaacattgcagtgcaatatcaaagcccaagttcagaagactccaaccttgctgggaagaagagtgacatcacactgcccatgaagatgttgaaaacagacaatgttggtgaaatccctgttgagagcagggacagaccgtttcctaaatgctacactcccctccccagaaatgttccgagacggggccacagcagggaagagtcacaggttttgcttgctgtggacctctgacgctgtgaataaaactttttctttagttttacaatagatgtcactgtgcggcattcttaaacacaaagaagagggagaaacgaggttactaagataatttagtaactaagagagaacatgatatattgaaaaacagtggaatttggagtcagttggttcattctagtacgatgataatactcccaaccttgaacaagttacttagatttttttgaacattagttctgtcacccataaaataggcataataaaatccatcactcaaaaaatgttagtttcttctctcattggctaattttcataatcagaatttccaagactcattattttcatttgaaaagtacaaattatacctgcatcagagtattgatatttaaatgagttcatttgtaaactttaaagcatgaggtaaatatcaggtattatgaatcagtcataaaatatttgcgatggttactatatattagatcctgtttttggtcctggagaaatggagggttgactgaagcagggccttgcccttaggagagagctgaaggagaaatctattcttcttcctgaggcagagagaaaaggtagcaaggccagagggaaagggctgcacaggcacccaagttcctggcagttggccctctctgggggatatctgatatctgacctccagccatcagctgagagcttgcccagactatctgacccaagggctgtagggactgggctgcagaatggatttctaaatcttcaaaataaacaggcaaggaaatcttgcaacaaatgaaaaatgacttgagggcagtagaaagtacttgtgccaactgatggaggaggttatgaaaaatgaggagaggaaaatcactatagacttctgtgtttctactgcaagtggattgaacagtccagatatactgatttccagcccatatttcctgcttttaagctcctttggtcttatttccctcttctttctgaaaagttataaaatgaatgaagggcagaatgtttcttgcccaaccatgattcaggaggcagctcagccacagaacaggcaagtgtagcattgcctggaggaaaaggacttgtagaggcaggtcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggtgagtggaaattatgaaattgatactagcatcccatttgatcagacctgtagccttatttagaagctaactaccctgcctggtttgtatttgagtaatacagagaacagcatttttaaaagatagcgccacaacgttatgattatggctaactaagccagtttgttcatctaattctgtgtagtctcagctcacagagtgttgatctagccctctattttgttattgttggttgctactaatttcagctcttttgttttcctacatgactgtttttggggtagcaacttagaaaaataacaacccattgtggcaacaaagattgaatatttaactgatgaataagcatgataatgagcatgcttgttaaaatcatattgctagattccatcctgagggtgagaattctcaggcagaaagggtgagagtctgcacggtgggccaaaaagcaaaattatttcttttcacttgaatgtgctgtaacataattgactatttttactttaatatggcaagggaggatcatagctctatgatgtaagagcctccatttagtattgctttagtgaaatcagtagcatcataaggtgtggtcttgaatgtgcccacaggtgtgacatgaaaaggatttgttccacaaaagcttaaaagcctttctcaaaattgggaaaactatgaaggcaagcacagacatataattagtgtcctaaaatcttccatataatcatttaaagtttttttaaaaatttgctcctatgttttcccaaagtctagggctttctctaaaagaaatgggtctcttcaaaatatttcattgtcttttattactgtttaagcataccagaaaaccaaaacatacaggatttacaagtggtaaagtaagtttttcttttgtctggctgtaggaaatgataactgaagcttcattttacctatttaatgctaccaagagaagagtatttttcagaaatataaagattttaatacctgccacatggaaagctaataataacagcaaaataaaacaagaatcatatgaaaaggtaagaatccaggatttcattcaatgatctcaaggggaaaaaaaacaccaaaatatactgtgctcaaacgataaaagtgagaagttaagtaaaaacaaatcatcagtattaacaatgcaaataatattaatgggcagaatgttatcaacaaaatatatgagaataaatgaatgcaaattgtgcagtaaaaaatgagtcaaatgccatagcctaagtagtttctcagaagatctctttattttgtaacttatggagtactttctgaaaagtttggttgaggatcaagaactagttttatcctactgaggatgagctgcaaagggaacagttccaattatgactatacccatttaccatcctgtcaggagcaataaacatgcatgtccagacagaaatataaaccaccatgcatataaaaatatgactgccatcttatgccatggtgtagattatcagaatttcacattagctcaagtccagaatattgttttaggggaataaggagattagaaggaagggaggaaggatgtggggatgtggatgagtaggggaatggctacctttttttttccacctatagaggaacttcaccttgaaaggctctcataagttgcagatcatgattaagcacccatgatgatgtctggtacatactagtgtgcacactataaataaatgataaataatataaatggtaaatcactgtttgaagtcaactgtgaacaagagtccattgcagctaccagaagggccagaagtagaggcattggcaacttatctcagggtttcagcaatggagtgggtttgagattgtaactacatctctaacagaatgactcaaacatgtggtacagctttcccctttccttatttctgaccctcagtatgaaatttcctaagtctgtttcattcttagctctccttcaaagctactctgtcagaaattgaatggtatagcaatccagataggtaccccaatgtcctgaagaagttaaagagcctgtgaaaagcatttgacctatgaccagatgaaagcatttgagaatgcttgcacatgaagataggataggtgggggaactggggtaagctgggaagagttagtgtttaagctccaactaagtgccaggcattttacatatattatttaattctcacataacttaaaattagtttctgtgatcacaaattaaaacactggggcttgaataaggtatggactttgtcccaaatctaacagctagtaaattacagagccataatttgaatgtctatttgcctccaaaacccatgctttttgcactaagctttgttgtctctagctgtcaatagagatttaatgcatctattgggccttcaatagaactaagaagtattggagacaacaaacaccaaaaccaggttgccataggtaacacttgatcctaatggaggggagagaaataagtaaagcaaaagtgaaaatatgagtgaacggaaagaccaaaggaaacaatcgtccctggatgctgttcatttatctgttggataccaattctttaacctcagaatgtcaattaagcaaacagtgaatgatcattatgtacgggaccacgctaggcacttcagagaacccaaggaccagcaaggtagttcctgtccttccaagtctacaatgagatgtaggtaggaatcatggaagggggaaagggttaggaaaagtagataagagctgaattactgtggtctataaggtataaagtaaccccaaacagcctctgagtattccattccatgaagggcactctttccttttggcctcaggacaaattttcagacataggaatgaggttttacccaagtgaggactatccaagagtgtgacctcttcagccttttttgtaggtacttccttgtaatgaccttggcttgaattcttatctttctaaaaataaatgttaattattataaaagtaatttatactcattgaaaaaaattaaataatgtagaaacatggaaaataaaaatgaaaaattgtattgtcctcttcttctcagtggcacacacacagacacagatggacacacatacatacaacacacacacacacacacacacaaaacacatatacatattgtacatagagtgataattgtgtatattggatcgtattagatctatttttccaaaatcagcttttaaaaaaacttaacagcatatttaacttttaagtgcatatccagaacaatctgtcatctttcttcccaaaaataaaagaaacaatgttatatataacattttcttgtcttgatagttatatgagtggatatttcagttttggacttaaaatatgttttagcaacagtaatggaaatggtcaggccataagatgaaatataacttcattggaatgatcgttttgctgatctaattggttacaggaaagaaaggacaaattttcaaagaaataatgttctattgtcttacaccaataaaataacccacagaaagttgttcacaaaaggctgtaacattttacagccttctgaatggttctgaacgatgtataaatgcttttagaatttcttcaaatattttaattgcattttatagtgttttgttatatcagacttttacaggattgacttttgagaatattttaatctggaatgtggaaagatcaaatggaagtaattaggttccataaaaatttgctaagctttcataacatagacctttttggaaatcccaagtgattttattgatatgtagctgtgggtgcattttaaactccatccacaaggtgtttttcttcaattttgtttttaaattgggttataattacatacaataaaatgcacacatcttaagtgtacagttcaaagtgctttaatgaatgtatacatttatgtcaccaacaacagagctgagaaagtattacaaggcatttcttttaatttaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggtaagtgggaccaataaaacaatagccattggacaatactacttataatattctgtgcttggtgctgaaagggactcactcacaaaacctgaaacttgtcaaggacttaccactcaaagggggagataggtcatatgcccatgcaaagatgaggggctaaagtgaactcgaaagagtttagcaccagattagtggcccagagaggagtgctataagaattcaatcaaggaaacgtcatttagagtcaagggtggtcagaaatgtcctcacaaaggaaaaggtcttcaagattgaacatcattttgataaatggaaagaagggagaaaatagtgggaagactatgaagaaaactgtggcagcagaaaaattaaaggcatataggagagacagagaccctgatgatggtgcagggagactgtgggcagtgggagaaaacgttgaaacatacatgagggccaggtgatgcactaaaatggccacattttcaagtcaccactcaaggtttctaagcacaggagtgactccatcaaagcagtgttttaagattaatctggcttcctctgatcaatgaaggagaaactggatatcaggagaataactgggagaagtcgaggtatgaggccacaagacttaaaaatgggtggagacagtgagatgggaaggatagtaataaggacactgaggatttcctatgcgctagccgctctgtggtttccttttcaaatgttatcgtacttaattctagcaactctaagcgatgagaaatactccagagataaaaaacaaaaagaggtctgaactgctgcagaaggaaaggcaagaggcacgtggagacagcattaaggaacaaggcacacaccaggtttttgtcagacatggaaaaaaccagcttcaagaagaaatcccacaagtctggatctaggcaaattcattgtgaagagcaatagactatgccagggaaagtggttcagcctgtggttagatattgatggctggagtttgggagagaagtcagggtcataggcctagagactggtatttagtgagtgagatctgagggagaaaatagtaagcacagttcgccagtcaaggactatctatcccaatctttattttttgtttttgatttaatgtaacagtagtgcctttcaagtgatgtcttaattttcttttttatccctagttaaatctaaactagggttttgttaacaaggattttgttatcctctgtatagttagcaggaagtggagtgaaacactccataaaatacactttacaaaacactttataaatctttagaaaaacgtagttttttttctttcctggtaaccttgagatgctgataatctctgctcaagcatgatttcatcagcacttctaaatttcatgagtaggcacaatctttccctcaacactcacagcttggactgctaccctcccttcctttgcctcgaggtccaaaaattacacaatatgccacagcctgagtcaactcagcacacacttcctgagttcccggaacttaaaataattcagaaaaaagaaatgtgtgctttgggaggggagttcatctggaaagcttatatgggaaagctgtggtctgaactttgaaggggaatgtaagattttgagannnnnnnnnnnnnnnnnnnnatgggggtttccctgacctaggagctgtaaaatacacataaacatggagaataagggataaaataaaagtacaagggaccatccaggctggggagaacattctgcagtctccttttttgctccttcctccttccctagctcctaggtttcaactattgctctagatagaagaattacctgcaagaaaaaaagcaggtctgcttggatagctcagacagaagattaggaaagctttatttgcctatctggatatgcttctttccctttctccaaaccctgaacttagaggcctctacaaagctgaatagaaacctgttgggcagcttcactggggagatgagaggatgtgggactactcactagcttcaaatagatgtgcaacaagtaaattactgcatttacaagaccaaacatattttcatgctgccttttttatgatggtaggtggtggagtaggaggagatgggaataggataggggagaggaaaaggggagagagggaagtaacttaaactctttggtcattccaaagagtatgtgtggtcaagaaatgttacgtcttcactagttagcaaggcacattgctgagattttagaagctcaaaagcaaaagttctttcttccgcaggccgagtgtttgtccatgaatgggcccacctccgttggggtgtgttcgatgagtataacaatgacaaacctttctacataaatgggcaaaatcaaattaaagtgacaaggttagtactttttttcatgttataattcattatttatttgactctaaaattgcttataacttaagcaattaaataattgcctaatttaagcaattaatttaattgcagctaaaacttagctgataagaaagagatcctttcacttttcagttcttaagttatatgacatttttctttaaattggtatttatgtggttcaaatatcaaaacaatataaaaagtcatgcttgtacctgtcttgcttgcagcactatcttcactgtttcccctcatgccctctaagtaaccactttgattagtttcttgtttattttttcaatatttcttcaggcaaattcaaatgaatagaaacatatgtttttcctcgctctgtgttttataattgcatagtgttccattatgtgactataccataatttattcaaccagtctcctcttggtggacacacaggttgtttcccatcttttgtattatcagtaacacgcagttcatagcattacacatgtgtcatttctcatacgtgcagacagattaacatatcaaattcttccaacaattactgagtcaaagggtgattttggtagctattgactgattcttctcctacaattgccactgttttacattcctatcaacaacatttgagatcgcttgtttaggaaagaatcctgttaaatatcatcattacatgttcattatctttttttcccctgataccaagtggaaatgaactcaaaggagcactgacccaggatcttgccactcatgtccttccttgggcttcccaaagtccatctggatttcctagtatcttttgctttgaccctatttagttgttaaagcccttgttaatacagaacccctccatcaagataaaatgctttaaaataaaatagagtgcatttctaaatcagtgaactttcttaatgaagcagttttttgtttgtttttgttgtttgtttgtttttttgtttgttttttgagacggagtttcgctcctgtcgcccaggctggagtgcaatggcacgatttcggctcactgaaacttctgccacctgggttcaagcaattctcctgcgtcagcctcctcagtagctaggattacaggtgcccaacaccacgcctggctaatttttgtatttttagtagagacagggtttcaccatgttggctaggctggtcttaaactcttgacctcaggtgatccaccagcctcagcctcccaaagtaatgggattacaggtgtgagccacagcaccccgccagtagagcagtttttaaagttttgtatatatctagcaggctacaatccttgtaacaattatataagctagtcaacaagaaacataagtgtttctaaaatagacctaattcccagtttctctttccatttttaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtaagtatgcccttggaatgacacactcttgcaggattccttctcttcccatgtttcaagtatttaaattataagataattaagatgcactatactttagaacttgggggaccctagagttcatctagtttttatctacagatttaaaaattggaacccccaagataattacccaaatgataccttcaggaaagtgactatttgctttcctgggaggtttaacaaagggactctggggaccacaaaataaactgttcttatggtggtgttcttgtattctttcataagaaattacattgggttaatgagagtgatataacaaatggttataattctctcgtttgaagtagcagaccactctgtatttgaaatgcctttcctcaatctctttcctttgttttgaatagtctagaacttaacagtaaggtatcaccaggagaagtcaaccaactctgctttgcagaaacccaaccttgtcaatattccatgctaactaactgacaagagactagcatataaatccagaatattattttttaaactattaattaaaaagagtactctgtcatgggcatctcatacttgcatcctctggccaacttattttctctctggatgaagcagcctggaacagccaattctcaccagatgcatagtcagagagcatggaatcagaaacgagggagttaggtgattcagaggttagtagcatcagccttcatgacctgatatatctctcaaagttcacaaaagcctgtaagtcacatctgtgggtcatctcttcacagatctgggggtacagcccacacgtgcctctgtggagttttctctttgtgtccatggctgaccaatgccccttggattgacatgctattttatttcattctggttttagtcaggactagaagttattttgtaactttaagacaatttttcatatttcttgtcccatacattatgtttcttatttatagctttaatatctgatactaacctaatgcattcgatccacattatttatgactaggtactatcttcacgatgttttgaaagacctactcataaatatcttgtcagaaaagttttacaatcccataaccatagtcatgaaatggaagaaaaagagttaaacaacgcaaagcaaaaccagattctgttccagtccctgcaccttcctaagaaactcatgtccttaagcagttatcaacctttcaaagcttcagctttcttttctatgaagttagagctgagacaagagaggctattcagttgcttctaactctaagtttccatggctctgttaatgggaagtatcgactctttgtaggaatagagccactgggaatagatggtgatgcattacttagcaatgcaaaccatatttttaagtggggtattgacataggttcagtatcatttagtgaattatatctatatttctgtaaattatatctatatttccaaattgagtgggggtggggggatcaggaagtaaatttaagttgtttatccccttatctatttttacagagatcaatatttgaggtagaaaaatatatattgactgatcaacaaataaaggtgcagtggtcattaaatattattccaaggagtaggctgatcatgataacttcttctggctgttttcctaatacaatattgtgctaagggaagagggagattgttttgttttgtttttaagagtaagattatgtatatatatacacatacatggtttgttatctaataccaataaactttaatagagattgctctcagaaccacaaagatgctagtgttcccagcaagaatgccaaggtttatttgtaatttgatgtcattcttgaaggaaagaggtatatcactgtaccacttttgatttcttttctttcagttcaccttttcttttacctatagttccttgagaatgagaactatgtttgctttgggagaagtgcctctctttattaaagactgtttttatttccaggtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggtaacattttgaacgaaaatgaatgtaaacatttatcattttttctatcagttctttattatctcaatttattttaagttctggggtacatgtgcaggacgttcaagtttgttacacaggtagacatgtgccatagtggttgctgcacctatcaacccatcacctaggtagtaagccccgcctgcattaactatttatcctgatgctctccctccctgctgtcacccaggctggagtgcagtggcacaatttcagctcactgcagcctcgacctctagggctcaagtgatcttcccatctcagtcttccaagtagctgggactacaggtgcgggacaccatgccttttctatcagtttttaattatttttattttcaggaggtaagggtgagagttggaggaggcaaaaggtttggaatagtcaaggacatcctattttttgggggttgggaggaacaaattcagaatgtggccaaaagttgagataatgcagataaatgaaatccacagataatttctaacccttatttttgctactaattgaaactctttccaacaaagatccttttccaaaattcttacctataatgatcaaaaattcttatgtataatgaaaagttcctgctggctacattctactcactggtaaatatccctggttgaggaagtaaactgtgaatttgcagtgaaagtgaatgtccattatatggctattttccatgtcattgtgtacagaagaccatatctcagtcatctagcaatctagcagcctccagctgctttaactgattaaagtcttagtctccacaatcaggcagctgtgttttaatcctggctgcttcactactgtgtaatatgtcttcgttataaagagcatgatggcccctctgaagcagctttctcacctgtaagatagggataatagtgcctacttttatgagagtcaacttttaaagttttaggaaatctgcaaaccagtaattaaacatagctattaataacaattaaatgatataagcttacaataaaatatatgaaaacgaatatatgaaatactcaaaactcatcacttcttaatttttcctactattttttactattatctatgcccagggtcagcaaactatgtctcactacctgttttgcatggctcacaaaataaggatgggtttacattttaaatggttaaaaaaaaaaaaagaggctttttcatgatgtgtgaaaagtatatgaaattcaaatttcagtgcccacaaataataattttattggaatatagcaatgctcatttgtcaacatattatctatggatactttattgctacagtagcagagttggggagttgcaacagagaacttaatggccagcaaagcctaaaatatttactatctggcccttcacagaaaacttctgctgatccctgagctaaattcttgaggttatttctggtctattgcatctgtatggatgtgctactacaatttcatcccaactgtgcactcagtgacatcacattgacagcaggaaatcaaccatggtttcacacatggaagagtatttaccccgcagaaactggcagttgctacgaatcaggcctgcctgcctgcctgccttcctccctccctacctcccttttcccttcctttattttattcttcatcagaaaactgttattaaacatttaccagtataccactgtctacttcatagggttattgagaggggagtaaatgagataatatgaaatttttagttcaaaataaataataagtggtagctgtttattttaatagtacttgtccaaggagagaatttatccccttgtgctctgtggatcaatagtcctggaatacttgcctttttggctgatatctgaaaaactaaaaactccactaatatagccagcatttgaataattttgttatgttgcatacctgcagttgactagggcattttgttgttgttgttgttttggttttttttttgagatggagttttgctctcattgcccaggctgaagtacaatggcacgatctcagctcaccacaacctccaactcccaggttcaagtgattctcctgcctcagcttccctagtagctgggattacaggcatgtgccaccacgcccagctaattttgtatttttagtagagatggggtttctccatgattggtcaggctggtctcgaactcccgacctcaggtgatccgcccaccttggcctcccaaagtgctgggattacaggcatgagccaacattcccagtggcatgcttttcttaaacatggtctcagagtaatttatattggctatctgcctgtattgagcaagaatgatggaatgaagaggaaagatgatggtacttgagagtatcatctgaaatatgtagaagagaaataagcccaaagtaacaaactcatggcaaaccaaactttcctcccttttcctgccaacaacgtcattgaaccattattgccattcattatcagatgcctacactgcactggcctgagggatatggagatgagaagaacagcatctctgctttgaaatgcttatagctaatgagggacacaggacacacacatgtaaatagatacaatacaatgtgactaggctccacagagatgtgagttactatgtgagcactgaagaggcagcacctggcgctgtagaagaaagtggtcaaggaaggtttcactgagagaatcaatttggagttcaatcttgaaggattcaactaggcgcttgctaggttgggtgatgtaaggaaagagaagaaaggaggacatttgtgggaagagaaaagtgtgtgcagtggccaagaggcaaaaaaagaaggatttgttcaagggaagggcattcatttgtatgactataactaacactgggtagatctgagaggtggcgaatgggatagagacataggtatggatttgagagaaatttaagatattgagttgatgggacctgttcaagaatatggaggctggtaacagaaatggtaagagagtcctgggttgctggcttagctagctgggagtagagatcaagattgggagtgatgatctgatgaccatgaagatggcaatagctattctattgtgagtgcttactcagtatccattttgcagatgagaaaactgaagctaaaaaaaaaaagtaattttactatgatcacataattagcaaaagttgaaggcagagttctaagtccttgttttaccccctttacaacttacttcccaatattgtaagagaaacagtattagaattcaaagtgtagagttgccatcttcatggttgtcaaatcatcactcccaactagttaagccagaaacctgtgtcctaagaagtgtgaaatgcaggtctagatccacccaggaagatgcttgagttggagatagagatcagtgtcatccctgagtgggtggtcattgaagctcagcttgctgctcctctcttttcccagagctttcaaaacaagttaccctagtgaattaatcaatagcatcacctgcccaaaactggtcactaatattactttacacctggttagcccttcatggtataactgtactgccatatatgtatctcacttgatcctcatggcaattctaatttcataaacaagaaagctatcatcctcactctacagatgaagtacccagcctaaggtgaccacaatagcagagggtagtgccggggcagatcatgggtcctctgactgccactcctctctagcaaaggtctctttgcaatgttttcttttacctggactgcatttttaaaacagcagttacaaatttcgtctcagctgggttcatgaatctttgaattctaagttggagtgaaatagtggggatgatgagaaacagagagtggtaaattatgaacatcttgttggaggcagagccccaagccactccctcttccctgaaagcatgcatttttgagcctgcaattaatcaaacaatattctaatattatgttactctttaaagctcaaaaaattatgatccaacatctctaaagaattagcagagatgtttgctaattgagttacttcatcatacttttgtctactaaccaaatgttgccattttcttttttcctttttgggacataggctgacagactccttcaactacaacaagctgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtacagtagagcatcctaagccttggatcaccatcattttcctttccctcttttagtatacgaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatacttgttgacagaataagaaaataaatgaatacaatggatgagactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaagtgtgtttcaggaatgacagagtttatttaaatcaacacaagtttgcattcagcatctgggatgcttatctgatagcaaacaagacacatcagctatggtttttgctgcccatggtctaaaccttggctatctattgaaatcacctggggattaaaaaaaatactaatgtgtgagtctaacccccagagattctgatttaattgatctgggatgtgacctgaccattaaaattgtttaagtctccacatttgattctaacgtgtagccaagactgagaaccactgctctaggtggtcacttactggatctcagaggcaagcctctcacacaataatgtattccacatcttctatgatggatacagttctaaactatggggacaccttgatgattcaagcaggaaaagtccctgctcacaagcaaactggcagtggaatgtagggtgacaagtgctgtgatggggtgaggtaaaacttgagtggagatgggcgtggggtgtaggagctacagtgggaatttggatgagagtgaattcttttgctcaataaaacaatttgaactacacttccttccaagtgactaattctctatgttcaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggtaataaacttttaaaaacttatcttttggagcatgtccctttaacttgactatccaagacacaactatgaaactcattatatggcttaattgaaaatacagaaactgtttttaaaaaacgcacacacatattgctagaatctgtcaaaattttgctgattttttttttacattttccctaaaggttccaactatatacatccaaaaaataatattttataattctgtgttaagccagtgtgagcatgcataatcatggagctaaaacatatgtttaagattaaatgctttgtgggcgggcgcggtggctcacacctgtaatcccagcacattgggaggctgaggtgggcggatcgcttgaggtcaggagtttgagaccagcctggccaacatggtaaaaccccacttctactaaaaatacaaaaattagcagagcatggtggcgggtccctatactcccagctactcgggaggctgaggcaggagaatcactagaactcaggaggcagaggttgcagtcacctgagatcacgctactgcactccagcctgggtgacagagcgagaccccatctcaaaaaagaaaaagattaaatgcactaacttctataatagggacacacacagtgttttaagatacatatctttttatactaaataaggcacagaataattttatcttatattccttattcaataaaaaatgggcatgctgatttgacaaatgaaaggttttattgaattatctttaaaagcaatgttttcagaatataaatgtaaacatatagggatgtaaatagcaattaacctaaattatcttaaaattaccttaatctgaagactattcaataaatatttattgagttcttatgtactgtacataagttctaggccctggcaatacagtcatgaatagaatagctgaaaccactcgcctagggccacttaccatgtggttgtataggatgtcaggcaaagcaagtcaagcacagctcccatttccccaaaacaaacactctaatgcaaagaaagcttgttggaaaaggcttaacattttatttttgttttattttacccattttaatagtgaacactcctatcatgtatttcaggaggtttaaagttctttgttccagatatatcaaactccaatagcatgattgatgctttcagtagaatttcctctggaactggagacattttccagcaacatattcaggtcagaattttctcaatgttatatttccaggtggggagtgggaagggagaaggaaacaagggaaatcaacgaattgtgctacctgcttcattaaccttacttgaatatgtaacagctgtgtatggaaggcttttaaaaggctgcttggcatcaccagagccaggctttcagccctaggagccatttaccacaattgccacctcagcttttcaaagtctgcgagtggagcttgttcctttcttgtggctcaagtgcagatgggggtgtggcagaggcaaggtgcagaagaaaaataaggaactgtgaatttacttttagtgttatagtaactttctgtcaatcagaattcatcttatttttgcttcttcaacatctttgaagctcttccttgtataaggggtatcaactatttcattaaattctaccacaaatatctaaatatctctttgactaccacaacttacatgattttgctcaccaaagcttcctctagttaagtccttttcatagggccactttttttttctttccaaagtactttaaagatattttggacataactgaataatgtgttgaacaaaatttcatctatagtttcctcacagatggcaagtgtgcctgccaagttaatggcttgatgtgaccaatgcagcctgtcaatttatttaacgtgaagattatatttacacagtgaaggcaataaacacaattccacaataagaagtaaaaatgtgaattatatatgacaatatctagtacagattaggctacaattggctcttctgataatgctcaatctttatgccctgtgacttcctctgcaacaatagggaataaaaacaaatgtttaaagaagtaaaaaataaatttaacaaaatattactcatatgggatcaaataagccttaacgttcccaaacttgtccccctcccgacaagctgttggagtcattagctccattggagtgaggtgggaactacatgtaaatcttcttcaacagcccagggcccagcatagcatgtggcccagccatcagcaatccataaatatttcttaaattcatttgaacaaacaattcacaatgtctttgctgttatccaccaatataattttacacgctttgcagatttgagcaattaacgaagcattactaatgtgcttatttaataaatgtaaattttcaaagttatttagagacttgtatccattggaaatacgcagtaattaaatgcaggggctctggtgtcaggcccactgggttttatcacggttccattcccttggtatgtgacatcggcaaattacttctctaagcctactcttcccatctctaaaatgtggataacaatagtatttatcacagaggatttttataaggatcaagtgagattgtgaagcctttagcatggggccaggcatacgtttgtactctgtacatgttacacatgtgtgtgcacacacgtggcttattatgaatggctaaataattttttttttttttgagatggagtcttgctcttctcccaggctggagtgcagtggcgcgatctcagctcactgcagcctccacctccttggttcaagcaatttccctgcctcagtctcccgagcacctgggattacaggcacatgccaccacacctgactaatttgttggtatttttagtacagaaagggtttcaccatgttggccagactagtctcaaactcctgacctcaggcaatccactcgccttggcctcccaaagtgctgggattacaggcatgagccactgtgcccggcctaaataattttttaacgtagcaaaaccatgccaaaacccaagattttatttcttatcgaaatatataaaaggatctggacagattatatacaaattaataaaatttaagcatattcacaaatgaaaatttttaaaagcttgtcattgtaattgctgatctgaggccaatgttggtttggataagagataatatgaggacagctaacatcttttaataaagaataatgaaatgacacttgcattaactacaacaaaatgttttatacctactgtacttaaataacatgcaatattttgctttgcaaagtattttttatgaaaaatgatgtataactacacgtacctgtcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctttaacagcttgaatgtcaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaaggtaggtgttgtgagtttgttcctaaggacaacgttcaaccaagtttatgattttcagctgaatcacatgattaaatgcattgtgtaaagaaaatcttgttttaatatatcaaaagtttactttaaatttatgaggccattttgtgaatattaaaaatttaagaggaataactaaggtatattcccagttttatatattagacaccaaatacttcaacactgaaaattagtatttccactagtattacaattaatgtttttctagcctacatatttctttacataatccatacaaacacacttttctatatgcttagaaaaaaatctctacttagaatttataatatgaatacatgcaatgcatgtggtttttagcatctactgggtgtgctgggttttgttccaggtactttacaataaaatgccatggtaagagcatgaacagggtactatcagaacatacaagagggtggaaggaagaatgcttcctggaagcaaagacatcaaaatggaaatataaggaataacaggccagaggtgggtatgatattgtgggcagaggaaacagcacatagaaagactcagataaaaagaacatggctgttcatagaactagagtagttcaatagagtagggtaatctataagttagggatgtaggcaaaggaaggagaggggagtagtgaggctagacaggtaaacaggagctgtattagcaagggctttgcacaacagtaaagtgaacaggggcttgaatcctgaaagtgaaagggaaccactgatggttctaaggagaactgtaagttgatcagattcactcttgcactgcctgaattcagtgcctcctcacatgctgccccacccccacttttgttgttgttgttgttgttgttgttgttgttgttgttgttgttgttgagatggagtctcgctctgtcacccaggcgggagtgcagtggcaccatctcagctcactgcaaccttcacctcccaggttcaagcgattctcctgcctcagcctcccgagtagctgggactacaggcacttgccaccatgcctggctaatttttgtattttttggtagagatgaggtttcaccatgttggccaggctgttctcaaactcctgacctcaagtgatctgcctgcctctgcctcctgaagtgctgggattgcaggcatgagccaccgctcccaccaccttcttgacagccccttaactagccttcttgactctgaactgccatccctccagtccattctttacctctataaaagcgatccttctgaagcacaaatcagtctgtcttttgttcaaaacctccttggtggtttcagaataaaatccaagtgttaacctttttttttttttttttttttttttagcttagaagattcgcatttattccagatgggaggctgaatctctcagttgtagattttgacacattggcactatttttgtttctgatttattgccttggccataaggtcaaaggcaacaataaagtgtactttcattaatatcaccatggactttcgagtattaatatgacaagaaaagacaactattcattttttttaaggggattggacacacaaacttcaggagggaagaatcccctctcccatggtagaatcctctatcttgataaaatggttgctttattggtcagattttggacttggatcgtctttgttataatattaatagtacagagcatgtaagattttctgcattcatttgaaattcctaataccaaccatcttttaatttataaaaaaatgagggaaacttataataaaacaaaaaatactaccctcacagacgattaatagcatgcaatctatgaaatattacatacattaaaagtctccaattactgtgtgcctggctcatcacacagtatccttccaagacgatctatagaattcaaaactgtacaaaaattttaaaatatgcagaaaacccaaaaggtattttgtaaaacaaagatcacacacacattagtactaaatagggaaaaaaaatcagcagacccatggactccccctgctcccaactgcaggtcttcagtatagaggatttcaccagtgtcttctgcactcccccaatccagtaggggtccaacagaccagctgcattcctcctgactgccaccaactctgttttctgcatagttgtcttctctgcttctgtagtggtgagctgtgggaacttttttttttttttttttttttgatggagtctcgctctgtcaccaggcccaagtggtaaatcttacataccagacccttcatgttttggcttctacccaagcttctctcttaacttcttcgatgctctgctcctattgaacttttctccaaattcatcatgttcttttcacacctgtgtataagggccagggacactttacctacttcttgctccccttgcctgacctcttggtctggattagatgccctgtatcaaaacatttattacactcagagaactttttgatgtggaagttcctgccatgcatctgtcactaatgttatgattcaaaaaacaaaaacaaaaaaacatagtccttgaatcataacttaatggaaaatagtgaagctcatgaatcccaatgaagaaagatggctagggtgtggtgcatctgaactctccaccctgagttacgcttcaaccccttgcttttctgttcttccttctgctttgttgtgtttcacttgttacttctgggggtttgataaggagcagcagcagaagtcaggaaaaagcaatatatgtatagcttaatcaaaaggacgaatttctgctatattgtaattttagtctttttctttcagattttcttttgtaggtttttcccaggcagataggcaagagtagtgtttagcagtatttctataaattacccaaattagatattgtataatcctgacctattaaaaatagtaggtccttttcttggtccctagtagtgtatgtgttttttgttgattgagatttctgagtgtggagtttttgggaagtggagtgaaagaaggatgttgttgcctttttagtccacggtgtccacataaattataatggtccaattaatttgatgtaattttctcagttatgaaaagaaatgaaaaacatttaaacgcctttttggggaaggggctcagattaatatctgtaaagtactttgaagctggacactattattgttatgttctaaaaatgggaatcaagatgtatcctccctcactccaaataaattcgaggtgtaattccctaaagaattatctagaaataaaggtgacttatgctatgaaagccatgtaaatacaaatttattcatcccttaaccaatgctacttttcctggcatctttttgtagtattttaaaaagtgcaacatcaacaaaacaagagcaaaattctccagaagttttgatgtatgctttaaaattagggttgatttttttttcacactttccaaaacaataagacttgttttacagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtaacaaggaatgtcatgacattttatcatcttctcaacagctgttgtgatatgatgcggtagtatcaatattaagcttatctgtaagattccttgagttcaatttttttttaatcttacaatattctcaaattcttatagagtcactgatatactgaatagctacaggttaacatggaaaaagagagtccttgtgagactcctcatagtgtctatgtttgagcaaagggtgggaggcagccgctggacaccttggtcctggcttccacttgctgaggtcatacaggagcaggcttctatgtccttatgacatacttatattcctctaagagtcactagctttattattcactgaagtaatcagattggactgttaaaatagcaaatgaaaatcagaagggaggtgcagtgacagcgaacccactttttccctttggaccccagttatgaagaaaaaattggaaactgaacttgtgacctataagatgaccctagacccaagaggctgggttgaagagagggcacagctcagttctagcacagccaatgccttttacgtgtgtaatttggtcccaagaagacccagcctgcaagcctagtggaatcagaatagagaaaagttctcattctgcacatacagcattcagagcctcgtcatcatacattatagatggtatagcatccagccaggtaaacagcagcacttgggatcctttgaaaaacaaattcctttgttgttccatctttcctatttggttattttcctaaattacattcttagaatggcagtagacctgcctcttggcagcccgaagtgtttgatctgctaacaaaattatattcttttgccctgttgtttcaaagttaatcttttttcaagagtcttaagtttggtagcccatcagtatcttgccatggcaatcatgtatgatgtgcaggaaaacaaaagttcattcaaagggttttggttcaagtccaccactgggggataccagagaagtcttcttgttttgcctgttggattggatccaaatgaacttctcatgctctgatggcttatccatggttgcacctttcattttttgtttatggtccaaaaatgtacttttgcagaatgtttctctcttgccccaccctgtgggccagcctggagaacagagcctactcccctagggaatatcgtctgattcagctcaattggcttttatattattccttggaactattttatttgtttgatatctaaatgtatgcactaaaaaaaggaacaataaaaaatactgctcaggcatcaaaatgtaaattgtttcccctccaatcaatacttaacacgcatgtacatagttgtttaatacttttataatggaagcagtatttatttgctcagtaaatgaactgtaataaaacttatacctctgaaatgatttacaatttaaaatgtactttttcatgcatactctcaaataatcatcacaacaaccctgcaagataagttatctccattttatagatgagaaaactgaggctcagagacatgaagcctcatagctactaagtgacagatgcaggccttcaaattaattcctctgtctcccaagccaatgttctttccccatttctttctgcctcagttattaaaagaggtggcagtggtgactttaatatggagagattttcctttgtaatttctcaacaaagataaaccttattaatcattaaatcactaaataccaagatttgatttcttacaacagacaaaaaagagttctaaatctatcttgataataaaatgtttagcactttttatttcatttaaatatactcctgcttttcttatgttaaggagccctgcctttgcagtggggaagagggagattctggggacactttagcaatgatacactgctggtatgcagggctgtgtgtgtggtatgaaaactgaattgacctctaggatagaggacaagctgcttgcccactatggccacctgtacttgaatggcaaaagtgatctatacttgggctaagctggacttccctctgctgccctggggtctaggccttcctgccattgagtcatgattttggcttggaattgaactgctctctgaagatcaatttaaaaggaaggaagtacatcactggctaacctttcagaatgccccctgaagcaaggcacagtagatgctaccaaattctgtcaaactccaggtcatcaagtcccctagaatctagaaaaacagctccagataccctctaatgaggaaattaagtaatttcacactattttataaactaaccaaagtttttatttattaaaggtccttaatcaagtgacttcaaggcattcataaacccttgaaactgtatgaaaatgtgtatatgtgcatatatatttatttcctagggacaaaatagcttttattcatatctcaaaagggtcaatgactataagcaacctgaagaatgtgcttgatttctagaaaaaactagtattattttcaatgataagtacaagaatgttaaaggtgatgattaaatgttttattagcatggtacaacttattcacctttagaaaatcattttactgaggtaagaaattacagggagaaattatggacccattggattttttatcacctgagaatgtaaaaagtagataagagcatgataatatatcttatatagaaagaataaggggagtaaatctcatttttaatgacttaaatattagtaatctactataataacaagtgttgacactgtgttttttatatatacaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaagaaccattagcactgttatttgagtaacatcatttcatgtacatatctctgatgggtatgtgtgtactggggtggcagggagtgagagaaagagagaatttcaaaactctttacgcttaagtccatacataatttgttgactgtttcttcaatcctcagtgattcatggtaggggggtaacaggaaggcgataggtaatgcccacagattatacctaacttcattttagtcattatgttgacctctttcttgtttcatcagaattactaatagataaagagatttactgggttttctcagttcctgcttctgtgtttcctctatagaggtttaggcaagagaaagaggcaaaaagttattagcagttgaaagaaggaggccaacagcccaaacagtccacacaggaaatgagttcctaaataaatatgagcttggatgttacaggcaactaagtgattcctgaagatgttttgcttttcttcaagaaaaaagttcaaaataaatggaagatagttatctttttaacaccattataatagttcctgataggaagcggtggttaaagcataatagaccaacagaaatatatcatgctacagtctttgaaaacaatctcaaaaaagacttctaagcatttttatttccaaaaatgcagattctttataaatattattcatgtattttagaagttataactaatcatttggactattccacaccatgattctatactttttgtttacttttcagtcctcattcttcctgacctcaccagtatcaaacacagccaagatccctcctttgccatttcctggtttctatgatacctcactctcctgattacctcctattttctggaattttttatcaggctctttttccagctcctccttttctaccaggcctctaaatgttgtctgagtctgaaccttcttactttaccatctggagccacattgcctggttttgaaacccagctcctccatttactagctgtgtgactttgggcaagtgacttagcttctgtgtgtctcagtttcatcatctaaaaaaataagggtaataattgtaccctcttcatagccttgttgggaaaattaaatatctgatacatgtaaggccttagaaaagtgcctggcacctagaaggtgctcaaaaagtgctacttatcattatagtaataattattattagttaatctcattaatccatatgcctttaataacatctatctgtgtataacctccaaattcataactttaaaattattaaatttagctaaaatctcttctttaagcttaaaatccagatctaaatggctcattaacatcttgaattagatgttttacaggaatcacaaactttgtaatttaatttttgttctttttctccttatcctgcttctcctcccagcttgctcattttagaaacctggaagcttttttttttttttttttttttttcattttaaaccatgtttcttttcttcaccattctgtattcatatccatcaccagcttttgcttgacatctgcagaagacatcttgaactgccactttcttgccctcctctccacaccatctcccatcccaagctgctatcttctctcatctggactattgaatggctaagtggccgccttgttgcttgctgtgctttaattcattctacaccaagcagccagagtgtcctattagaaagcaaatataattttgtcacttcccttcttccctgcagcatgtaacattaaaatctaaaatcactttggaccatgaggtcctgtgtaaacttctctcctgcctcatctcaaacgactctccttgcttttaatttagcttttctaacttgaaacctctttttcacctcagggtttgctgttccctctacctagaatgttcttccctctcttctttagctggacagttcctactcaacctttaggaagcctttcaatgttacctctttgataccacgctaaattactgacccacattattttctttcatagcatcctgtcttctttccttcttacacttatcatactttgtaaatatatgtttattaatatgattaacatgactataaattccatgagggatactgttttgtctgtaattattggcacagcatatgccctccataagtatttactgaggccgggcacagtggctcactcctgtaatcctagcactttgggagacaaaggtgggcggatcacgaggacaggagttcgagaccagcctagccaacatggtgaaaccctgtctctactaaaaatacaaaaattagctgcacgtggtgacgggcacctgtaatcccagctactcaggaggctgaggcaggagaattgcttgaacctgggaggcggaggttgcagtgagccaagattacaccactgcactccagcctggacagcagagtaagactctgtctcaaaataaaataaaataaagatctactgagtgaataaatggatgaattagtgttcaaagtattgtacaaatacactcagttattctagagatgtagtaaagaaaaaaaggtttaagaaagtctcactgtgtcaagaacaagctattcagaagctttgtaatttgtcattttgcctttttttttcttttttgtctcaggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccagggtaggtttgctcatttcattacctatttttccataagacagcatttctaataactaggtcaggggctagtagaactgaaaaaggtacagaggattgttgtgaaaagctctgagttgctgatcaggctttaaatcctggagtcccagaaggacagtgtgttgcctacccctggaatgaggaggccctggctaactcacgggatactaaccactcagaaaccttgactagaagcataaacaccacgtgttatgggtgtctgttcagtagaaatgggctctgcactacagagcatgtgcttcccagtactggaagtgattcattttctgaaagttgggtagtaaatatctattcatatatttatcagtaggctttggggaattttttgcataactcatgcaaaccttggtgcatttttgtttactacttctggccattatgtttgcgaggaagcctgggaccagtcccctgattcagggctttcttattctcgcttgggtaaacattgacggagtactttttctactttcccttttctaaggcttatgttaactttgaggtttctgcctccatcgtctttttccaaattttttacccaatttccacaacaccacttattcagaaattgtatttttcccccattaatttgaattccacctttatcatatactaaatttctgaatgtgttttggcctattttttgatgtgtctattcatgcatcagtaagtaccacagcattttaattactgaggtattatagcatttgtatatctggtagggttagtccttccacattgctattttttagactttatatgctcatttttgattgcttaatttccatatgaatttacaataaacttgactagataaagcagaaatgaggcattttaaataaaatcacataacagaccaggcgcagtggctcacgcctgaaatcccagcagtttgggaggccgaggcaggtggatcacctgaggtcaggagttcgagaccagcctggccaacatggggaaaccccgtctctactaaaaatacaaaaataagccgggcatggtgggtgcatgcctgtaatcccagctacttgggaggctgaggtaggaaaaacgcttgaacccgtaagtcataggttacannnnnnnnnnnnnnnnnnnnaaatcccttggattttaatatgagtcccttgtgtagtgttttaaagttttgcttgtattcatatttctcgttatgtttatttctaaatattttgactttttgttgctgttctcattagtaatttctaataaactagaaaatatactcaaagtgacttaattttcctatttatattttttaatttcagctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaattaaagagtttaaaactttattgaagaatatatataataatgtagactagatctaaattttataaccaggaccaattaagaataaaaattagattatgttttggggtggtggagagggaaatgtggggaattgggacaggaagaaagagatagcatgaagccctaagtgagagactcagaccagtgctggggagaaaaacaaccagcaaatctctctacccaggccacctccttgcagtttatactgatcaagtgtctggcctgttactttctaagtctcacagtgcctacattttcacagatgaaagcttcaagacacttgcagctcaattcctagctggcagtcaatccttcctccctctattgctattatacttgctagcatggaatttgcttctctccagttttaaactgggctagtgaaacacagagacggattgtagtgggtttcaagttctcgaatattttcctcattttacagacaggaaaatggagggttgggtgagtaattcaaagttttatactggttaatggcaaagctatattagaggtagagccaggttctcagactactccttttctcctatttaaggtgtgggagatgccagggtttctacctagagatatttaactgtttcatgataagttagcaggacagcagatctagctttaaagaaacctggtgggttttgttgttgatgttgttgttgtttgtcttccattttgtgggtacaggaatggaacaaatggacttaagtccagaaattagtgagtataagaggcaaaattaaggggttctaatgatattaaagtaacaaacaaatataacagtatagaaagagtgatctcatgaagtgcgtagggtaaacagtgttcagtggttgtaaggagtgaaaatattaaacaaaaagaaagatgtagtaaatgtaggaaaacacagatttagagattccagcagtcaatagaacagagtcacagtaaagaccctgttgattccaaatacctgataaaaaaaattgaaacaatagggcatttggccaaaaagaatgaaaaactatgatgtgctcgctggtcactagtggaataccatgatgtcaatacatgtgacatcattaacagtttgacccaagattgaaagaggaggaagactgtgggttagatagacagttatctgagagagggaagagaagtctatggaattaagcaatatgggcagatattatttttaaatttcagaatagtcattgttatgtagtggatagaaatttgttctggaaagtgaaaagagcattcccccattttttgccctcttcttttagggatagtagaggaagattaattgtctcaatggaagagagacaaaagtaggggatgggagatttttaagagctgctgatatagcctatgcactgagcaggtcactgtttatgtggacactattgactttcccaaaagtacgtttgtacttgcatgttaatagcaaaaagtctaccaaaaaaatttgtgtatgctttatcttttattacaatgcaattattcttagaagagttaacccctagatatatcttacatttaaaacttaatgtgacactgatggtgaagctgctcatatcaaactaatcctcttacaaataacaattataattctggaagaaaatgtagaacacaattctttaagcaatggatcctgacaaaagcaagcag

SEQ ID NO: 13967 - DNA, 31861 bp, Human; identical to SEQ ID NO: 12803

SEQ ID NO: 13968 - DNA, 68444 bp, Human
  misc_feature (1)...(68444): n = A,T,C or G
gtggaagaaacaaagacggtgggctatgaaaaatgatggggagataccagggatcagtagctgacagcatctcagagtagcagcagtctgcataaattttaaaagcacttgagtttctgagggaggaaggaagagaagtggtttggaggtaatatgaggaataggccacagataagaatacctatgagaggaaaaataacctcctgtacttgaaaagttgcaagggaggtagttttgctaagtgataaaccgggtttcagttggaatgggaagttgatgggaacatttacagaagaggctaagaataaaggggaagtggttgatggcagatgttgaaatcaaaagtgtgaagtgaaatggttaggatatttggtgaagagtgggatatggaatcagagtaattgaagcagagagtagcatggagatactagagcaataaacggatgacgcagatcctactggttgtgattgaggtggaaaggattataaagcatgatggaattatcttttggtaatctcttgggtcaaacgtggtgaacggtaagatgaataatatagagctacacaaaccgttcttgtgatatggaggctgctccctaattacaatgctaatatttcatttaggatttttgtattcatcgttacaaaacagggtctgtaggtttccttttagtgttcataatgcttaggttttactaacagggttatgattacctctccaaacaagctgggattttttttttcaagcgtttccatgccctggaaccatctggtctagtgctttttggggtaatgaatatcttcaattgtatttatttttacttagttgatctattcagattttctacattttcttgagctgattttgcttatttatatttttattgatataaagattttttctatttttatttcttgtgccaactgtatgtacattccccccattcccgtttccatactgtttttaggccatttgaaaatctcaaaggttttacaggaaagtacagattgatgaagaaatggccaaaaacgggaaaagtgaactttaaagtgattcaactacaaaacgtatgctactgagcaaatactagtgtattcctcgctctgcggcttaactccatgaaaatccgtgcaaaggttttagcgttgggattgtgaccgactcggtgaagagaggggacgatcaccaaaccgttagagcactggggctcttggcagtgtttgtcagttattttcaagtgataacttgaagtgataccgcaggaataaaatgctgtatccagagctggtcggaacgagcactacctttaacaaaagctgaaaagatctgcctaggaattcgttagaatacagccctcttacgtctctgacatacctagttatgtgaaccgagactgtgcagctgacggtggaaatttcctaagtgctttttaaacaacagaactggactccctccctcctccattcccagtcgaatacgtcccacccagatccagctcaagggtgcagcacttgttccggccagctcacaatcgccctttggaagggaggtttcccgccatttcgcttaggaggagggtgaactcttctcccttcattctccactcgctgggggcccgagcccacaccaccttcctagcaaagcaagcagcgggacgccaaggccagcaggccgcattaagaacgctggactgagccaaaagcctacacagaccaagccgctcgggaaaggatcaacaactgccgacaacccggagggcgaaaacgcccgcggcgtaggggaagcaaactaggagatgcgcgggcccagcgccagcggcgggaggagggagcgcggccgtcgcaggcgggagcgaaggcggggacggagggcgggctcgctccactcgactccggattggtcgagcttagagagccgagtgacgtcagcgggggagaacgcctgatttgtgtggtgggcgcgggcggtggggggaagcgcagtgcgcaggcgcaactgcctggctctgctcgctccggcgctccggcccagctctcgcggacaagtccagacatcgcgcgcccccccttctccgggtccgcccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactgggtaagttccctggcttgtttggcgcccgcccctttttcaggcagttcagggcttttatggcaccagccccgcgtgggcccccggcacccagagcgcaaccaaagtatacactgatggaagtgactaaaagctgtaatagcgctttgctgggtggaggtccgggcaaaccaagcggccttggggaagataggattgccgtctccctgcagcctattcttgctttatttccatcctccaaggatcaatgggaagcagtccactcccttccctgcttcactttggtggcaaccagaggaaacgtgtttgaaacctggcgccagattttggccaaaagataaatcgatgttgcacctgggccaggcgaaggaaaaactgtagtgtttccttagagaatctgtcataattctgctcctgaaagtcttatccctctcggttgcctcctaccggtggtgtcagttctccagattgacccgggattgctggggttggttgctggagtaaagcgtaagctaatttagaagggctgaaacgtaaccatccggcaacttaaagttttggaaggaattccgttgtaatgatggtgagatgtttttaggatcataaacctgtactgcttatgaaaactaaaaacgcggaacgtgttgttacctcttaaaaactggccccgtgttaagggtgtgcgttagattctgcttgggttttctttttggaaattgccttagctgattgctttcagatagttcccaaccggttgttcctagtttaaaaagtacttataaattgtaactgcccatcaaaataagaaaaggcaaggaattactgtatgctagaaggaaataaaggtcttaaatgtctaaaaatttcggtgtagttgtagtttcatctaagtttttttaaatgtttgtaaagcaggcaggatttctgtgcccaacatttacagaatcatcttacagcattataattgcttatctattgcagtgaataaatggcatgcatctttgttagagcaaagaagacaatacttccagtggtgggaaaaaaccttgtttatggcagcataataacgttgctttattttcagcagagggatagagacatagagaaaagagttagatttagcaaatacagaacatttttagaaaggtattgtcatagagttgtagattagccggtttcaaagtctgttttccatttgcttggctttctgccaagagttagttgattgactcaaaaaccagccactaggcttgttggaggcgtttcccatccatcccaggggcccctctttatggatttattttgtttttgtgtaggcaccgtagagctgaaagcactgtagtgtattgtagaaatatgtgatatcattgactgcagggcaacgagaagtcgacagcagcacaagagaggaagactaggcacagaactatttagagtgctgtttattttgcagtatacttggagtaacatgaatttgccatatgtttgaactttaaggataaaaaatctttaaggtataaactccgttacattagtattaaatttttttttttttaagagacgggcaggggcgggggacgggtgtgggccgccttactttgttgcccaggctgggcaacaagcgatcctgggctcaagcgatccttcctcctcggcctccgaaagtgctggaattacaggcgtgagctaccctgccggaccttcaggaacattttttaataaagcaggggccatgctgttaaatgtaaatatgtatggtttagttttacatacacagacttttcgaattaagctgtcactcttatgatgcataaagtttagagccttatactccagaaaaatgttaaagtttgttttgtaccacagctagacctcagacttcgtcctcaaagcttgaaaaaaaaaaaaaaaaaaaagtatgctaattattttgggagtcttgacaaaggaaacgaaggtttaaatttttttttcaatcacaaattcttggatggctccacattttctgtaaagtaaactgtagtttgcaatctgcaggccaacccctttcctgtacatattcagcctctccagtaaattatatttgttacacgaatttccattacattagtctctactcaccttttttcaggacacatggaaatactccatttccattttcttggattctgcctctctcaccctgcccccccaacaaggaaaactcaaacaaaaatatatccatcatgtagattcccagtcagtatgttttcttctgtgaagactactttcttttggaattgagcacccttttttctacttttgtagtgctcattggattgtagtaatagttctcaaactttttgctctcagaaccctttatatgcttattgaggaccccagagagtttttatgtgggctacatcttccagtatttactatatgagaaatttaaacttaggcaatttaaaaatatttctttaaaaacaaacttatatgtttatatatatattttaaagaaaaaacacttttttccccaaataagaaatagtggtgggaggagtggggttgttttacattttgcaaacctctttcaatgtctggcttaatagaggacagctgaatggccgggcgcacgcctgtaatcccagcactttgggacacaaaggcaggcgaatcacctgaggtcaggagtttgagaccagcctggccaacatggtgaaaccttgtctctactaaaaatacagaaattagccgggtgtggtggtgcatgcctgtgatcctagttactcagaaggcttaggcagagagaattgcttgaacccgcgaggcggaggttgcagtgagctgggattgggccactgcactccagcctgggcaacagagtgagactccgtctcaaaaaaaaaaagacagctgaattatcatatccacttctgcactcaatctcttgcgctatttggttgaagtatctaaagaaatagcagccccacatgcatatgtagtaggaaaaaggagaaatattttattagtcttttcagataattgtggatattctgcactaaaatggtagctattttcccccccagagaaaggtggaagaaaagtagtttcttaaagtttgctgaattggaatttgaaaccttagtaatgaatttcatacttaatacgttaagatccattggtctattttgtactttgaacgaatctcatccatgtgtgatttttgtgacatagtgcattagttatttggaaaataatggttcactcagttaagaacgtcctctgaatagcaacacatttcattatacaatatcaaagaaaatcatgtttgttaatatcactgatctcatcagaaaactctttaaatattgggaagctatctagttcactgttgtggatacacattatccaaaatgtatttttcaagcaacaattagaaatgtatcattgagaacaaatactgtcagtttttcttgaagcgaaaagctcactttgttcatgttgaagatgtacaccaaatgcccaagtcttattaacacagtttatcagtctctcaagtaaagatgatggtccatgaaaaatgtggctagttcattacatgactcagacaatcacaggtgcttttcctgtagtatgtaacaaaagcctgtttatgtagtctcctttttgtcatatagaatattaaaaagatatgcagcctgggcaacatggcaagaccctgttgctatacaaaataaaaaattagcttggcatggtagcatgtgcgtgtagtctctgctactccagaggctgagatggagggattgcttgagcctgggaggtggggttacagtgaaccatgatggagcctgtgcactcagcctgggcaacagaagaaaaaagtaggtattcatgggttgggatttaatacaattaatttttattgtgtcatcaaggatattctttttttaattttagtttttgttttttgagacggagtctcactgtattgcccaggctggagtgctgtggcacaatttcagctcactgcaacctcctcctctcaggttcaagcgattctcgtgcctcagccttctgagtagctgggactacaggcatgtgccatcatacccagctaatttttgtattttttttagcagagatggggtttcgccatgttggccaggctggtcttgaactcttgacctcaagtgatccatctgcctcggcctcccacaggcatgagccaccactcctggccaggaatattcttaagtgaaactagcttgctttttttggactgtaattaggtagctgtgaagaatgcagtgactaatggctcaatctggtgccactgccttgactcctgccaaggtaccagtagtttaccagccattgctttctaccatcagtacaaatgtcagcacagtgaaaagggcaaataaactcttagaattattatgaaaatagttttggccttgtagaatccctataaagattacacagaccactgggagatgctagtctgctatagtatctgcctgtcagctaaatcttgaggtctttggggccagagatactgccttactcatctttaattgttttaggattggccacataataccttgcccaaagtagctgctcaacaactagttgagtttagttgaatttctgttgagtgtaagtaaataaatggactttcttccattttttaattaaaatttctccttttaaaaaattgtgctaaaatacagataacataaagtttataccaggccaggcgtggtggctcacgcctgtaatcccagcaatttgggaggccaaggcgggcggatcacccaaggtcaggagtttgagatcagcctggccaacatggtgaaactcagtctctattaaaaatacaaaaaaattagccgcacgtggtggtgtgtacctgtaatcccagctactggggaggctgaggtgggagaattgcttgaacctgggaggcagaggttgcagtgagctgagatcacgccattgcactccagcctgggagaagacgcgagactctgtctcataaataaataaataaaatttataccattttagccatttttaggtatataatttagtggcgttaagtgtattcataatgttgtacaaccatcaccactatcagttttcaaaacttcatcagcccaaatagaaactctgtgtccattaaataatatctcattgtttccccctttcccatctctggtaacctccccattctactttgtactgctatgaatttgactattccagtactccatttaagtagaaaagtgttcttttgtgtctgacttattttacttagcatgtctttagagttcattcatattgtaccatgagtcagaatttctgctgaataatatcccatcatatagatgtatgcatgccacattgtgtttatccagttttctgttgatggacatttgggttgtttccactttttggctattgtgactagtactgctgtgaacattggtgtacaagcatttgtttgcatcccagtttttcaattcttttgggtatgaacctataagtggaattgctggatcatatggtaattctatgtttaacattttaaggacttgccaaactgtttacacagcagctgtaccattttacattcctaccagcaaggtatgaaggcttcaatttccccatattctaacgcttgttaacttttgtattaaaaaaaaaaatcctgatgaatgtggactgtcttacattttaaaattatagcttttctatgttactgagcccttcttgaattatttggtgttaagcttgacctctcttgtctttctaatgatgtgtacgcctcccaaatttacaaaggaaaattttttaaatggcttatttttgtcttgaggtagggagatttggtaaatacagtatggaatgaaagagtatataaatatattctttttttgtgtgtgtgacagggtcttgctctgttgtccaggctggagtgtaatggcatgatcaaaggtccctgcagccttgacttccttggctcaagggatcctcctgcctcagcctctgaagtagctgagactacaggcatgtgcctgcaaagtagctgagactacaggcatgcgcccagctaatttttttttttaattttttttttttatagagacagggtcttgccatgttgcccagggtggttccttaccctgggttcaagaagtcttcccagcttggcctcccaaaatgctgttattacaggcataagccaccacatccaggcctgaatatattctttattaaaaggtcattatttttcttttttctttattcatgatcataagttttaggttatgcctaatttatactcacatatatatgtttactgcccttttattatgcttgccttctaagaaataagtttttttgtttgttttgttttgttttatttttgagacggagttttgctcttgttgcccaggctggagtgcaatggtgcgatctcagctcactgcaacctccacctcccgggttcaagcgattctcctgcctcagcttcccgagtaactgggattacacgcatgtgccaccacactcagctaattttgtattttcagtagaaaagaagtgagactctgtctctggggtttctccatgttggtcaggctggtcttgaactcccgacctcaagtgatccacctgcctcaggctcccaaagtgttgggattacaggcgtgagccaccgcacctggcaaaaataagttttaaagtttgtataggcttttttaggtttacttattggaaataatgttttcattgtcccttcttttgatagtttaaagaagatggtgaatgaagtgcagcttttagctctgtgtcatagtcttatcaatagagtcaatagaaagatgacattctgcaaagggtgatctctggtgtgattacagggaattggccacagtatttgtaaaggaagatgaaatacaaaagtttcatttgttaacttggactgaagatttagagcattcattttaaaagagtatgaccaaggaaatcgtgaagaagttaatcttaacataaattgttggttctagatttggcattactttaatttaaaatggaaagaaaccaaagtggggagagagaattgaatttggagaaacctcttaaactatagaattttaaatgtgtatcttgttttatgttggttgttcgcattttttcatcataaaggatcttcaccttctcataaattatacgttctgaaagagttgtgtgccatattacttatcaagttcaaatttattttttctattttcattatcagtcattacttttgatccttattaggtagtctctccagaattgatatcacttagagaaatagaagcaatttaaattctcattagtttctacattatgcaggtaaaactagatttctttgcatctttatattatgaaatattcaaaaagatgtaaaatgattaaacaaacacccatccataactcagcttaaaaaataaaacattaccaggccgggcatggtggctcacgcctgtaatcccagcactttgggaggccgaggcaggcagatcatgaggtcaagaacctgatgaaacccagtttttactaaaaatacaaaaaattagctgggtgtggtggcatgcgctggtagtcccagctacagtgagctgagatcaacgacactgcactccagcctggcaacagagcgagattctgtctcaacaataaataaataaataaaataataaaacattaccagtatagttaagccccttctctctgtgtcatattacatctttttcactccccatgaggggcaactgcttctatattcagtgtttatcatcctcactattttttttataattttattaggtatatctttttttttttttgacacagagtctcgctctgtcgcccaggctggagtgcagtggcgctatcttggctcactgcaagctctgcctcctgggttcacaccattctcctgcctcagcctcccgagtggctgggactacaggcgcccgccaccacgcccggctaattttttgtatttttagtagagacggggtttcaccgtgttagccaggatggtctcgatctcctgacctcgtgatgtgccctcctcggcctcccaaagtgctgggattacaggcgtgagccaccgcgcccggcctttattatgtatatctttaaccaatatacagtacattttgtattttgtttgtttgtttgttttttaagacagagtcttgcttaatctcccgggctggagtgcaatggcgtgatctcggctcaccgcaacctccgcctcctggattcaagcgattctcctacctcagcctccccagtagctggaattacaggcgcgcactaccacgcccagctaattttttgtatttttagtagagatggggtttcaccatgttggccaggctggtctcgaactcctgacctcgtgatccacccgccttggcctcccaaagtgctaggattacaggtgtgagccaccgtgcccagcctgcatggtttttataacttatatatgacatcttactatatgtatgctattgtcatcccttatgtgttggtttcactttctgcagtttgttaactttgttcaatgttgaaatattaaatataaaattctagaaataaacaatttgtaagtttaacttgtgtgctgttgggagtagcatgatgaaatcttgtctcgtcccactgtgtcagccctggatgttaatcatttctttgcccagcatatctacgctgtatatgctacctacctgttagtcacttagtagcttgttagtcacttagtagccatcttgggtgtggttatcggatcaactcttatggtattgcagtgtttatgttcaagtgactcttattttacttaataatggacccaaagagcaagagtagtaatgctggcatattgttatacttgttttattttattaatgttgttaatttcttactgtgcctaatttataaattacattttatcatagatacgtatgtataggagccaagcacggtggctcacgcctgtaatcccagccctttgggaggcagaggtgggcggatcatgaggtcaggagatcaagaccatcctggccaacatggtgaaaccctgtctctactaaaatacaaaaaactagccgggcatggtggtgcgcacctgtagtcgcagctactcaggcggctgaggcaggggaattgcttgaacctgggaggtggagattgcagtgagccgagatcgtgccactgcactccaacctagcaatagagtgagactgtctcaaaaaaaaaaaaaaaaaagatatgtatgtacgtataggaaaaaacatagtgtatataggatttggtactatccaaagtttcaggcatcctttgggggttttggaacatatgcccctgcgataagggggtactactctattcttctgggtcttacttttttggttcagtattgtatgatttcttcatgttgacacacgtagctctagttcgttcattttcacttatggatagtataaatataccaatattgtgctcatccattgtatccttgaaggatatttagttttacaactatttataattaaaaacaatgatgtttggaatatttccgtacatgtctttggttgttcttcaaatatctgaggggttctctgagagcccaggtttggcaaagtaaagcctacaggccgcattgggctaccaccaatttttgtagataaaattttttttattggagcactgccaagatcatttgtttatacaatgtctgtaactgctttcacacttcaacagcagagttgaatagttgtgacagataccatatgttttgcaaagccaaaagtattttctggtctttcatagaaaaggtttgctgaccctgctctagtgtactaggggaacaattgctgggtcatgaggtatgatatcttggacctcactagatattgccaaattgctttccaaggtgtttatacctgtttattcccctgaagaagtgtaggagagtatcattctttcaccttcttgccaatacttgaagtggtctgcattttatggtggtgaaattatatcttattgtggttttaattctcatttccctgattcctcataagattgagtacattattatttttgagacggagtctcgctctgttgccctgttgcccaggctggagtgcagtgcctcgatctcagctcattgcaacctctgcctcccaggttcatgcgatcctcctgcctcagcctcccaaagtagctgggattacaagcatgcaccaccaccccagctaatttttctatttttagtagagttagggtttcaccatgttggctaggctagtcttgaactcctgacctcaagtgatctgcacgccttggcctcctaaagtgctgacattataggtgtaagccaccatgcctggccatgttttctttttatgaaataccttttaatttttttgcccatgttaacactgaattgttttcttgctgatttgtagaaattctttatgtattttgtggggtttttttgttttgttgggtttttttttgagacagggtcttgctctgtcacccaggctggagtgcagcggcacgatcttggctctgcctcctagtttcaagcaatcctcctgcctcagccacttgagtagctgggattacaggcatgtgctacaatgcctgactaatttttgtgttttttgtagaaatggggtttcaccatgtttgccaagctggtctcaaactcctggcctcaagtgatccacctgcctcggcctcccaaagcgctgggattgtaggtgtgagctgccacgcctggcccaaaattctttatgtattttggatactaattctttgttacagagttagcaggtatcttccagtttttagtttgtctcttcacttcgtgatgtttattaatgaacagaagatgttaaacttatgtaattttattaatcattttcttgatatctcatgtttttaaagatgctattgtgttctcttctaagaggtatacagctctgctttcacaattaagtcctcctatcatttttgtttttgtcctttacctatgtgctgtccaattgactggagtacacatgtagccactgactacatgtagtcagtggctacatgtgggtatttaaaaaaagaaaacagatttatagaggtataattgacatacaataaatggtacacatttaaagtatactctgataatttttgacatatgcgcatgtcaagccatcatcacattcaaagcaataaacatctatcacgcccaaaagtttccttgtgaccatttgcaattatcccacattctccaatctccatttctaggtaaccactgagccgctttctgtcttgtagattattttttctataattttatatacagtcatatgttgcttaacaacagggatatgttctgagaaatgtgtcttaggtgattttgtgttggtgtgcgaatatcagagtgtactgacacaaacctagatggtatagcctactgcacacctagattgtatatagcgtgttgctcctaggctacaaacctgtatgcaggtggtatggtatcattgttaacttcctgattttgatgggatcgtagttatgtaggagactgtccttgtgtgtaggaattaaatactataaatatttaaaattgatgggatttggtggtttacacactattgcttcaagaaaaagaaaatagaattattcttgcaaaaaaggaaaggtaaagctgaagatataaaaagatcagaaacccggatacttttaggaatctaggtagcagtttcatcagggtcttgctgctggatgtgtaccagataacagtctgttttttttttcaatgacgagaataaataagaaacagcagcatttggagtcaccatttggttatgataattcactgtcattttccaagagctatcagacttttgcagtggtcaaactatgtaataggaatagatgggatttaccaccccttcttctttcatgttttagtggtggcaggaatctttgttattctttgaaggatgcgacagtgcttttaaattattagtttggagtagagtctcattgttgaggtgctccaaagtcttgcacttggccttttctaccataataggcttcctaacctatcagttaagagctttcaggagaagctattagtttttgtccagctagttgatattccattcagtctgtggaattggggaattgtgtactatgtaatactaaatagtattactgcttaaataaaccctttaaataagggctaaagtgaaagcagtgtagccttttttttttcatttggactatttcttcagaaaaaaaattctcaaaactgaattatttgcttaaacaatgtataccttttgatggttgccaataagtattttcaaattgcttccctgaaggctttacatctccatactactttggaattggaattctgtaagaactcttaagtgattgagagtatgtgccctagagttgtactgcctaggttcgaattccagcttctccacttactgagagttgacagcgtgctggcagccctcgctggctctcagcgcctcctcagccttggcgcctactctggctgcgcttgaggagcccttcagcccgccactgcactgtgggagcccctccctgggctggccgaggccggagccggctccctcagcttgtggggaggtgtggagggagaggcgcgggtgggaactggggctgcgtgctgcacttgtgggccagcgcgagttccaggtgggcatgggctccgcaggccctgcactcggagcggccagctggcgctgctggccgcaggcagtgaggggcttagcacccgggccactagctgcagagggtgcgccgggtcccccagcagtgctggcccaccggcgctgcgctggatttctcgccgggccttagctgactccccatgaggcagggcttgggacctgcagcctgccatacctgaggccccccccccgccacccccccgcctcacacagcccaagcctccccgatgagcaccaccccctgctccacggtgcccggtcccgtcgactgcccaagggctgaggagtgcgggcccaagggctgaggagtgcccgggtgggcgcaaggcccgggactggcaggcagctccacctgcggccccggtgcgggatccactgcaaagccagctgggctcctgagtctagtggggacttggagaacctttatgtctagctaagggattgtaaatacaccaatcagcactccgtatctagctcgaggtttgtaaacacgccagtcagcaccctgtgtctagctcagggtttgtggatgcaacaatcagcactctgtatctagctaatctggtggggacttggagaatctttatgtctagccaaggtattgtaaatataccagtcagcactctgtgtctagctcaaggtttgtaaatgcaccaatcagtgctctgtgtctggctaatctagtggggacttggagaacttttgtgtctatctcagggattgtaaatgcaccaatcagcaccctgtcaaaacggaccaatcagttctctgtaaaacagactaatcagctctctgtaaaatggaccaatcagcaggatgtgggtggtgccagataagggaataaaagcaggctcagccaacattggcaacacggtggggtggcttccacaccgtggaagcttagttcttttgccctttgcaataaatcttgctgctgctcactgggtccacactgtctttatgagctgtaacactcactgcgaaggtctgcagcttcactcctgaagccagggagaccaccaacccaccagaaggaacgaacaactccagacgcgcagcattaaaagctgtaacactcaccgggaaagtctgcagcttcattcctgaagccagcgagaccacgaacccaccagaaggaagaaactccgaacacatccgaacatcagaaggaacaaattctggacacactgcctttaagaactgtaacactcgtggcaagggtctgcggtttcattcttgaagtcagtgagaccaagaacccaccaattctggacacattactacctttgtaaccttcagtaaaactatttgcaccagggtatccttacctataaaatagagatgttataacaatttattggtttttgcctttatgacatgcatattttcttgcttaagaaaattttccttaggctgggtgtggtggctcacacctctaatcccaacactttgggaggctgaggtgggcagattgctcgagcccaggaattcaagaccagcctgggcaacatagtggaaccccctctgtacaaaaaatacaaaaattagctgggcgtggtggcgtgcacctgtagccagcccaggcaaacccagctgcttgggaggcccaggtgggaggatcgcttgagccgaggaggcagaggttgtggtgagccaagatcatgccactgcattgcagcccgggtgacagagtgagactctgtctgaggaaaaaatgaaaagaatacttaagtgagagttagtatactagatggtgctgtcttttaatgcacttctcgttttatgtcattaaaaaaattaaaatataaagtaggaaataaatactatagttaaggaagacaacataaaaataccagttgcttaatatataaatttagtgcagtttcaatcagaatctcaagaaggttttttaattttgcaagttgctactaaagttcctttggaaaagtatgtgggagaattttctttttacttttttttttttttttttgggtagagatagggtcttactatgttgcacagactggtcttgaactcctgggctgaagctatcccctcctgccttggcctgccaaagtgctgggattacagatgtaagccaccgcgcctgcacctccctcccccttttttaagcgacaggatctctgtgttgtccaggctggagtatagtagctattcacgggttcaatcacagtgcactatagcttctaactcctgggctcaagcatcctcctgcctcagcctcacaagtagctgggactgcaggcatgagtgactgcacccagctatgtaagattaatttttttgtttttgttttttttggaggcagagtcttgctgtcacccaggctgaagtgcaatggcatgatctcggctcactgcagcttctgcctcccaagctcaagtgattcttgagcctcagcctcctgtaactggggttatgggtgtggtggcacacaactgtaatcccagctactctggaagctgaggcacaagaattgctttaacctgggtggcggaggttgcagtgagctgagattgagccactgtactgtagcctgggcgacagagcaaggctctgtctcaaaaaaaaaaaaaaaggaaaactaaaaagaaaagaaaaaggccaggttcagtggctcatgcctgtaatcccagcactttgggaggccgaggcggcagattactgaaggtcaagagttcgagaccagcctggcgaacatggtgaaatcccgtctctactaaaaatacaaaaatattagcctggtgtggtggcacatacctataatcccagctactcgggaggctgagacaggagaatctcttgaacccaggaggcagaggttgcagtgagccaagatcacgcctctgcactccggcctgggtgacagagtgagactgtctcaaaaaaagaaaaagaattgagggatacttaaactaccaattattaaaaagtactataaatagattagtaggatgagtttagaaatagatctaaggcaaaatgtagcatataataaaggtgacatttcagatgaatagggaaagtatgaattagtcatttttaggtcattgcaaaatatctctttgttcatgttaggcttttgaccaaaagtgtgatttaaataatattgcatctaaggatatttatttttagctcgttttttcacttgccattttgttttaggtgatttttgtgaatggctgaattatttgtatactgtaggtaaattttgttttgttttctttcttttactctttaggagactgagtcttgctctgtcgcccaggctggagtgcagtggcacgattatagctcactgcagccttgaactcctgagctcaagtgatcctcctgcctcctcctctgaagaagttagaactaacagatgcatgccactaaacctggttaattaaaaaaaaaaattttttttttttttttgtagagacagaatgtggctgtgttccccaagctggtctcctggcctcaagtggtcctcctgccttggcctcccaaagcactgtgaatgtaggcatgagccactgtaccctgccaaattttgtgttttgaatgtgctgtagaacttctgagagttcgcctcatttattcattcacatttattgtagtagaagttttttttttgtttgtttgttttttaatttacttcagtttgtttaaaaagaaagaggatagccaggcacagtagcacatgcttatagtcccagctgcttgggaggctgaggcaggaggattgcctgagcccaggaggtcaaggttgtagtatgtgatgatcacacctgtgaattagcctgcactccagcctgggcaacatattgagaccctgttgttaaaaaaaaaaaaaaatagaagaaagggttttatcaaaagctagtaaacaccccaaataattgaaagggctgaagaaacatacagtatactctaggctgagcttccatgaaataacttctgcaaccagattgcaaactggatgggctatgaagctgtccttgctgtgatttctgccggcaaaattgataccttttctctgctttttttttattttaaatattgcaaaataagcatatgtatagaaaaggtcataaaacataaatgtacacttcaatgaataattataaactgaacaccatccagttaggaaagaacattgtctgcactgcagatatctgtatgtcctttctgatttcatatttctatctccccctaaaaaactaccttcctgactttcatcatgagagttctgtaatggtttacttgtttttcttaatagtttcaccacttttctctaaacatgatggttgtttttgaagaaagtcatgctctatgtgttcttttatcatgtgctgcttgtgagattcttgtgtgctttatgtagtattgtccattttcatgttgaacaacttgggctgttgcccatttgtagcccttattattgttttagagacagggtcttgctgtatttcccaggctgtaaactcctgggctcaagcgatccccctgcctcacagcctcctgagcagctggtactacaggcacatactaccatggttgactcatgtatttgttgtgtatgtatgttaatttgtggtatatacctaggaggtagtcaaagagtatacatatctttacctttaataagtaatgcctaaatgttacctgcaatgtaccagtttacactttcacagtagttgatgatagtacatgttgctccattttcttgaccacagttcggttgctattgtcgaactttaatttgtgcggtcttgtagttatgcagcactatctcattgtggttttaaattagtatttctctgataattaaagaagctgaatacctttgcatattttgtggctgtttggatttcctattttgtaaaaggcttgtttaagctttttgtccattctcccatttgggtagtctgtctcattgatttgatttgtaggaaaattttatatattctggatgcttttcctttggcgcgtaggtgtgtgtattctgttctctgtgttgtttttattctaataatggtatcttctgaagaatagatttttttagttgcttttaaaaaagatgtgcaatgtgatagatgattttatgtatgtatacattgtgaaatgattaccacagtcaagttaattaacacatccatcacctcacatagttacctttttttggtggtgagaacactcaagatttattttcagcaaatttcaagtatacaaaacagtattattaactatactctctgtgttgtacattagatactaagaacttactcataatgggaagtttgtgctgtttgaccaacatctccccacttctcctaacccctaatccctggcaaccgtccttctactctttccttctgtgactttttctttagattccacgtataagtaagatcacacagtatttgttttttctgtgtttggcatatttcacttagcataatgtcctacaggttcatccttgtgttgcacatggcaggatttcctttttttttttttatggctgaacgatattccattgtgtatacatacattttctttatttatttatctcttgctggatacttagattgttttcatatcttggatgttttgaataattctgcagggagtgttgaggtacatgtatctctctgagagactgatttcattttctttggatatacattcagaggtgcaattcctgagtcatatggtacttctatttttagatatatttttaattctataatattttccataatagctatgccaatttacatttctatcagcagtgtacaaatgttctcccttcttcacatcctggccagcacttgtttactgttatctttttgataatagccatcctaataggtgtgaggttatctctctctttatttttttaatttttttttagatgggtcttctcgctctgttgctcaggctggagtgcagtggtgtgatcactgtagccccagactccttggctcaatggaaccttctgtctcagcctcctgagtagctaggactacagatgtgtgctaccatgcccggctaatttttaaatttttagtggagatgggtctcgttatgttgtctatgctggtgataaattcctggcctcaagcgatcttcctgtctcattttgtttttgatttgaatttccgtcatgatgcttgatgttgagcttctgttcatatacttgttgcccatttgtatgacttctttgacaaatgtctattcaggtcatttgcccagtttttttttgtttttgtttgttttgttttgttttgttttgttttgttttgagacagagtctcgccctgtcgcccaggctggagtgcagtggcatgatctcggcccactgtaaactccaccccctgggttcaaactattctcctgtctcagcctccccagtggctaggattacaggcgcctgccaccatgcctggctaatttctgtatttttcgtagagacggggtttcaccgtgttagccaggctggtattgaactcctgacctcctgatccacccacttcggcctcccagagtgctgggaatacaggcatgagccaccgcgcccggcctgcccagtttttaactgtgtttttgtttgtttgtttgttttgctattgagttgtatgatttccttatatattttggatattaatatcttaccacatagtgtaaagtttgtaaatattttctcctgaaagttgccttttcattttgttgatggtttcctttcccgtgcagaagccttttagtttgatgtagcccaactgtttttttctgcttttgttgctgttttttttgtttgtttgtttgtttttttgagacagagtctcgctgtactacacaggctggagtgcagtggcgtgatctcagctcgctgcaatctctgcctcctgaggttaggatccctcctgagctgggattacaggtgtgcgctaccatgcctggctaatttttgtatttttagtagagacaggctttcaccatgttggtcaggctggtctagaactcctgacctcatggtccacccactttggctttccaaagtgctgggattacaggcatgagccactgcacccagcctgttgccatttcttttggtggtcatattaaaaaagtaattgccaagaccaacgtcgagatttttccttatgttttttttctaggagttttgtgctttttgtttttcttttcttttctttctttctttttttttgaggcagattctcgctctgttgcccaggctggagtgcagcggcacgatcttggctcactgcaacctccacctccaaggttcaagcgatttgcctgcctcagctgcctgagtagctgggattacaggcgcacaccaccacatctggctaatttttatattttcagtagagatggggtttcatcatgttggccaggttggtctcgaactcctgacctcaggtaatccacccaccttggcctcccaaagtgctgggattacatgtgtgagccaccgcatccggcctgagttatgctttcaatgtatttcttacatttcagtttttaatcactttccagttaatttttgtgtatggtataagacaagggtacaatttcattcttttgcatgtggatatccaggttttccagtgccatttattgaagactatccctacctcagagttttgtttgtttgtttgtttgtttgttgttttgagacaggatctcactctgttggccaggctggagtgcagtggcaccatctccactcactgcagcctccacctcctgggttcaagtgattctcccacctcagcctcctgagtagctgggactacaggcacacatgcctggctattttttgtatttttttttttttttttttttgagacggagtctcgctctgtcgcccaggccagactgcggactgcagtggcgcaatctcggctcactgcaagctccgcctcccgggttcacgccattctcttgcctcagcctccagagtagctgggactacgggcacctgccaccacgcccagctaattttttgtatttttagtagaaacggggtttcaccatagtcaggatggtctcgatctcctgacctcgtgatccgcccactttggcctcctaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctcaaaaaaaaaaaaaaattatcggccaggcgtggtggctcacgcctgtaatcccaacactttgggaggccaaggcgggcagatcacgaggtcaggagatcgagaccatcctggctaacacggtgaaaccccgtctctactaaaaaaatacaaaaaaattagttgggtgtggtggcaggcgcctgtagtcccagctatttgggaggctgaggcagaagaatggcgtgaacctgggaggcggagcttgcagtgagccgagatcatgccactgctctccagcctggacgacagagcgagactctgtctcaaaaaaaaaaaaaaggaacactcatttactgtctttattactgatttttctttttgcttatgttggattacaagtctgcatttttattttttttcttaacataattctattcctttaaacttccaggaattcttcatctttgcctatgacctttctgtgtgtgtctatatgttgtggatttatttctaacatttacattctgtcctttcagtgggattttggtggggagaatatgtcattgtttggactcattttgccatcatgaactataagttgcagtttgtttagtgttacataatacttcagaattgttgaatgacagtgaatttaattaaacagtatagggtttgtaatttaatatacagggattctgcccctaaatatttgagttatctgaagcaggtttcttaattattcaaagtattgatatccttatctgcaaaatgaggaataagtaaataaataaagggaataatcatatctgtctcataagttcgtcacaagcattatttgagataatacatgtaaagctcttagtatagaacttggtatacagtgaatatactcagtaaatgtaatttgttaagtagtgactattcaaaatagttatttcaaaaacaaatcaagccgagtgcggtggctcatgcccatgatcccagcactttgggaggccgaagcgggtggatcacccaaggtcaggagtttgagaccagcctgaccaacatggcgaaaccccatctctactaaaaatacaaaaattagctggggatggtggcaggcgcctgtaataccagctactcgagaggctgagtcaggagaatcacttgaacccaggaggcagaggttgcactccagcctgggtgacagagtaagactcaatctaaaaaacaacaaaacagaaaaacaagtagctttttcagaaagccttttagaagagatatgagtaaacagatgctaagtggctggctaaatgataccacaactcttgaatcaaaactgattcagattaaaaaaacctcttaacacattctttcctatcaatgtagttaggactaagagtcatgtagcagtagtaaacctgtcctgtaatatatttctcttaggattggtttgatagttgtatcataattgcattatttataacattaatttattaatgtattcattaattaacctaagtcctttagtagttttcagaatatttttcttaaattgtttcctgtgctaattcgaatgttaacatgctaattcagagtttgttgccatttgtatcctgacagtgtattaatgtttatacttgcaagagtgaaatattttatttcttattacagcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggaggtaacattctgtcgttttctctttcctcttttggttctatttagtccttttatgctttactaatgaaattgacctactactgtcccttttactgaagttactttcttagtattacaggttttttagtttgtctgatgtaatactcatgtatgtatgttcatatttttctcattactatgaattgacttttatttctgataatgactctaataggaaataatatttcagtgagccccaaggaaacaattcaaggttttactgaaaacctttcagatgactttcagaatctagacggagcagctcttggagttccagagtagaacactttgaatctggctgggggaaaaagattaagttagaattaaccttcagcttttttcattgatttcagatttactgcaaacctttccagttattgttttctttgtttgaacttagcgtttcaatgtgtaagtaatttgtaaactaggaactgaaattgatttcaattttatatttttatgattcaaacttaaatgaaagattattctaaaaatcaagagagtgaataacatgaaaaaatttaaaaattatctcaatactaatttttaaaaattgaggatatgaggcaagttgagtagaatccaatgttttctaaataatccttctaactaaagccttcccatgatatcgttacttgcctcttttttgcttttattaaatcaaaattggtcttttgcagagaaacgacaaactaaggaaaataattagcatctggctgggcactgtggctcacacctataatcccagcactttgggaggctgaggcgggcacatcacctgaggtcgggagttcgagaccagcctgaccaacatggagaaaccccgtcgctactaaaaatacaaaattagctgagtgtggtggcacatgcctgtaatcccagctactccggaggctgaggcaagagaatcacttgaacctgggaggcagaggttgtggtgagctgagattgcaccattgcactccagcctgggcaacaagagcaaaacaccatctcaaaaaagaaaaaagaattagcatccttaaactataaggagttcaacaaattaataaagtactaaagtgtgaggctgggcgcagtggctcacgtctgtaatcctagcactttgggagaccgaggcgggtggattgtctgagctcaggagttcgagaccagcttggggaacatggtgaaaccccatctctgctaaaatacaaaagaaattagccgggcgtggcagcgtgcaactgtagtcccaactattcgggaggctgaggcaggagaattgcttgaacccaggaggcagaggttgcagtgagctgagattgcgccactgcactccagcctgggcgacagagcgagactccatctcttaaaaaaataaaaataaaataaaataaagtactaaggtgcatggcaaccccggttaggtggataaaggagagaaagtttgaacaacaaaaaaatgcaaaacagtagtaaacatttggtgaaataaaagtaaaacattaagatgaaacttcatttcctgttattagattaggaaagataaagagattcctctcaatatttttattgaaatggttaccttcttggtaagattacaaattggtactacctatatagaaaataatatataccagtagctttaaatgtttagggaatctaaagaagaaatctgaactgtggacaaaaatatctgaatagagttactgattgcagcatttgtaatgactgttaaaggccagaagtaacttgaaggcctaacagctggataatggttaagtatatttagcaacatattcataatgctgaatatgatacagccattaaaaataacatttatagataagtttataaaactcatggtgttttgaaatttttccaagtaaaggtagagtaatatgaactcccatgtatatggggaaggtttaatgatagaggaaaatgtttatggtcacaaaaaagcaggatataaaattatatttctggtgttagcaatgcagagacatgggaataagatggaaatattctaaatttttataaatgagtgatgagattttatgccatacgtttatttttatttttttaatggcgacattcatttggttcaaattcaggtagcataaaaaagaggatatgctatggaaggtctctcagctgctactgtcccaaaggccacctcgttcccctccacttgctaagcaaccagtatggctgtgtgtcctttcaaaagagagatattcatatacaatcaaatatattatggagctgtaccatgtacagatgtaccgtcatttattttaatcagtctcctattgaaggatttttatttctaatttttttttgttattgcaaactgctgtgaaatgaaaaatctgcacatatgtgtttttgtgcacttgccagtatatttgtaggatcatttcctaaaagtggaattgcttggccaaagaggtgtatgttttgaatattgataactatttgtctctataaaggttgtaccaatttacacttctaccatcagtgtatgtggatgtcctggacaacaaataaaactttttgatcatatccagtttcaggtttaaaaaagaggtgtctcaatgatgtgtttttttggggttttttttgttttttttttttgaaacggagtctggctctttcgcccaggctggagtgcagtggcgcgatctcggctcactgcaagctcggcctcctgggttcatgccattctcctgcctgagcctctctagtagctgggactacaggcgcctgccaccacgcccggctaattttttgtatttttagtagagatggggtttcaccatgttagccaggatggtcttgatctcctgacctcatgatccacccacctcagcctcccaaagtgctgggattacaggcgtgagccactgcacccggcaatgatgttgttttaaaaaaaaattttaagaaatagaaatgaggtcttaccatgttgcccaggctggtcttgaactcctaggctcaagcgatcctcccaccttgtcctcccaaattgttgggattacagatgtgagccacgtgcccagcttcagtaatgttttaatttgaatttatcttatgagaaatattgaatctttttatatatttaagagccatttatattttcttttctctgtatttcttttaatatttattattcattttgggggattgttgttagccatttttttcccacattaatgtgtaggggctagctgtacattaaagaaattagtctgatgtatgtgatgtgaattttagatattgtttccacagtttgtcttttgattatgctcctggaactttttccacgtggaagtttcttttaatgtagttaaatttattagtctcttctgttacaactttttgggttttatgccacacacacagtgaagctttttaataaagtctgctatattttcttttagtacaacaggaatatttttggtcttagaaactctgtttgttcattgtatttgtttttgacatgatctcactctgttgcccaggctgcagtgcagtagcacaatcatggctcactgcaacctcaaatgatcttcccatgttagtctcttgagagctgggactacaggtgcacgtgtgccaacatgccagctaattttctttttctttcttttttttttttgagacagagtcttgccctgttacccaggctggagtgcagtggcgggatctgggctcactgcaacctctgcctcccaggttcaagcgattctcctgcctcagcctcctgagtagctgggattacaggtgcccgccaccatgcccagctaatttttgtatttttagtagaaacggggtttcaccgttttggtcaggctggtcttgaactcctgaccttgtgatccgcccacctctgcctcccaaagtgctgggattacaggtgtgagccaattcgcctgaccaggaaggagtattttgctcacttttccataaatgtttgtctttgatactgtttcaaaactcaagaaatgatagtttcttaaggtatctgaaactttattaatgaactttgcatattcttacattaacagccattagtcagtcaatgaagacattagttgaatagaaatttttttttttttttgagacttgagttttgctcttattgcccaggctggagtgcagtggcacgatctcgtctcaccgcaacctctgcttcctgggttctcagcctccggagtagctgggattagaggcatgtaccaccacacccagctaattttgtatttttagtagagacggggtttcacgaactcccgacctcaggcgatccacctgccttggcctcccaaagtgctggcatttcaggtgtgagccactgctcccggccctgaattgaatgctttttaaaaatccctgcataatttaaaaaaattaatgactttaattttaagagtacttttagattcacagcaaaattaagtgggaagcacagaattctcatatatactttggcctaccccccgtctcccaggcttccccactatccttctccagagtgtttgttataatcaatcagtgaacctacactgacatactgttatcacctggtgtccatagtttacattagggttcactccgggtgttatacattttatgggttttgacaaatacgtcatgacacgtatccatcattatagtatcatgcagattagtttcatcaccgtaagagtcctctgtactttgtctgttcatccctcccccacttactcctggcaaccactgctctttttactgccttcataattttgctttttccagaatgtcatatagttggaaccatatagtatgtagcccctatgcatgactttttaatatatgcatttattgtttgtaatatactaggtcactgagttatacagatcttgcaaatattgacactttttattatactatataatatccagtcatgcagcctctcaaaaaactccactgtatacatgtggtcttagtagtattatgaaaaaaaaaaatggaccttggagacaccctgaaaaagtctgtagtaacctgccaggggcccctaaaccacattttgagaaccactttgccagtactcgtatggtttcatcatcttttatattttaatctttaatccttctggaattttaagatctaagctatgtagtaaataggcaagttaactttttttctagatggctactagtagccacttgaataattatacatcttttcattactgagtagcagggtgaccaggcttaagacccttctttagtgggaagatgaccttgaatttaccctcttcttgtatttctctggtgaagataaatgtgaaatatcacctctgttgtaagacagcattgcttattgtagaatgatccctgaatggaattgcatcttggtagggaagttgttgaatggactgtacatttctattcggaagcacaggccttggcttccttgtatgcatgcagtttgtcttgtgtagggaccaagaaactgtagtcatgtgctatttattacattggtttctgtgacacatgaagcttacctaagctagaccctgtcgtcttgcttacaactgagccatcacttgggagatggaaaaatggcttctggctgtctgaatcactgctgaagacaatatccttgaagctgctatggtggcatactctatttcctgcccagtattctgcaaagttagatgaacctcctttcaggctatagtctatttgatcttgtgattgtgaaggtgagaatatatctgacatctctgctggttgtcatgctaagtgggctttgcaaattataaacagaattcttccatatatttgggtcttttctgggctataatttttttcctgcttatttaccagtattataatttttaaaacggagactttattataattttaaatattggtaggcctgattccttctcattaatcttccttttaaaaaatacttttcttggggccgggcacagtggcttacgcttataatcccagcactttgggagcctgaggcgggcggatcaccggaggtcaggagttcgagacaagccgggccaacatggcgaaaccctatctctactaaaaatacaaaaatattatccaggcgtagtggcatgttcccgtaatcccagctactcgggaggctgagggaggagaatctcttgaacctgggaggcagaggttgcagtgagccaagatcctgcctctgcactccagcctgcccaacaagagtgaaaactgtctcaaaaaaaataaaataaaataaagcagctggctgcggcacttgtaatcctagcgctttggaggccaagatgggaggatcacttgaggttagaagtttgagaccaacctgttcaacatagcgggacctccatctctaaaaaatttttttataattataaataaataaaataaatgaacaaaaaaggaaataattattttctacagaagaaattacccttttgtgttttaaaaatacctttcttgactattctttcttgtttgtttttttacttgaattttaaaattatattttatttgattttaataatgtttttagaaagagttttttggctttattaccaaaaacaccatctggacagttgggcagatactccgctattttggagcaggtaactttttgcaaaaattgagctattttattataagttatttccttgcttccctctgtcccggcctaggcaacgggccagcattttgtttttccagccttctgttgctgctcagtcagctctctgcgtgtcaggctgttcctttttacatgccttttaatcatataggacaacaacaggaagtgcagtaaaagcatcttttataacattgctttggttttttgttactagatgttgaaacttctatgttttaaccagtatcattatttgtctttttgtttctcagaaacacagatcataatatctttgaatattaagtgtcgagagagctgctcgtctagttatgttggaagcagctactgtaaattacttaggtactaagccttaccttgtaaggagaaggtttagcaaagaataatagagctttaagatggtattaaggcagaatgttggcatcttataactcttgtgtttcatggattcttgtgaatggcaagtttagtctttactctgctgttgacttttgagagtcatcattgaagaaagcttaatacaacaaaatgaatgcctttgatattttaactcttgttatgatcaacctatttatatcagaacttatttaaactagttcttggctgggcatggtggctcacgcctgtaatcccagcatgttgggaggcccggatgggaggatggcttgagcccaggagtttaagaccagcctggcaaacatagtgagatctgttctctacaaaaaaattacatgcctttggtcccagctatttgggaagctgaggtgggagcatcacttgagcctgggaagtcaaagctgtggtgagccacgatcacaccactgcactgcagcctgggcaacagaacgacaccctgtctcaaaaccaaatgaaaactagttctcaaaagggatggtaggctgggcatggtgactcatgcctgtaagactagcactttgggaggctgaggcaggcagattacttgaggccaggagttcgagaccagcctggctaatatggttaaaccccgtctctactaaaaataaaaaaattagccgggcattgtggcgggtgcctgtaatcctagctactcaggaggctgaggctgcagtgagttaagatcacaccactgcactccagcctaggtaacagagcgagactgtctccaaaaaaaaaagggtggggggatggtgaatgagcaactttctggaatttctcttctttgttaacacccacaatgttttctggtcattctctacttgtttcagtcttcctctggactgttcagtatactcaccactagccacaaatggctgtttaaattaataaaaattaaatttaaaaaatcaattcccatttgaagtaaagctcatttcggtcatgccaggcatagtttgagagaccatctctaatgttttgattatcagtgttttttcctaaagaactaatcatatttcaggccgggcgcggtggctcacgcctgtaatcccagcactttgggaggccgaggtgggtggatcacgaggtcaggagatcgagaccatcctggctaacctggtgaaaccccgtgtctactaaaaatacaaaaaattagccaggcatggtggcaggtgcctgtagtcccagctactcatagtcccagctactcgggaggctgaggcaggagaatggcatgaacccgggaggcggagcttgcagtgagctgagatcgcaccactgcactccagcctgggtgacagagccagactctgtctcaaaaacaaaaaaaaaaacctaatcatatttccaagttttaggcatttcttttgctcctatgacacattttaggagggttttcttactcttgtaactcccaaatctatatgtctacagctgatctatttcacaaagtctagtctcaaactttgaattacagaaatacctaaatatatagtattttctgtatattgctgaaatcatattaaaactgccaacaattagctgggcatggtggcacatgcctgtattctcagctactcaggagactgaggtgggaggatcactgcagcccaggaggaagtcaagcctgcagtgaaccatgagtgcaccactgcactccagcctgggcgacagagaccctgtatcagaaaacaaaaaacaggctgggcgctgtggctcacacctgtaatcccagcactttgggagactgaagtgggaggatggcttaagcccaggaccagcccaggcaacatagtgagaccccgtctcctcaaaaaagaaaaaattaggcaggcgtggtggcccacgtggtggctcccagcactttgggaggctgaggtcaagagttcgagaccagcctggccaacatggtgaaaccctgtctctactaaaaatacaaaaattagcaggcgtggtagcgtgtgcctgtagttccagctacttgggaggctgaggcagaataatcgcttgaacccaggaggcggaagttgcagtgagtcgagatggtgccactgcactccagtctggacaacaagagcaaaactccatctcaaaataaataaataaaaataaacaaaaaaactggctgggcacggtggctgacgtcagcctgtaatcccatcactttgggaggccgaggtgggcagatcacttgaggttgggagttcaagaccagcctggccaacatgctgaaaccccatctctgctaaaaatacaaaaatagccaggcatggtagcatacgcctgtaatccaagctactcgggaggcttaggcaggagaatcgcttgaacccaggaggtggaggttgtggtgagctgagatcacaccattgtgctccagcttgggcaacagagtgagactccatctcaaaaacaacaacaacaacaaaaattaaaactgaagttctgctgtttcgcccgtcctcaacataaacactcagaaccctataacctttcctttttaattgcttatatcacaatttaatgcctatttatttatttatttattgagacaagagtctcgctctgtcatccaggctggagtacagtggtgtgattctcggctcactgcagcctctgcctcccgagttcaagcagttctctctccacttagataaggccttctgtcaacccccaattgtttactaattaggtagtgttgctttttttttgacatggtatttatacttacttttcttcacattacattcatttggttatactgcctattccagtaatctcaaaattttccactttgaatctaccctaattcctctctgaacaggaattttggcttatgcatctttgtatttgaaacacataagacattattttgtaataatgtagtcttattttattagtgatttaatatactgagctatcttagttgttgtattttaatcatttagattatttatgtgaactctttatttttagtgtaatgaacaagtctggggtgaatcgtgtagtttggaaacgacctcgactcactcacaatggacctgttagaaggagcacagttattgaccagattccttttctggcagtagcaagagcacttggtaagtaggacttaatttggtgaaattatattgaattttctacaatatatggtggcaaaataaaagaggagacagaactaaacccttacttggcatatagtgagggtagagatatcatgatattctattaactgctttagaacctaatcgaagccatgcatggtggctcacgcttataatcccagcactttgggaggctgaggtgggcggatctcttgaggtcaggagtttgagaccagcctagccaacatggtgaaactgcatcttcactaaaaaatacaaaaattagctgggcatagtgatgtgtagctgtagtcctagctactcaagaggctgagtcaggagaattgcttgaaagcaggaggcagaggttgcagtgatcgcatcactgcactccagcctgggcgacagagcaagactctaaaaaaaagcctaattgaggggaaggtttaggtatataattcactgacagttgccctttgttcatgagtcacgttcaatgttttgctaatttctatctctgtttagggaagtatatgcatatctaggcttaatgttacccttgaaactatttttaagtatcccattctcctttagcccttaatagtcctcctgagagccttcaaaacctcttttttctttagttaggaaagtaaaataactatgaaaaaaatagttatatttctggtctacctggctttggaaagaaggctagagaattacacctgttaaggtgtcttaccttggctatgctagatgggggtagttttttcaaagaaaatgtctctgagaaaacgcacatttgtttatttttattttatgagacagggtcttgttttgttattcagcctggattgcagtggcatgatgacagctcactgcaacctctacctcccaggctcaagtgatcctcccacgttagcctcccgagtaactgggactacaggtgtgagccaccacgcctggctaattttttcttttttaaggagacggggtctcactgtgttgcccggggtggtcctgggcttaagccatcctcctatctcggtctcccaaagcactgggattacaggcatgagccaccacacccagcacaactactatatatattaataatttgtttccaatgtgaaactaattttcttctttcacaccctgactggtggacttttatgttatatccaagcatttgctattatgaaaaatactgcaataaatatttccttatatacacatatgggttgttttttttttttaaatggagttttactcttgttccccaggctggagtgcagtggtgcagtctcggctcactgtaacctctgcctcctgggttcaagcgattcttctgcctcagcctcccgagtagctgggattacaggcatgcaccaccactaccggctaattttgtatttttagtagagacggggtttctctatgttggtcagactggtcttgaactcctgacctcaggtgatctgcccgccttggcctcccaaagtgctgggattacaggcgtgagccactgtgcctggcaagatttctttaagatacataactagaaatggaatttctgggtcatagtatgttacttaccaactgtttttgtgtcgtaacactcacacaagatgataatatttctacagtaagcagaggaggctacttgagactgaggtaactaacatggactctctagccactgaggacccaccctgctgcccctaggcctcactcatccaaggaataccaattgggagactcagttcagagatatctacatgtttagttttattaggtattgctaaatttcttcccaaagtgattatcccaggttattacagtcccgctgtattagttatctattgctgtgtaatcaaatactcccacacttaggagtttaaaacattttttatgtacacagttcctccggctcaggaacccggggtgacttaactggatggttctggctcagggtctcttgtgtagctgcaatcaagatgtcattaatcatcgaagccttcaatggggttggagcatctacttgtaagacagctcactgagtaacctggattggctggaggcttcagtttcttgctttgccggcctctgcatagggttgcttgatgtgtcttcatcacatggcagctggcttccttagagcaagtgatcataaaaagacattttgacttctaccttgctttcttgatcacttgctgtagggaacccagctttgtattttgttagccctgaatcactaaatcaagcccaccctcaagtatatcaaataatttgtggatgtattttaaaagcatatagttcctacttcttcatgattgttctttattcaccaaatatttattaaatacctgctatgtgctaggtactgttccaggtgctgaggattcagcagtgaatgaaacaaaaattcctgcacccatggagcttactttctaggttaggggaaaacatgataaactaaaataactaagtaggacacatactgtgttagaaatgctaccaagaaaaataaagcagggaatgctatgagggtggggcctgtataataattctaaatgggatggtcagaggagggtctcgctaagatgatatgtcagtaaagtgtaagtaaagagatgaggcagtgagacctgtgagtgtctggggccacagaatttaggcagaagtaacaaatgtaagggttctcattactcatgaatttttctcttttttttttgagatgaggtctcactctgtgccctaggctagagctcattgcagcccctaaagtcctgggctcaagtgttcccccagcctcagcttcccaagtagctggggctacaggtgcatgccatcacacccaactaatttttaaaaattttttgtagagacgtctcgctttgcccaggttggtctcaaattcctggcttcaagcgatctgcccacctcagcctcccaaagtgcatgtgcgacagcgctcagcctactcatgattttttttttttttttttttagacagaatttcgcttttattgcccaggttggcgtgcagtgatgtgatctcagctcactgcaaccttcacctcctgggttcaagcaattctgctgcctcagcctcccaagtagctgggattataggcgtgcgcccccacgcccggctaattttgtatttttagtaaagacctgtgagtgtctggggccacagaatgtaggcagaagtaacaaatgtaagggttctcattactcatgaatttttctcttttttctttttctttctttctttttttgtttttttgagatgaggtctcactctgtgccacaggggtttcaccatgttggtcaggctggtctccaactcctgacctcaagtgatctacccacttcggcctctcagagtactgggattacaggcatgagccactgtgccccgctcctactcagtatttttaactgagcagctggaaaaatggagttgccactaagtgataaagaaatgactggaacatcagtgtaaaggagaggtcggaagttcagttttggacacattaccctttcggcatgttttagacattaaggtggtgatacctatttggcttcccattataagaattgatttcaggtgttgtctagggtggagctttcaatttgggggagccagtagcatatagatagtatacaaagtcttgaggtcatgtagggattgagtgcagatagaaaaggggacaaggtctagtggctgagccctgagatactctcactgttaagactcgggggatgtgctctggtttcatttgagggttggattaaaattaaaaaaaaatctaaaagagttaggggatgtgaatggaagaacaaggtaaaacaactaacagctgtaagtcaaataggaaatttgggttagcgtaccctggaagctaagtgaagaaagtgtttccagaaagaaagtgtttcaaatactgttgtcatttaggtggagggaggattgaaaaatgaccatgggatttaggaatgtggaggtcattggtgaccttgaaaaagaaggtagcttttggtggaatagcaagaccacaaccatgattggggttattgaagaaagaactgtcttcttgagtgggaggaataaaatttgatacagcgagtttttagacagtgtttttatagaagttactttacttcaacataattttgtaaacacatacagaaatgaattaatattttgataaaagggcttataagagaaaatcgttttagtgataaaaaagcttttttcctcttgatttctcttgtcacataaatattttcttttcaaaaataatgctaccttttagattttaatatttaagctaaaaaggctttgctgtattacttttcaaaccattattctgacacttggaaaaatttttttttttttatgagatggaatctcactctgttgcccaggctggaatgcagtggcacgatctcagctcactgcaacttccgcctccccggctcaaatgattcttctgcctcagtcttccaagtagctgggattacaggtgcgtgccaccacacctggctgatttttgtatttttagtagagatgggatctcaccatgttggccaggctggtctcgaactcctgacctcagttgatccgcccacctctgcttcccaaagtgctgggattacaagcgcaagccaccgcgaccgaccggcctggaaataatatttttaaaagagccatgttattggttttctgagtttagcttgttgcatggaaatacttactggcctaaagtaaattaaatgctcatatttagcacacacccttatggtttacggccatttttcttataggtttttttgggcgggggaaggggtgggaatagatgtctccttgtcaacattggtacccaccctatagacactgatgataattacccaagtacaaatgtagcaaaggtgccctctagtggctgcctgctggaattgcattttgagtcttgcaaatcattttattcactggggagataatttttgagtatagtgtgtatgaagcactctgctgtatgtacaagcacatgatctttgccctcatggagcttgcagtctaggaaagggttgaaaggcattcatcagatgataacaaaaaactgaaaaaaaaattatttttttttgagactgagtttttttcttgtcatccaggctggagtgcattggcacaatctcggctcactgtaacctttacttcccaggttcaagcgattctcctgcctcagcttcccaagtagctgggattacaggcacccgccaccatgctcggctaagttttgtacaaaaatacaggggttttgccatgttagccaacttggtctctaactcctaacctcaggtgatctacccgcctcagccacctaaagtgctgggattacagatgagagccacagcgcctggctaaaactgaacatttttaattcttcttcttcttctttttttttttgagatggagtctcactctgtcgcccaggctggagtgcagtggcacgatctcggctcattgcagcctccgccttccgggttcaagcgattcttctgcctccatctcccaagtagctaggactacaggcgcacgccactgcacccagctactttttgtatttttagtacagacggggtttcaccatgttggccaggctggtctcgaactcctgacctcaggtgatccgcctgcctcgggttcccaaagtgttgggattacaggcgtgagccaccacacccagccaattcttaacttcttatatgtactaatgaaaacctaaaataaggatatttcacttaaccagagaggccagaaaagtgatatttgaactgagttttgaagaattactggaggttaaggaggaagaaagtgtgttttaggcatagaaaacaacattttcgaaaagttcggtgataggaagaagcatagtgatataggaactctgatgaagggcagtgtagctggaacggataaggaaataagagacttggataaaatgagaaaatactgcattttataggcagtggtaaataatcatgtttggctggatgtggtggctcacacccataattctaacactttgggaggccaaggcaggtggattgcttgagttcaaggagttcaagaccagctggacaacatggcgaaatctcccctctacaaagaattggctgggcgtggttgcacgcgcttgtagtctcagttactcaggaggctttggttgggaggattgcttgagcccaggaggctgcagtgagccaagattatgtcactgtactccagcttgggcaacagagcaagaccctgtttcagaaaaaacaaaagaattgtgtctttatcttaaaaacaattgtgaactataacagagttggaatgggaaacataaccagatttgtgtgtttttaattgtggtaatatatgcttagcatacacgtaacttaccgttgtaaagcatgtggttcattgatgttacgtacggttacactgttttgcaactgtcatccaccattcatcctagatttgtgggcttttgtttgtttgtttttgtaatttcagcttttagattcaggaagtacatgtacaggtttgttacatgggtatattgcatggtgctgaggtttggggtacgattgattccgtcatccaggtagggagcatagtacccaattgttagtttttcatgtcttcctccttctctcccttctccctctagtggtccccagtgtctattgttgccatctgtatcttcatgtgtactcaatgtttagctcccatttgcaagtgagaacatgtggtatttggctttcttttcctaaaagaaattggaaatttcttttatttagaaatttagaaatttcttttcctaagtaaattggattaatttacttaggataatggcctccagctgcatctgtgttgctgcaaaggacataatttcatttttttttttgtggctgtgtagtattctgtagtgtgtatgtaccatattttctttatgcatttcacttttgatgggcacctaagtagattccttgtctttgctattgtgaatagtgctgcaatgaacatttgagtgcatgtgtctttttgtagagcgatttattttcctttggatgtatacccactaacaggattgctagatcgaatggtagttctaagttctttgagatatctccacactgctttccacagtggctgaattaatttatattcccaccaacagtgtataagcattcccttttctctgcagctttgccagcattgtcatttattggctttttaataatagtcattctcacagggtatgagatggtatttcattgtggttttgatttgcgttctctaatgattactaatgtggagctttttatgattcttggccgtttgcatgtcttcttttgaaaagtgttgatgccttttgcccactttctaatggggttatttgtttttaacttgttgaattgtttaagttctttacagattctagatattagatctttgtcagatacatagtttgtgaatattttctccctttctgtaggttgtctgtttactctgttgatagcttcttttgctgtgcagaagctctttaattaggtcctacttgtcaatttttgtttttgttacagttgcttttgaggatttagtcacagattctttcccaaggctgatgtccatccacgattcttacagtttgaggtcttacatttaaatctttaatccattagtttgtgttttaaagagagaattttcattgagttttgagaatggattagagggggtaaacattgttggaagttctccatgggaagccactcaaaggggtgctgaaatttgataggtgtaaggaccactgagtgtcttgtggactgctggctgccaagtgccacaggagcaagcagaaaatatactggaaccagaaagcaggcctcctctcttctggtgtcccttcagcaccctctactgaggaaaaaagggaattggctgtctgccagtttccaaggcacctcctttcaggacctacagaaatgatgttctatgatcgtactttggtgtacaaacactagaccagtaataaaaacccttagttaaaggcccaattctgatccttaccagttatttgatattagatagaatcatatagactctttgaactggtaaaacaagggaaagtgtctatgagtatgaatcatctggtgagtttgttgaaaggtcagattctagggacttttactagcaaatttgaagcaacttgagcatcaaaacaaattataacaggaataagttaaaaaatattgaataaaaaagaatctgtaagtctatatagagataaaaaattgtacaggtagaagaatggatttttttttttttttttttttttacatttaaaggagtttaattgggcaatgaacgatttgtgaattgggtagccacccccgcccacagcagattcagagagactccaaagaaaatctttttttttgagatggtgtcttgctctgtcaccaggctggagtgcagtggcgcgatctcggctcactgcaacctctggctcctgggttcaagtgattctcctgcccgagcctctcgagtagctgggactacaggcgtgtgccaccatgcccagctaatttttgtatttctagtagagactgggtttcaccattttggccaggatggtctaaatctcttgacctcgtgatccaccagcctgggcctcccaaagttttgggattacaggcgtgagccactgcctccggccaggaaactcttctttaaaaaagattttcagccgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtagataggtatctccagaaagataagaacataagaataatagtccttacagggaaaactggaagggcagtggtgagaagggagaattttcactgtatatgtacccttttatatcttttggttttcatactatgcgaatatattacataatattataaaaaggcagacccagtaccgtggctcatacttgtaatcccagcactttggggaaccgaggtgggaggattgcttgaatccaggacttggagaccagcctggacaacatagtgggaccgccatctctacaaaaaataaattagctgggcctgttggtatacacctatagtcccatctacttgagaggttgacgtaggaggatcacttgagcccaggagatctatcctgcagtgagccatgattgtgccactgtccccatgttcatttttattatttcgtcaaccagggagctttgttttgctggtataaagaggtaagtgtgtctttgtgagcttatctggattataattagcttttagtgcttgcatgtattctgttttgctgctcagagggctgaattgctttttgaagagtctggttagcaatgattttgctactttcaagtgggagtaattgacttgaattattctttctttggactctgagcatgtttgaattgccagtatttctgatggggagctagtggggaagtttaaataaagaaaaggacaaagcttcctcttgtttaacaaaaaaaccagacctactgaaaggggacaaaaattgtttaacctcttgtctgaaaatcttttgcttttaatttaggcctttcccttaaatagttcacaataaacaaaagaggcagaaattaatgttttctcctttctgtctcctcttccacatttattggaaacagaagaaaaatttatattgtttcatttatgttgtcttatatattacagaaaagtagatggtttctataaatcatttttattttcttctgttttagttttattgatcttttttatggcctgggtcgactaaaagttattgtctcttgaacattttgatgtttgtatctaataggtctaaaggcagaagtttaggcattgtttttatgtggagctaatcaaggagaaggataaatgtaagagctttctttttccggctcagtgaaagggagaactgttgctctccaaagtttggtcatatggttggtaaagagcattacaatgctcatttttatattttgaattttcttgcaagtgactggtacttgttctgtaagttttgatgtaggtactttactgatctagagattaacaggaagtttgcaaacagccattggtacttctgtttgtaggataagttctcatcttgtcctttttcttcaaaattatcttgattaatcttggccctttgcgcttagcctgtcaaattctacaacaatccttttgggattttggttagaattacattgactttgtagattattttgggaataattgacatctttattatagtaagtattgctatctatgaatctgattggttacttcatttatttagattatctttttaatgtttcaaaatagaatctataatcttcataacaggcatgtataccgtttgttaaagttgttcctaagttccttacatttggttcattgttaaaattggattatttaaacatttatattttctatgtcttgctatcatatagaaatacgttgacttatatattgggtttgtatttaacaactttgctaaacttttctattgtaataatttatttttggttttccatgtataaatgaaattatctgcaaataatattagtattattttctcctttccattttgtatatactttatttttattatcttactgtgctgggaaggactcagtatagtattagaagagaagcaatgatacaaggcatagttttcttatttctacattttaaagggaatacttttaacattttacctttaagatgattattacagaattctggtggatatactttatcaggttaagggagttcccttttattcttagtttgctaggaaatcttatcatgagaggagtttgaatgttatcaaatgcttttctgcgtctattgagatgaactgtgtagattttctcttttaatctgttgctgttgtactattagcttccaactaatacttcttgctttttctgctcccttcccccaggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatggtgagatgtgattgaataacttgatattgttgtctaaacattgttttggtacttctgtcagaatcttgaatatgaactaaggacattgaccttgggtagatttttgcatttgccttgatctgctagtgggtaaaacataggctttgtagctcctaatcattagaggaatgagacaagaaatatataaccgaagtctaataacaaaacacacaaccactgacttcagtataaattggcctgtgaaacgttgctaattccttatttttttaaatgacatataatttccataccataaaatttatcgttttttttttttttttgagacggagtcttgctctgtcacccaggctggagtgcagtggcacaatctcggctcactgcaagctccgcctcctgagttcacgccgttctcctgcctcagcctcctgagtagctgggactacaggcgcctgccatcacacgcggctaatttttgtatttttagtagaggtggggtttcaccttgttagccaggatggtctcgatctgacctcgtgatccgcctgccttggcctcccaaagtgctgggattacaggcgtgagccactgcgcccggccaaaatttatccttttaaagtgtataattcagtgattcttagtgtagttcacaaagttgtacaaccatcaccactactactttttttttttttttttctgactgtctcagtgtctcgctctgttaccgaggctggagtgcagtggcatgatctcagctcactctaacctctgcctcctggattcaagcgattctcccacctcagcctcccgagtagctgggattacaggtgtgtgccaccccacccagctaattttttgtatttttagtagagatggggtttcatcatgttggccaggcagggctcgaactcctgacctgaggtgatgcctcagccccacaaagtgctgggatttaaggcatgagccaccgcacccggcctccatcaccactacttctactactttttttgtttttttttccccccaagagatgaggtgtcactatgttgcccaggctggtttagaactcctaggcttaagcagtcctctcacctcagcctcctgagcagctgggactactgtggtgccatgcccagctcctaatctcaaaacattttcatcatcatcccctaacagagcacatggaagtatctggaatcaaaaatccaaagatgggttatccttagaaaagatgatctttctctcagatggcaggaatagtaaagctgtattttgaggtggaaggaggggcaaattgattgaatttttgttaaattgcctccattcattccgggcgcagtagctcacgcctgtaattccagcactttgggaggctgaggcgggtggatcacccaaggtcaggagttaagagaccagcctggccaacatgatgaaaccccacctctactaaaaatacaaaattagctgggtgtggtggcactcgcctatagtcccagctacttaggaggctgaggcaggagaatctcttgaacccaggaggcagaggtcgcagtgagccaagatcatgccattgcactccagcctgggcaataagaacgaaactctgtctcaaaaaaaaaaattgcctccattcattcactcaattaacatactaggtactaggtacagggattgcaaaggtaaatagaatatggtccttcctcagcacttaccatattattataaatagaatatataaaaaactaacaatcccattagatcatgagttcttttaaggtgagagtcatcttgattcagttttacatgttcagggcctggtgtgttgcatttagttggagattatcatgtatcaaagagtaacataaagactcttctgtctaatggatttagaattctttaatgatctgagagagatcatttcaatggcataaagacaaaaaccagtttgtagtgcattggaagaacctatttatgaaccataaagtgttttaagatgagtattgaaggaagcatccgtataatgtataattagaacaagtcttatgagacctggaagagtgagacgatagaaaacttcacaagactgcataggaagcttcatggaagagagtgatatttgagcaagaaaatttgcaggcttaatctaaggcagcagtggtttttggaaaaaacacaaagaaatacatgtaggccgggcgcagtggctcaagcctgtaatcccagcactttgggaggccaaggcaggtggatcacttgaggtcaggagttcgagaccggcctggccaacatggtgaaaccccatctctactaaaaatacaaaaatcagccagacgtggtgactcgcacctgtaatcccagttactcaggaggctgatgcaggagaattgcttgaacccaggaggcagaggttgcagtgagctgagatcgtgccactgcactccagcctggtgacagagcgagactccatctcaaaacaacaacaacaacaacaacaacaaaaaacacaaatacataagtagtagaattgacagctcttatgtttataaggaggaagaatatgatgacacctaaatttctaactctggtgactagtaagctgttataaagaagagacattatttagggagagatgggggaggtaattagttcagacataggcatgttgagttgaggtacctgtggttcatctagatagatatcttcagtaggcagttataaatatttgagagagaggggtggcatgctcctatagtcccagctactcaggaggctgtgggaggattgcttaaccccaggagttcaaggctgtagggctctatgattgtacttgttaatagccactgcactccagcctggacaacatagtgagaccctcatctctttaaaaataaaaacttgggagggaagcgtggaaatactaatttaacagttaacaagagttgcgtaaattgtggcaatatatgcacttagagagactctgtggtttaagagcacacaatattagggggactcaagtcagcagaattctagtgagctgagggaaaaatatacaggtaagatagtggaaaatggtttatataattgttttcatagagcattgatgggaagggaaacaggcacactgaaaaagtgagaggtaagggctcagtcagctggtgtttggagagtggaaccacatgccgtagggaatgtgatagattcatgaattagagattaatgctgcctttaatcaattctgaggtgcatattttcttttaatatctctgaaattggaatactttttacaaatggtatatcacagttcaattaacagtgtttttggtttttttttttttttgagatgtaatctcgctgtgttgccaggctggagtgcagtggcgcgatctcagctcactgcaacctctgcctcccaggttcaagcgattcccctgcctcagcctcccgagtagctgggactacaggcgcgcgccaccatgcctggctaattttttttattttagtagagacggggtttcaccacattggccaggatgatctccatctcctgacctcatgatccacccacctcggcctcccaaagtgctgggattacaggtgtgaaccaccatgccaagccaccacgcccagccgacagtgttttttatttcgtttgtggcacataaaatgatgcatccataacacaaggctcatggtattctacatgaagaaaacaatctaagtgatccagtcagagttacaaaaaagaatatcatagtaaaacccctcaaagtaggaggttgaaaataatagagcagaaattaattatttagggagattcacaaaacccagaagggcagtcttttaagaagacacataaggcatgattgattgtttctagttcaagagaaaagcacaaaaaagtttgagtggacataactacacttaaaaatagagatttttaaaacacactttaaaaaattcgaagtatactatacatatgacatttactatttgtactatttgaaattgtacaattcaatagtaaaaaatccatttatattctttttttccacccttcatctctctctccctactacccttcctggcttcttgtaaccacaattctactctctctctttgtgagatctactcttttagctgccacatatgagtgagatcatgtctttctgtgcttggattatttcatttagcataatgtcctccagttccatccctgttgctgcaaatgacaagatttcattcttttctatggccgaatactatttcattgtgtatgtgtatatacaccacattttctttatccattcatgtattaaatggaattgacgtaggatgattccatatttggactgttgtgaatagtgctgcaataaacatgggagtgcagatataccttcagtgtattgattttctttctgttggatatatgtatagtagtggaattgttggatcatatggtagtttacttctgtttttttttttttttttttttttttgaggaaccttcatactgttcttcgtagtggctgctctaatttacattcccactaacactgagggttcccctttctgcacatcctcaccagcatctgtagttgcctatctttttgatgcaagtggttttaactggagtgagatgatacctcattgtggttttgatttgcatttctctgatgattagtgatgttgagcattttttcatatatctgttaatcatttgtatgtcttttgagaaatgtgtattttagatcttttgcccattttaaaattggattatttggggcttgttttgttttgttgctactgatttgagctccttacatgttgttaattccttgtcagatggatagtttgcagatgttttatcccattctgtgggttctctcttcactttgttgattgtttcctttgcattttagcttgtattttcatttgtctatttttgctttggttgccagtgcttttgaggtctcatgcaaaaattatttgcccagaacagtgtcctggagcgtttctccaatgttgttttcttctagtagtttcatagtttgtgagatcaaagtagatctcacagagggaatagaattgtggttaccaattctactaattgagatcttagatttaagtcattaatccattttgatttgatttttgtgtgtgatgagagataggggtatagtttcattcttcagcatatagttatccagttttccccctaccatttattgttgctcttggcacctttgttgaagatgagctggctgcaaattgcgtggatttatacataggttttctgttctgttccattggtctatgtgtctgtttttgtagcagtaccatgctattttggttactgtagccctctagtatagttttgaagtcaggtagtgtgatgcctccagctttgttcttttggcttagaattgctttggctattcaggatattttgtggtttcatatgaattctgagcttaaagaaaaaattatgtgaagaatgtcatttcaattttgatagggattgaatctttaaattgctttgggtagtattgtcatgttaacaatattaatccatccaatccataagcatggactacctttgtatctttttgtgtcctcttcaatttctttcatcagtattttctagttttcctttatagatctttcacatctttggttaaattgattactaggcattttataatttgtgtacctattggaaataggattgctttcttgatttctttttcagattgtttgctgttggtatatgtaaatgctgctgatttttgtatgttcatcttgtatcctgcagtttcactgaatttatcagctctaacagttttttggtggcgtctttaggtttttgtaggtatgagatcatgttacctgcaaacaaggctcatttgacttattcgtttccagtttggttaccctttatttctttctcttgcctaattgctctggccgggacttccagtattgtattgaataacagtaagtgagagtggggcatccttgtctgtttcagtccttagaggaaagaccttcaatttttttccccattcagtattgatgttggctgtgagtttgtcattttgaggtatatttctactatacttatttttgttgggtttttatcataaagtgatgttcaattttacgaaatgctttttcagtgtctattgaaataatatgctttttttttttgagagagagagtctcactctgtcacccaggctgggagcacagtggtgcgatcccggctcactgcagcctccacctcctgggctgaactgattctcccacctcagcctcccaagcagctgaggtgggaggatcacttgagnnnnnnnnnnnnnnnnnnnnacagagtgagaccctgtctcaaaaaacaacaaacaaaattttccactcattttcattagtcatttatttctatgggtacttttaatacatgcaggcagccgggcacggcggttcacacctgtaattccagaactttgggaggccgaggcaggcagatcacctaagattaggagttcaagaccagcctggccaacgtggtgaaaccccgtctctactaaaaatacaaaaaaaaaatttagctgggcatggtggcaggtgcctgtaatcccagctacttgggaggctgaggcaggagaatcacttgaacctgggaggcggaagttgcagtgagccgaggtcttgccattgcactccagcctgggcgacaagagcaaaactccatctcaaaaaaaaaaaaaagaaagaaaagaaaagaaagaaaaaaatacatgtaggcttatttcctggagtacatcattttcacttttgttctgtgaaacctagcagattttaaattcatatatgacactggaagttttattccaagccacatttatttgcataaaatgagatccttttggttttgttttctttactcgttcaattggtatatatttgttctttatactataagcagttattgtattactttttcctcatatgagtgacattgactgtttatatatatatatgagctgtttatatttccttttctctggattttgtttatattctttgacaatttttatgttgagtcattttcttcgatttgcagaatctcttatgttagaaggaatttgaccctttgcaatgatttttttttgtaccatgcctgattgtcttgtttgtgaattatgttttcttaaataacttgatgtttacttcttgttgttgttgttgttttgagacggagtctcgctctgtcgcccaggcgggagtgcagtggcgtgatctcggctcactgtaacctccgcctcccaggttcaagcaattctcctgtctcagcctcccaagtagctgggattacaggcacacaccaccatgcctgactaatttttgtatttttagcagagatggggtttcgccatgttggtcaggctggccttgaattcctgaccttgcagtccacctgcctccacctcccaaagtactgggattaaaggcgtgagccaccacacctggctactttctttttaagtaacttctttataactttttcttttctttttttctttttctttctttcttttttttttttaaatggagtcttgctctgttgcctaggctggaatgtggtggcctgatcttggctcactgcaacctccgcctcctgggttcaagcgactctcctgcctcagcctcctgagtagctgggactacaggcatgtgccgtcgcgcccggctaattttttgtttttttagtagagatagggtttcaccatgttagcgaggatggtctcgatctcctgacctcatgatccacccgcctcctcctcccaaagtgctgggattacaggcatgagccattgcgtctggacaactttttctaaataaagttacagtgaaggctgagtttcttgataaaaataaaaatagtgaaatttaatgacaggataaaaccttgttttattagtattttttgaatttagaaaagtattattttaacatggctaaggagactggggataatgtttgaaaatttgggagctttggctgggcgcagtggctcacacctgtaatcccagcactttgggaggcagaggcgtgtggatcgaggtcaggagatcaagaccatcctggctaacatggtgaaatcccgtctctactaaaaatacaaaaaattagccggccatggtggcgggcgcctgtagtcctagctactcgggaggctgaggcagaagaatggcatgaacccgggaggcagagcttgcagtgacccgagattgcatctctgcacttcagcctgggtgacagaggaagactctgtctcaaaaaaaaaaaaagagaaaagaaaaaaaaaaattgggagctttgtttgggccacagcgaacaccaaatatttaatttgatatagatacagatgtagtggcagctaaatctgagttactttccttctccttgttcttttgaatacagggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggtatatagttccatagtttttaagttatgttttaatagacaccagttctttggttagcgtcacctggaaacaatttttaaattcttacaggattttggatttgaactcgattcaagaaagtgatgtaacttattatcagagagccatctttacatcaatactaatctgaatgccagccatgtgtacagcactaataaaaaggtgattgtgggcccttaagaatattattgtttgccatctaatgctatgaacattatttttaaagcatttagaagtttgtgaagcacttaaatatattttatttgaatctcgtagcccagaagtagagctaatgttattatttcattttatcagtaataagcctgagagattaaactgtctaaacaaggtcatagagaatcaaaattgagctggacctgaggatagcagacgttacaactggttgtctgttaactcgtataagaaactttattcctatttcttatccatgttaatattgattgagtttaagatatgctttgaaataagcaaattttaagtagatatcatacttttttgatttactaagaactcaaatacttggttgtgttttcatcctaatttttcccaccaaaaattagcagtattgattgataattgctttaatacatagcatggctaacctggctttctgagaatgtgttttcagtagactgaccattaaaatgggaaatgtagggaaatctaatgtcacctattcaggaagttttttaaagtgtcaaaggcctttaattttgggcgtcgtaatcctatagtcaatacttggaaatggattattactgctttgctttctttcactttacatacatatggcaaaaaccacatatggccagatacaatggaatgttttcatttctttttcttttttttgtttttgagacagagtttcactcttgttgcccaggctagagtgcaatggcattatcttggctcactgcaacctctacctcccaggttcaggtgattctcctgcctcagcctcccaagtagctgggattacaggtgcccgccactacgccctgctaattttttgtatttttagtagagatggggtttcaccatgttgtccaagctggtcttgaactcctgacctcaggtgatccacccgcatcggcctcccaaagtgctggtattataggcctggctgaaatgaagtattttcattcacaaaaggtttcttttctttgaaaaccatgaatggtaatgcaggttgaaaccctttaaagcctctttattctcttttcaaagctgtgaaagagcttatgtttgtatatttgcgtatttctgaatatttgtatgtaattattactttcatgttcccttataactgacctttaggcagtatagagaaggaggagacattagggtggggaatagtgtgaggaacaaaagggcattcttaatattgacctcaaataaaaattattgcagtctgctgactggcattagtaaacccatacataaaatacgtttaaaaaattacttaagctgggcacagtggctcatgcctgtaatcccagcactttgggaggctgagttgggcagataacctgaggtcaggagtttgagaccagactgaccaacatggagataccccatctctactaaaaatacaaaattagccaggtgtggtgatgcatgcctgtaatcccaggtacttgggaggctgaggcaggagaatcgcttgaacccaggaggcggaggttgcggtgagccaagatcgtgccattgtgctccagcctgggcaacaacagcaaaaccccatctcaaaaaaaaaaaaaaaaaaattccttaaattctgggctgggcgtggtggctcacgcctgtaatcccagcactttgggaggcagaggcacatggatcatgaggtcaggagatcgagactatcttagccaacatggtgaaaccccatctctactaaaatacaaaaaattagctggatgtggtggctcgtgcctgtaatcccagctacttgggaggcagaggcgggaatcgcttgaacccgggaggtagaggttgcagtgagctgagatcgcgttgcagcactccagcctgctgacagggcaagactccatctcaaataataataataataataattctgataatgacctaataatactactaaagtaaagataagaagacgtatgtttgccatatgcaggtatagttatttgttaacccattggccctgcccaaatatgggaaaatatttaggttaattcagaataattagtattgttggctctgatctaacaactaacaaaagacagatttctgcccaagaaattgtttttggtttgttttatttaccttaattgacataaaggtgagtactcctgactatatttaatttacatcattattaaagttgtctcatgtttagtaacatagagataaatttaattataatgtggttaatgttgaacagtcagagacttaatcacatttagacaaggcatttgagactagatttgtctgtaaacatgtcagcttccatttgaattctcacataaattagtctttgttttgggatggagatagtggaaaagcctttgtttaagtaagatagattactatgacacacatttctttctctgtcctttgtttagggcaaaactaaatttagctatgttttacaagctaagatctttaagaacggaatggggaagagagcaaagagtttcagaaaattaaaacttagttttagttgcattttaggcacagtttgtaattaattgtttaatattggattacagggtagatgggaggagaaagttgatctctgaagcagtgaacttttttaaagtatgtatttttaggggtaacctcaatatcacataactgttttacgaacatgcaggccttagcaatacaaattaacctggggtacatctaagaagtctaaacagttgcctgtgctaacagatacaatgtattcccacagaatgccaataaaaagagaattcccttcagaaatgttcaagaagaaagtaggggaagggaagccagcacacctgtggtgtcagaataatattctgtgcatttaggctgggtgtggtggctcacgcctgtaatcccagcactttgggaggccgaggcgggtggatcacaaggtcaggagttcgaggccaatatggtgaaaccctgtttctactaaaaatacaaaaattagctgggtgtggtgacatgtgcctgtaatcccagcactttgggaggccgaggcaggctgatcacccgaggtcaggagtttgagaccagcctggccaacatggtgaaatcctgtctttactaagaatacaaaagttagctgggtgtggtggtgggtgcctgtgatcccagctacttgggaggctgaggcaggagaatcgcttgaacccaggaggcggaggttgcattgagccaagactgtgccattgcactccagcctgggcaacaagaatgaaactctgtctcaaaaagaaacaaaaacaaaaaaacagagaagtgatgtatttggggcagtaccagattagtaactagaaattctttgtccttttcttcagtgtccattggtcctaaagtctatatatatatgtgtttttcagtaaagcatattcatatctatgattagatcgagatcattttagaaacgagtttctgggccgggtgtggtgggtcacttaaggtcaggaatttgagaccagcctggccaacatggtgaaaccccatctctactgaaaatacaaaaattagctgggcatggtggtgagcacctctaaccccagctactcgggagggtgaggtgggagaatcgcttgaacccgggaggcagaggttgcagtgaacagagatcgcgccactgcactccagcctgggtgacagagcaagactcggcctcaaaaaaagaaaaaaggaagcttctggatgccttcaatttccctttcattttattttttgaacctccctgcctcccttatttccctttgtttttaactctagacaaattaaaggaaacattcctatgataagtatacttttatatagcacttctaagaaagttgtatattcaggctgggcgcagtggctcacgcctgttatcacagcactttgagaggccgaggcggacagatcacctgaggtcaggagatcgagaccagcctgaccaacatggagaaaccctgtctctactaaaaatacaaaaaaaaaattagctgggcatggtggcgcatgcctgtagtcctagctactcaggaggctgaggcaggagaatcccttgaacctgggaggcagaggttgtggtgaaccaagattgtgccattgcactccagcctgggcaacaagagcgaaactccatctcaaaaaaaaaaaaaaaaaaaaaggaaaggtgtttatttataggagattttatttcggagaaagatcagataaatacgtcttcatttgctgctctgcttgggcttttcagaatctattaatattttgatacatttgattgagagtccacttgaggaaaattttacatgtttgggggagagagtatttatgctttaactctggaccttgataaagtattaagacaatgattttatgaaatgttattactttggaagagctgggtttgatagtaagaatgttcttatctggaggtgagcggctattctgagtatatgtagatttagagcactacactcaaagtagtggtgcatatctagattgacatgaagcgttgtgaaaacagcatttttaaaaacaataaagtgccttggataattctcatttgttttcatcaattgggaatttccctaaccattctcagaatggtcccatgtgtactacttttctcaaatcacagagcagtatctagtgtttgcaggatgggtgcaaagcagcattcttctgagtttccattatgaccattatgacatagttgctttaatgttgtactttgctttaatgatgtgctttaatgttgtaatgctttccacactacatactcagaaattagaatttaggagataggataaaccaaaaaactacaaatttgttgcttatcctactgagatgctaccatcccctccagtggttacactggttttcattactagaaaattcagatttttatttttaattttaatatttatttatttattgtgagacggagtctcactccgtcacccaggctggagtgcagtggtgcgatctctgctctctgcagcctccacctcctgggctcaagcagttctcctgtctcagcctccagagtagctgggattacaggtgcacaccaccatgcctggctaatttttgtatttttagtagagacgcagtttcaccatgttggccaggctggttttgaactcctgacctcaaatgatctgcccgcctcgacctcccaaagtgctgggattacaggggttagccagtgtgcccggccaaaaattgagatctttaaaagcttttttttcttttttgaaatagggaacgcttcatgaatttgtgtcatctttgcacaggggccatgctaatcttctttgtatcattccaattttagtatatgtgctgctgtagtaagcacttaatggcatcttaaagcaattttttgatggttcttatggaaaaatatgacttttatgaaaaatagagcgatttcatcagcattatgttattaccaaaagtaaattaaaatgcacacagagaatgcgatacttttgatcttctccatgtttgagtacagaatagtggaagagtgaatgtgtgcctatggttaattttgagggtttgttttgaaatcttgttccttaatgtatcttatttttgtttacctgccaatggatagaaaatgcttgtgaccacgtgaattttcacccacttgaatagattactttataatttcatctattaccctgaagacagaattcaatgtcattcttacctttatattgtcttctcactcaggttcctcccattaaaccttaacacatagttcagtaaatagaaggtgaacgaattagtgaatgcataccccgtttttgccatcctactagcttcataagaagcctaatatcacatgcatagatttgttgagttctgggataaattttttcttatttgttttaccttcttatttttcagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgctctgaaaaagtttctgattctggagcattttggattttggattttcagattagggatgcttaacctggattaacattctgttgtgccatgatcatgctttacagtgagtgtattttatttatttattattttgtttgtttgtttgagatggagtctcactctgtcatccaggctagagtgcagtggcgtgatctcggctgactgcaacctctgcctcccgggttcaagtgattctcctgcctcaatctctctccccagaagctgggattacaggtgtgtgccaccacacccggctaatttttttttttttttttgagatggagtctagctctgtcatccaggctggagtgcagtggtgtgatctcggctccctgcaacctctgccttctgggttcctgcgattctcctgcctcagcctcctgagtagctgagattacaggcacgcgccactgtgcccagccaatttttgtatttttagtagagatggggtttcacatgtcagtcatgctggtcttgatctcctgacctcgtgatccacccgcctcgacctcccaaagtactgggattacaggcgtgagccaccgcatccggcctgagttttatgctttcaatgtatttcttacatttcagttcaagtgattttcatgtctcagcctcctgagtagctggaactacaggtgcgtgccaccatgcctggctaagttttgtatttttagtagagatgggttttcatcatgttggccaagatggtcttgatctcttgacctcatgatccaccagcctaggcctcccaaagtgctgggattacaggtgtgagccaccgtgcccagccaactatgccattatttaaccatgtccacacattctggttattttcaatattttgcagaagataattcttgatcggtgtgtcttatgccacaaggattaaaatatgtattcattgctacaaaacaatatctcgaaatttagcagtttaaaacaacaaatattatctccagtttctgagcctcagaaatctgagagtggtttagctgggtgatagtctcgtggttttggtcaagctaccaaccagggctacaatctttcgaaggtgtcattggggctagaagatctgcttcccgcaagactcacagctgttggcaggagacctcagtttgttgccacatgttcccctccagagggcctctcacaacatggcagttatttgtccccagagcaagcaacaccggagggcaaggaagaagccatgatgttttttgtaacctagcctctgaaagtgtcataccaattctgtattttgttggtcacacagaccaagtcaactacaacgtgggagactcctacacaaggcatgaattctaggaggtgggcatttttaagtgtcatctggaaggaggctgtcacaacctggaagttaaaagcattgatattctgaaatacagcgtgtataacattgttttagtagggtgtgcaatagttatgttttggtaatagcattaatgaacaatgttattttcatcttccagacatctggaagattgctctagtggagtaaaacatcttaatgtattttgtccctaaataaactatctcactaacaaagttgagaataattttttttttttttaacagggtctcactgtccccaggctgatgtggagtgcagtggcaaaatcataggtcactgtaacctttaactcctgggttcaagtgatcctcccatctcagcttcctgagtagctgggactacaggtgcatatcaccacacctggtggattttaaaaatttccttagagacaaggtctcactgtgt

SEQ ID NO: 13969 - DNA, 301828 bp, Human
  misc_feature (1)...(301828): n = A,T,C or G
ctgtgagtttataatgcacagctatgtgagtccccgctggcacaagtgagcacctgagtacagtagttacctacagatctccccatccttgcttgcttattctctgacacacacacacacacacacacacacacacacacacatttactctttagtaacgtatcctgcagagatgcattgtctcttcaaccctggagtctataggatttctggtcaacctagttcctgtacatttttcactgcaactagagtggctgggaactctgacacccatggacctttgggtcttgtttttgaaacaaaaacaagcacccccatggcctgagaattgcagaagtatcaccgattcactgtagcctggattttccttttttcatcgaaattagtacctgtgtaggagagcaggcctagagccatggcaggctgtgatatttggcttccttgcttgtgtctcctttcagcattggactaaccaaattccatgctgtctttctacccaattccctaccttagtgaaaacctggcaattgtcgtttttttttgttttttgtttttttttgaactgtttttcagtgttgttttttgttcagtccacctagtttgtgaatgcaaataaaggttactcttaatgcttgtctggagatttttccacgtgatttgggagatgatatagggcatgtttgacttgtagcagagatgaagaatggataaatccagtgcatggaacatgatcggagattcccacagactaacttaccctgcctctaagtgggccccgagttcctctactgcacagattcctgcctgttgaacagccaagcgttgtccttacagaagtgcaactatactaactggtattgcacacagtgatttccaaagtggcactactaggaaatccttcatcttccatttctcaagctggccctctcctggagggaggaggtctgtcgcttccctttagctaaagtgttttgcttctcttggtattctgtctcctttccctcacctcacttcaccttcacgttcctggcctgggtgttactatttacctactgatcacagaatactatgtgaatttccattcacagctttgagtgtttatgaggctttcctacttcccacccagcccaaaccttgggactttccacacactgatcctctgatcagtttgacacaggaaagcacacagaagtcttgtaccagtttgtatagtagtacccttttgaactggcgactcttgaagtagagtgtgctaggggtttgcattggctgctcgacacacacaccaagtcaattagcatgcatgccaaaaaaaaaaaaaattaacccttagagtactgcttcaaccttttggtttaatggtctgaatttgactggtcggacaatgcttctttccccagatccgagtcctgcacagaaagtctgtgcttaatctagccagaacctcacccaggatcctctcctctctagctttcttgagatgctcctgggtcctgaatttattaatcaactaatggtttttaaaaggtccaaaacacaaccactgtgtttaattgaaaacaggccccactgccaatgcgttggagggcatgaggaactgtgttttagctttagtatgtgtcctctcaaagaaagaaagaagttctttaagggttaatatgaaattaaggaatttggaggcctctcctgcttgtccttcctccagggtatctgcatgatcctctttagattcttagttcaactgctgaatgatgataaaaaatgatagtatataataatttcgaaaacaataaataaaagaacagtagttcctgaatggttgaatggaaagaccccttggcaatgcttgcttgatgatcccaggaggcagaaagaccaaatgttttcttttatgaatattcatttcatcgtctaccctaagcactaccacttctcagcatcgtgggagacaggatgatactacctgtcatttacctcttgctttttcttcttcctgtctaatagcccaatagaatcctgccagaatttctacaaagatttcacattacagatcgacatggctttcaacgtgttcttccttctctacttcggcttgcgggtaagtttgtgcaacattgttcagtatcacaatggggtgtttcagtctgggacccagggatcatccccctcagcctctgctctcgcagtcaagatatttccaggagaaacagcgcacccgcattctgattttcagtctgagagagagccctctccttagctaagcattttctggaattcacatcagttttgtttcaagggggagaaatagggattgaagaaaaatgatgatgtatccaccggtggattgtttctcatctctctattcacataatgccctgttcccttaaaaattaaatagaaataggctgagtgtggtggctcacgcctgtaatcccagctttgggaggctgaggcgggtgaatcacctgaggtcaggagttcgagaccagcctgaccaacctggtgaaatcccatctctactaaaaatacaaaagttagccaggcgtggcggcgggcatctgtaatcccagctactcaggaggctgagacaggagaattgcttgaacctgggaggcagaggttgcagtgagctgaaatcacgccactgcactccagcctgggcaacagagtaagactccatctcaaaaaaataaaacaaaacaaaagtaaatagaaataaacctcttcagctcttaaaattacgtttagcagtgttcacttagctgagccctgagagagcagttgtgagtatgaatgaaaggaaggtgaggagagtagatggatggaattttgtgtgtgtgtgtgtgtgtgtgtgtgtgaatgcgtacatatgtgctttatttatagttatatttacatgaatgagtctaatacaagtaaaatcacccaatcttccctatgaagctgttgggaaccacagaaaaatacactgcctgatctttctcttaagactagcatagcatatagttagtctatatagggctctctatggggcactagaaaacgtgtgtgtccaatcataaaagcatgtgctttgtgtagatatgagaaggacataatgtctccctccagaccttaaaaattaaatagaaataggccgagtgcagtgactcatgcctgtaatcccagcactttgggaggctgaggcgagtggatcacctgatgtcaggagctcgagaccagcctggccaacatggtgaaatcccatctttactaaaaatacaaaaattagccgggcgtggtggccctatgaaaactcaaaacttaccctttgacaaaagagtgtacattggatgccagcaccatgcttctcatgttttttctctttcttatttcttctttcccccagtttattgcagccaacgataaattgtggttctggctggaagtgaactctgtagtggatttcttcacggtgccccccgtgtttgtgtctgtgtacttaaacagaagttggcttggtaagtcagcctctctttccttctccttcctggttcctgagtcatggctgaaggacagaatttgcagtggatgagggggctgtctccctacaaacaatgttgtatgtattaatgtgaacaacgggctcttggagttttagaagttgatggtggcagctctctttggagcactagccccaaagggtttgcacagtttgcgcttcaggcagtgcagttttatcattgtcaaagcctagtggtcatcactgtcacagccagggcctttatgttcatggttctgtcacttttcattcaggaacttagagtcaggactggattaagaagcccatgggggtaaggccaactttccgagtggctggctcaggtaccccagaggcctgcctgccaaagttagctttggtctgcttccaaaaagtgggttctgcatggtctatttataggtacaaggttctttgtagggcagggagagatgaagcttcttgagtcatctctcaccttacaggagactgaggtccctttctgtgttaaggggagagtgctgctgggctgtactgtacagggcacctcctggaccaggactagaacactttagtggagaaagtaacttgaccagaggatagtcatggaagcccagggcttagagagacagcttcaagtttctcattgctgcgttgatttcattttttccctgaattcagagtattcctgctgtcatggggtctactagggaagaaggcaggccgaaacagaacctggaggactatttgtgggttccttctgtccttatttttaggatttttggcttaattatttaaaaagtaatatgcatgcattgtaatcaatgaaaacaaagatgtgtgaagagagcattcatcatcttttccccttgcctccatcactgcctcctcctttagacacccacggttcccaggccttcacatgtgcacacatgatagtgttttagagatggtggtgtttgtataagaaattgtttcaaataattacattgcaccacaatttggcttcctaactaatcatgatggacattccgtcagctctgtgataactcattttgtaagagttgcataaaattccataatttgtttgtatcgcagtatattcagccataaccctaatgatagaccacctgaatgttttccttttccttttattgctgctagaaacaatggtttaataaacactgttattcatatatttgtataattctaattctatcaatagttccaggttcctggaagaggaactgctggttcaaagaatatgtgtattttcttttgtgcagacattgatggataacttaaaaaatgttgtgtcaagataggcttccgctagcaatccattttgatgccattgctagcactgggaatttattatatacctagtgtcaagtatttttttaaaaaataagcatcttcttaatatagtatgtgtggtaatctctatattatatgcacatacacgtgtgcatgcatatatatatatatgtatgtgtccatatcctaaaaagatttcttttgctacagttttctcattagaattatattctcttgctctaaggaaaagtttttgttttggacctgagatatgcttggttagactggattttttgcttatcgtatcctgattcctccttattttctccgtatcgtatcctgattcctccttattttctccttatcctgatgaggctagtagagtcacacacaaatctgagaagtgtcctcagtgtaacttacgtggccctgggtgccagcagtcccagctgctgtagcttcactgctaactggctttgtgacctgggagctcaattttctttacctagcctgttgtttttcatctgtaagataaagatttggctagatgacttcgaagaatcttttagctcagaaagtctttaaggttcttgggtcattaatgggaaatttgggatctaggtcattggggtggacagggaagctagtagaattctatcagcagcacccctgagtcaaaattatggatgagttgttaacagggactccttttaaaacatcttgttgctaagagttcaaacacatacccatgcacacacagggaaatcgatggggaaggggagaggtgggatctgccttcttcactgagctgtgcttaattaccctgtgcactcgaacaaccactttgcttttctggatcctcagttttctcatctgaagaatgggggtttaaatgaaattaccttctagtcctcacacttcatgaatctgcactttctgccagtgtccattgtctcttggtcccctgtgggcctgggtgatggaagggctccctggtgactgtggtggagacatcctcctctgcagtgagcagaacatgcccccggtaaaagtgtggagcccagcttccttgtggtgagtgacacgttccctgaagcattttagggccaggagttctggtatgctttgaaatccatagccttcctgtggatgatttaattctgatttttggagatatgttgtgatctcataaaaaatctattggcacaaacacagaatgggggtgaaaaaaattgaataggaaataaaagaggtggaaatgaatttctaatgagatacatctttgtatcaactgtggtcgctttccaaaagaaatgtgctctaaatgtgcttccatttgtatattaatatttattgagcatctactatatgtcaggtaccattccagatgattgggaaacaacagtgaagaaatagagtcctatccccctaccctcctatactgcagtgttgggaaagcaggaaacactgaacctaataaggaagtaaatgatacggtatggttaggaagcataagtactattgaaattgaacacatagaacaataaccttttgggatatgaaataataataacaaaaataaaaaaacctctttcctcttgtaggagaaagcacctttaatgaaatgctttaggttctttggtagcgaaatctccttgggtgaaatctaaaactgatctccctgttatggaagagaattcagtacaataatatttcaaggaggttctcatctgacttaatacatgggttattacattgtgaaacaaccattgtaccaatgagcttccagagagaaaatgaacattcccatgagatatgacttataaaggagaagaaataatcccattaaataggggcatttcaggcatggctgcccttctcctggaaagtggaagggtgctgccttttctggctgaggtttgggataagatgcaggaaaccgaagtctatccccattctcctgcacaaactttcctggccctgctgagggtacaggactgtgcggtagctggctctgtgggagataaaaaccagagtgaatgcagggtccctgcccttacctgtcccagaacgctccccacaccgtgtttagttttcaattgtcggcatatgattgcgtgttgtatagtacagaatatattcattgtgcagatcatcctagtgcatgtaacggtgtactcatagagacactactatgtagtcagctcctactgtgtgatgggcactctggaaagcccctcacagacacggactcacttaatcctcagagcaaacctatgaggcaggacttgtcatttccccatttacagatgaagaaactgaggctaagagagattatcttgtccaaggtcacatctcctgggagtggtgggaggggtgcattccccagtatgtggtctgactttatgtccacactcttcctctgctcttctttctgtgtccttaccccttgaatgatttggagttgtgaggcctgggttgggaatgacagggctagttttgctgtgttgtgttggcatccctccatcggtgcttactcataaagggcttcactccaggcaggaagagagggaagagatcttatttaagactccgtgttctcctggctcctctttccccctcctccttgcccacctccagtttctagaaatgccaggaggaccagaagaatgcagagctagcctggtgtctcccgagtcctagtgcccctcagcagcttggagatccgacctgctccatctgggacagagagactggggcttaagaacaccccggatattggcgcagagtagattaaagctcagctctgagctccaccaactcagtccacatcttggctaaactgtttgctgatgggtcgctcagcatgagcattttatctgcctcaggctcagttatctcacctgtacaatgggctaattacagcacccacctcatagggattcaccgaggtaatgtgagtagcacagcacgtacttcatacgagcttaatgaacagaagccaggattacctcggtctctctttctaacctacccatcatattttaaagcaccgcaggagaaaacaaaccagaacagaataaaaaataaggcagcggatgtgaggacagtcatgtcggcaagcagcaagacgctgcttattttaattcctgtccccacccaccaacttattcattttgtttcccttacaaatccaaacctcactaaaataaatgcaccttgaaatgagagctttatcttattttgagatttgaataacatgctccaaggagaactcatatgtccgtctgtctcattctcttttgggaatgtatccccaaggtaggtcaatgggctgtgctgcctctgtttgtgtgtatgtttttttgtttttgtttttgtgttttggagtttcgcccttgttgcccaggctggagtgcagtggtgcgatattggctcgctgcaacctctgcctcctgggttcaagcgattctcctgcctcagcctccccgatagctcagattacaggcacttgccaccacacccagctaatgtttgtatttttagtagagacgggatcgccatgttggccaggctggtctcaaactcctgacctcaggtgatctacccgcctcagcctcccaaagtgctgggattacaagtgtgagccactgcaccttgcctgtgtgtatgtttttgttgagggtgatcttgtaggatttaaagaagggagtaggaggaaagtaatgatgcactcaccagccagttttctagcccatttttattacctactgtgtgctcagcactgggatgagaggaacacatgccgggccaccctgtatcctactggtactgtgatttccaacaccatcccctgttctttgactgatgaaatcggcatatgataagggaccatggtcattggaaccatgattggaaaactataaacttgattctattgtctgtatcagaactggccttagaccttaaaccttaaaaccttcagtaaactctgctagaaaatagaaaaatgagttaatgcccaatcacagggcagttgcaatgatgtagggtatctgcttataaatatatgcccaaaatagtcctttttttgtgtcagaaggcaataaaaacaggattatataaaaaaagcacaggtgcttaaaaacaacaacaacaaaaggacaaaacattgttcctgtttgagactaaagtttcaatctcattttggaaccaaaataaacacacatgcagtgacagcaggtaacactacccactatataattaagcccgtaattgcaaggtacaggctgtaaaggccatgggagttcagaggagtgagagctcatgtgggtgggagaatgaggataggcttctgtgagaggctggggctcagtggaggctgcaatgatgggctaagacagggagaatgaagcctagtatgtgtggagcatggtgtgtacccacagaagctaataacagcctagagaagaaagtggccttgctactggggaggatgaggcaggaggacccctgagctcaggtgtttgagaccaacctgggcaacatagtaagaccctgctaaagaaaagaaaaaagaaaagaaaagaaaagaaagaaagtcagaaagagagaaagagaaacagagaaagaggaaggaaaagaaaaggaaagaaggaaggaaggaaagaggaaagaaggaaggaaggaaagaaggaagaaagtgaaggaaggaagaaaggaagcaaggaaggaaaggaaggaagaaaggaaggaaggaaaataaaaggaaggaaagaaaagaaagaaggaaggaaagaaggaaggaagaaaggaaagaaggaaggaagaaaggaaggaaggaagaaagagagaggccttgctgagtgccaagcatcagcctcacaaccttgcaaaatggtgtagaagttttctatttccaagcagttctgtgggtgagaagtccaacatgggtctctccagaggctctagggaagattccatgtccttgccttttccagcttctagaggccacctacaccccttggctcatggcccctttctccaccttcacagccagcaactaagggtgcatccccaccttgcatcactctgatcttgcttcctgccatctcttctttgcctccttcttctacttttaaggactcttgtgattacattgggcccacctggatactccaggatactcttcccatctccaggtcagcctatcagcaaccttaatttgcctgctgcgttcatttccttctggcatgtagatgaccatattcacaggtcccaagattaacacagacatctttgagggtcatcgttctgcctaccaaaaggggcatattattattcccattattatttccaaagaggaatctgaggctctgaggggttgagtaacttgccaaagtcagagcccagaagagggtgcgctgggatccgggcccctgttcagatgtgccaaaagctctgcagagccttttggagtcctttgctccaggggtcattcacggccctttggggccatgcttcatgttattttacagcctgttagggaggagaccgttggggagagccttattgaagctcaacaccctcccacacccctcatttgcatggagtgacatttttttttcttttcatgggaacaggtgagttactagacagacttgcctgttgtctgttgttcttacgcaacttactctgaggtttgggtgccccttcctgtgcagctgcagtgactgaggggaacatattaggtctgcataacctccacctagtagccctcttttttaggaatcatgctttattgctttctggagtttacagagaaacccaaatgagaccaaagagttgtggtggtaggccaccattttcctaagggaagcggtggatggggtcagcacaccactcttccttttaatggttaccccacccagggctcagctgaagtctcaagcatctctctgttcctctgcttcaatggagcatctgggcccaaggccacctgcttggctgaagagccccgccccaccttcaggcagggtcaggatgattctgtgaatctctggaccttctgttgactggcctctgcatttggtaagaataatcaagaatgaaagctgtggcctggtttcagtttcctgacatcagtaattttcagtgtttgggatttaaacaaacacaaatagtatggtttggccagagagtggaggcagaccctggttggcatccccatatgcacagccctgcctcctgcctcccctttccctgtacttcctgccccagctccactaggctgctagctgcatcttcttgctgtctctgccctgtgcctggtcatgagtaagttcctgccctgactctgcaggttgtaatccttctccccattaaggcacagctctgactccagctcctgtgtgcagctttcccattctcatccattggaatgaattcctctctgacctttgtattgtgctgttaggattcgtgctataggagcaccatacgcagcctgctttgtactgacaggtaggactgcagcttccatgatagcaatgtggcagggactgtggcccccttgtttttcgctatgtccctagtacctggaacagtgcctgacacatagttcatacttgttgaatgaatgaatgagtgagtcttcttaggatcatgatagtaaggaacagttattgattgcttattaaaagtaggcactatgcccagcatctcacagtcattctctgagttaatattcacaataactcgatgagtaaatattcatagcccaagtttacagtttgggaaactgaggttcagggtctaagtaagtggcaggtccaagactcaggttagtccaattctggagcccatcttttaaaatgattagaccagtggttctcaaagtgtggttcctggatcagcagcatcagcgttactggggacttgttacacatgagggttcttagagctcaaccgagacccagggatcagaaaccgcgagttggagccagcagtctgtgttttaacaagcactcctggtgatctccagttttggagccaccgtactgacttatgctgggatggttctcgaatttttattagaatcccccagagtgcttttaaaactcttcatgttcaggccaagcctttaaaccattaacctaagaatctctgggtggagggtgtgacctaggctcagcttcttttaatgtttctcagttgtgtctgaagtgcagtcaggatgagaaccacttgtatgcatctcctaactttctaaactttactgtgcatgagaagcaccaggagatcttgttagaatgcagtttctgatttaggaagcctatgctaacgtcagagatctacatttccaccagctctcaggtgtagtgattctcctgctctgtggaccacactttaaatagccaggcttaccaatccacttaaaaatggccaaaaccacaattacttttgcaccaaactaatacactgtgctgtccagtatggtagctcctagccacatttgcctatttaaaagctcagttcctccatcctaccagctgtttttcaggtactcaagagccccatgtggctcattggctgcggagctggacagcacagatgtggaacattccatcatcatagacagttctgtgggaccacgctgctctagaatgagtctgtgacagcacacaccatggctttttactttttgtatgcccaggacactcttgcacatagtggaagcttagcaaatgttttttgaagtgattttgagtgaatggaccaatggtaaaaattctatatctaaaagaaataaataactttcctgaagaaatgctagagaaatcatgaatacactgttaaaaggaaccctctaccaccctacccaaattaaattaaatatacttaaggactcagtaggccaaaaagcacaagagacactggaccatgctccagctccaggacacactactctgctgctactgaaatggcattttgggctctgaaaggaaaggtctctggtgccccctagaggctggtcctgcaatttgctggatttgtgagcaattaagtagcaaggggagaggggaagggggccaatttcatcatgctcagatgggcagttcgtggttagcagtggtggagataggctcactttgaactcctataagctatttgacatctgataacttgactcaaccgctatgaccaaaagcacccctcccccaagggagttgcttctcagtgacagtgcccgaagcctggaaggaagggcccctgagtgcccccagaggtcacccactccatgttccaggcagctgactttcaacttggacatctagattccctgaagcccagagccttctaagtaaactgctgtctgtagtctgtgggtttctttagaataagaatagtgaaataaagaaaagaaaaagtatgatttccctttttgggccaggtgtccttaggagagtgggggttggggggtttgagagaaagagaaatccaaaagaaaagtgcttccataactagaataaagttagatgtgttcatattacacatattacatatatgtgtatatatatgtatgtatgtgtatgtacatacagtatataattgtctcaagtgctcttccaaacagtactatgaaataggtgtcatttgggggcccatattacagatggggaaactgaggcttcagaaggttaaataaattgctgagagtcacctagtgagtaaatggtagagctcagctttgatctcaggcaatctacctccaaagtccatgttacttgatatgatactatgctgtctctcaagctacaagttaacacatttttaataacttaccagcctccaaactacttttttcccccaggttcaccagtcccctcttctgagcttcttgacccattctatacaagtagccaaataaataaaaacaatccatgtttttaccattagtccatgttgaaatagtatcatgctagatgttatgggctgctatggtctgaatgtttgtatctgccccaaatgtatgtgttgaaatgaaatcccaatgccgtcgtgttggagatggggcctctgggagatgattagatcatgagggtggagccctcaggaatggtattggtgcccttatgaaagaagcccttgggaggctgtttgtccctcccaccatgcagggaaacaagaaagtgccatctatggagcagagaaaaaaccctccccagatgctgaatctgttgtcgccttgatctgggacattccggcctttagaactgtgagcaatcaattgctgttgtttataaattacccagtctaaggtattttgttagcgcatatagactgacatggggctctactcttggcttgagctttttttttttgtttttttttgagaaagaattcaatggcaacatacaccttatgaatagcattgcaactgaattgctctagtgtgacaagaaaaatgaactcattattaagttctgtccctatgattgggctctgaagaaggcagcccagccaagtggaatactaaaaatttggatgtatttcagggagctcattgctgttccggtcgctgctatagctaaaactgcttctagagaaattactcctctccaagagatttccaattgtgttcccttgatattgctttgtcagggacacgctttaaataagatgccctccgtaagtagagattctaaatcctcattgatttgcatggctctgttatatgccaaattggaaataccatcctaaaatgaatgtcttcaaggaacgaattcagcagtaggtttgcatggatgccaaaacctctccagatggctgtacttcatctggggtattattggaacagcctcctcagcaacctaaatctctaggactggacgtatatttaccttcacatcatcttcaaaaaatagatgccttgattcttttccatgagaccagggccataatggattgacctggctagcagatcagatagggagaaaatgaacacctgaaaccagctcagggattcgactgcattattcagctgaacacctactgtgtgcaaatccctaggtgctaggagtgacccaaagatggggaaaacatagatcttgcctctataagatgttaataacttaattggagtgtcctctagaaagaacagtaagtttataggaatttagaggaggaacagatggaggaaagttggccatcccagcccaaagtagatttcaggtatctaaaatataaacatgtttctcctagagcaggactactcgaggtgcggtctgcaagccagcacatggcctgggagcttaatagaaataaaaatgttggagttcaaccctaaacctggagaatctctgaaaggtggggctgaggaatctgttttaacaaattctcctggtgattcttctatgggctaaatgatcttggcagtatgttagaatcacccaggaactctgacacgtcctcctggccagactgtatttctaaccaagcatatgagaattggggatgaactcagtcaccagaatgttttcaagttctctgaataatttcacttgtgcagccactgttgagaggcctggcacagtggtggttcttaaaccagaggaacatacctgaatacctgagaaacttcaacacacacacacacacacacacacacacacacacgcacacacacacacgcacacgtactttccgaaatctattctgtgaggctctttgggtcgtggtaaggacaattgctttggaacaagcacactatgtattctagatagaccagtggttctcaaactttgagtgcaccagagtcacctagaggtctggttaaattacagatttggggtgttccatccccagagtttcagattcagtacacctgggatggggcctgaggatctgcatggctaacacattcccaagtgatgctgctgctgctgatctgggggccacactttgagatctgctggtccagcccacggtgaggctgaacttgaattctagttgtagctgctatgcaagtttccaggattctggtattagagtaaaccttgctattttgtgctcctaaatatcagtattcttattaatgtaatcctttatttcatatgtttttgagattaaaatctgagtcatttacatcttgagatatactcatcctatgatattccatattacaatttcaacttgaacagcagaacccttttcccatagctcttggatcttccacttgtaatccccttctaaggtattccaagtccttggttactagtaagaatgagcacctttgcttgactttattagtcactagtattttgtctagagccaatttggttgatatcgcttcctaaactctctgaaattaggatagggtcaactcattcaggaaaatagatacagggtgtgttggagattagggaaggagaggggcggagggaggtcccaggccaaatttctaactcatccctagagtctcacctccgacgttctcccagggatggagcctcacctctgaccttctcccagggatggagcctcacctctgaccttctcccagggatggagcctcacctccgaccttctcccagggatggagcctcacctccaaccttctcccagggatacagtatctcagcccgctcctcgagggaagggctctcttagggtccagcctctctccaatagcagggtgacttatttgaacaaatcttctttcccagtcatctcacttgcagacactgagatgcccaggcctgggcccaagcctgctcatgagagtaagaacagatgataggtggtgagcagagctccatttttcttttttttaaatttatttttattattattttttagattgggtcttgcattgttgcccaggctggagtgcagtggcacaatcttggctcactgcaacctccgcctcctgggttcaagtgattctcctgcctcagcctcccaagtagctgggattacaggtgcccaccaccacgcccagctaatttttgtatttttagtagagatggggtttcaccatgttggacaggctggtcttgaacacctgacctcaagtgatctgcccacttcggtctcccaaagtactgggatacaggtgtgagccactgtgcctggcccatttttcataagacacactatatcactcgaaataaatgccaaacactagtgtggtgacactttgctcccatatcacaatcactaaattcgacttacccctttaaggccaggtaggaatttagcaacccagctcataaagggtaaaattagcttattatttcctgagtggattgcaaacctcactggccagattgggagcacagcagatacttcctttttgtaaaaacttggctgagtgtggtggctcactcctgtaatcccagcactttgagagcccaaggcaagaggatcgtttgaggccagcctaggcaacacagtgagaccctgtctctacaaaaatttttttaaaaaattagcccggcatggtggcacatacctgtggtcccagctactcaggaggctgaggtgggaggattgcttgagccttggaggttgaagctacagtgagctgtggttgtgctactgtactccagcctgggcaatacagtgaaatcccatcttaaaaaaaaaataaaaataaaaaattaaattaaattaaacaaacaaaaaactcagtctcatggtcttccttctttatattctcacctagccttcttctccagccctgtttgcatttttgtgaatttctcccattttcactctagccagcctacttaccaaccactcctacccaatctcagatatgttccatctccatggttttggtagtttcttgtctagcagctgctttcttgtcttctctgcttacctgcactcaaccagttattatcctgttacttgcctcttccaaaaccactatagtctgagccactcttttgatcatgggtgatcttctgatgtggttgtgtttttataagtaacatgtacctgtcctgactcatcaactagatcaggagttagccactctggcctactgcctgtttttgtaaataaagttttcttggaacatagccatgttcattcgttcacatattgtttatggcaatgacatgaagaagataggacccaaaaaagccttaaaaaattattatctttctttttagagaaagtttgctgatccctggtctagatttgcagctatgttatatattcttttatattcctctaaatgtctggcactatgttttgcatacaatagctactaatcaattttgatgacctgaacatgaatttttctctgaaatccttataaatgtaataggaataaaataagttatttttgctcttgttattgttattattattatagctgctatgtacagtcctgctacataatgtttctgtcagcaacaattcccatatgcaatggtggtcccataagcttataatatgtatttttactgtatcttttatatgtttagatgcacaaaacttaccattgtgttacagttgcttgcagtattcagtacagtaatgctgtacaaatttgtagcttaggagcaataggctataccatatagcctaggtgtgtaggaggctatacaatctaggtttgtctaagtgtactttatgatgtttgctcaatgacaaaattgcctaatgacacatccctgtcattaagcaatgcatgactatattttgtggcaggtattggacaaagctctttaccggcctatctcatttaatcctaacacacaggtagaggaacttggaacttggagaggtgacctgtgtgacctgtcttacttgctgtatgacttcagcaagtgatacagcaagaattcgaactcacatctttgtgatctcagcgcctgagcttttaattactactatatacccacggtttagtagtaactcatacatgtgatgagagacagaaatgtttaaaagccctaccaatgagataaatcatgtaaagaaaactggcctatgttataaataggctaggagcaagatgaagcaagtgaccctgaaagcgagggcctcagctgggtgcagcagctcatgcctgtaatcccagcaatttgggaagctgaggtgggaggatcgcttgagtcctggagtttgagaccagcctgggcaacatggtgagaccccatctctacaaaaaatacaaaaattagccagacatgatgctgcatgtttgaagttcctgctatttgggggctgaggtggaaggattgctcgaggaagtcgaggctgcagtgagacaagatcatgccattgcactccagcctggggacagagtcagcccctgtctcaaaattaaaaaaaaaaaagaaagaaagaaaaagaaaatgagcgtgcctttcaattttgttccctggatgcatcactgtcttaccctagtctctgccctggttaagaaacttcataaatattgccggtttcattattatcatcatctttattattatcatcattcactcaacaaaccttaaaacaagtgtaatgtgccagctgttgtcctaggcttggagtttaaactaagatattttagccctactataggaaagatgaatctataaaccccagattgcaaacacaaatgcttacagggacaagaagataacaaatgggtgaagcaggccaggtggaggctgtctctagcaggagagtgaatgtctctcttcaaaggaaggctgttccatgaaaaagaatgaaaccctgtcatttgtggcaccgtggatggaactggaggtcgttgtgttaagtgaaataatccaagcacagaaagacaaatattgcgtgttctcattcacatgtgggagctaaaaaaaaggggatctcatgaagatagagagtagattggtagttatctgaggcagggaagggtaggaaggaggggaggatgaagagaggttgattaatgggaataaatatacacttagatagaagaaataagacttggtgtttgatagatcagtagggtgaccagttaacattagggtgacaagttaacatgaatcaattgtacatttcaaaatagctacaaaagaataatttcaatgttcctagcatgtagaaaagataaatattttaaggtgatggatgtcccagttaccctagtttgacaatatggatgtatcaaattatcacatagacactgaaaatacatccatctactatgtattaattttaaaaagaggctattgatcaacctttggcaaggtcttgctgtattgacagcttctcaatgtccactagcagttacctccttctccccttcatctttcctacattaaggcaaaaatacagtattcagttaaaactcctcctcccctccttcttttcttcttcctcttcatcctcttcctccttctcctctccctctccctccttctccttttcttttccctcctccatgtccttcccctcctcttcctctctttcttcttccttcccttcctcttcctctgaatcaatcatttttggccatagcgacttgccctttgcaaactagtatgtgttgcagtattatgatttctctgcttgagacaggaacctctggtgttttggaggaaatttcatcttgggctgctccccttcttaccacatctgttgcccagtatccaccacaaagcctgtaacttagcatctgcctataacaccaaacaggttgcatcagataaacaaaaattcttactgtggtaggtgaatattttagcaaacgtaaaatactataactcgaatttacaaactgggtcagaagtgctttctcatgttttggtgtctggagcaacgtgcacatggtcagaggacttcttatttcaattttcttgtttgtttatatttattttatgaaataaatagcctcccttccattagtacaagtacttctggtttgttagagacgaagggccccagctccactgggaacaaaggggacctataggaaacacaagtgtcgccagcttttccatgcactgacctgccctaatgtgtatcctcctcccatagcccgcagagactccccaacctcactttagctcaactgcattttccccagactgttctgaaaaatgtgttgtgacgtgctgccacctagtgaaggaaagtaggaatggacattatagtggctgtcgccctcagaatcctctttgaagcctggtttagttaacctctgccgaaataaggtcctacgtttttaactttcagaaaataactcttataagactcccaaagggtccaaagactatttagtgaagactgaagaagacaaatgtcaagtgaatagctaagagtttgaaaagtaggtatacgtgttcgggctaagtataaatggaaaacaactccccgcagaaaaccattctaattggacttgcagggcaggttaagaggaggaagtcagcccgactccagagtacagacattacctgttttcactaaaataaaggactgtcttcaattgtttgcattatcattttatctccgtagaatattttccttcggtcttttgactgaattggttttgaatttaaaagaaatattgaaatgatctgtcactttactttttgcctatcaagctgtcagcttcaaaaaatgaacaaatgtatggattctgaatagatatgtttctcagacctaaaaagaaagaaaatgtgttaataaacttgcgtctagtcatcatatgtgtacttcaatgtgtcagaactgatttatgaaccagaagtactgtgtttaagtgaggacttctctgcattcatattttaagtattattatttcattctttcctcttggggggcaagttagtataatattaccattgactaccgttgggtgggtcccaaaggtcatttctgtggaggataatagagcttttcatatgagacactttcagctgcctagcagaggcagcacactatgacaagtggccaaaaaaaagtagtgaatatttttatcgtgagttttcatggcatgaatcaactcattcttcagaagtctgtatttttttctttctattatggcatgtctgtcatttcctttgactctctggctggtcttcatctcagcaaagtggaaaaaacatattttagatgggaaaaaatgggaagaaactgaaagagggaaaatatccctaatacaaggagaaacacaactctagattccctattgccatatggaacatttaggatttcccaggaggaaacacgttcaaccagttgcttctgttacctccggactaagagggatcctgatagtagctgtggctggtgaaggaacacctctattatctggctctgggtgctgcagaaccaggcagttaacaggacaagaaaaccaaatgatccatgggtgcaaatgtgcttttgccaaagccacttccctggggtctagatagcgaagagaaatggtggcttctagaggaggaagagctaggaagtaatcctggagtccagttgtcttttcttaaagatcatgtttcaggattccaaaaaaaaaaaagaaagatcaatggcatgtaggagggtgggggacaaagagggtgaattatgagtttgtgtctgtgttttaaaatagccacctgccttgaaactgccatttagaaatgtgcatggaaggagaatcttcctgattcttagctctaatttatggccaatttatgaagtcaaggtcatctctcttcctgctggtgtgtgttcaacctggcctccctttatgccaaagaccttgagcagaccttggctaaaacccccaggtatactcccattcactgtcagcagtgatccgtggaatggattggggctggccgccttgccttgggcagagttcatgtgtcactcaggaagatgcatcaggctgctgagtcagagggagtctgccttatgtccacagagaggagtgaatcagaaagccagatgagtccagctctcaggacatgacaaattgcagaatgccgagctgggaggcttgagtacatcatatccttcttattctactgatgagaaaactggggcctggggatgcccaggaatttgcttacatttcttctcctaatgaattaattctttcatttgttcaacagtgatgccctgagtgtctcccgtgtgtcaggctttgttctaggtgctggggttagaaagaggaagagtgtcacatgaggagaagacacatgtcacaggtcattctaaaagggaaacccaactgagaatgaagagtgtctcagggcagaaaaaggaaggagcaaagacatccaccttggcactagacaatttgggtcctgatttgacagtctttagtaattagcataaccatcagtacatcatggaagcttaccccatgtaccatttcttagctctcctcactgttgtgattgcaaaggtgcttggaaggttacttgatgagcctctttctgctgctccagacccagactgtgagttccatcaaggcagggatctttctcagctctctgttttatccccagaatgggacagagcactgcacgcatgggagatactcagtaaatagccactgagtgaacaatggaatgaatgacaaatgataagggttcccaagttccattctatagaataagggtcagcaaaattcttccataaagggcctgatagtcaatgtttttggcttcaggggctgtatgatctccaccaccaccattcaactctgcctctgtggcatgaaagcagccataggcaataggtaaaagagtggacatagctgtgtcccaataaaattgtattcgggacactgaaatttgaatttcatacaattttcatattccataaaatattctaatttttttagctgttttaaaatgtagggggaaaacatttttagctggtgtcctgtgcaagaactggtggtggccagatttgtctcacaggctgtagtttaccaacccctgctataggaggaagattaatagggtaaagattttatgaggtttttaattgattcatttatccatatgtttgagcatttacttactctatgtcaggctctgtagcagacactggacatacaaacagaaatattagtcaccaatatcaagatgaaatcattatccttgatgggtcagatcttccgaggatgagtcacgaccgtgtaggaaatatgaaccccgcagtctgtttaattgatgtatgctatgcactctaaaattaattggagatttctagataaaactttccaaatgtcacaagtatccttccagcatttcatatttacagactggaaaatcaatggagatggaatcattctcccactgtctctaagttaatttgcctgtctaatgctttaacactttctgctagttctgtctcattctttacccattggagagtaccagtgggttttcagataacttccttaaagaccagaaagaaagatttaaaaaaaattccagctccttccttttggctcgggtcttccaggtctttatcttgatgaaaactggaggcaaagatgttatctctggattgtagtcagagaacaacaaaaacccccatcttttctttcccaggaaaatattaatcaaaatagaaataaggtgagattagaaccttagaaggttttgcataatacttttcttgtttgactgtttctggcctgtcttaatccaataatctattaaactctagctagtactttctttcttcatccccagcaaatttgcaatcctccagaatccttttgggaattccaaggcaaacggccttaaacaagaacataattgtctgagagattttgtttgcttatcggaactgtttggtccacagcattatctgcatgggggcataattcccttagctgcagtcagttttacaggtctttgctcataggattacagttcttttacataaaaggatgcttggaatgggggccaccaagagtgccaatatttagtatctttaactgagctcaaagtaataactacttaactagaatcagtgtgcttcttgatatctaggaaaaaaaggcaaaggaaggaaagaacaggatttggggatgtaatttgagattaataaatgattcactcaatagatacatatggatcatagcactctgcttgttgtgcatggtatactgtgaaatgtaagacacaatttcagcctagagtagcttaatctagttatagatatgggaattccaaataccttttctacaacaagagttcaaagtctttcataagtcaatataacaaaagatgaataaatagttaaataatactacagaagagtaaacatgagaagacatgcatttaaatgtatgcagagcacttattgctttggatagaattcacatgttatccatgcgttgactacaagatacatgcacatctctaaacacactcataactgaattcagcttaataggatagtaattgaatgatggaacctagtgtgcctgacttttctcagatgaaatatctggctggtgcaatgcagtaactactattaaaactccatcaggcatggtggctcacacctgtaatctcagcagcttgggaggccagggcaggaagattgcttgagcccaggggttgaagaccagcttgggcaacatagtgagaccccatccctacaaaaaaaaaaagtagttgggcgtggtggcttatgcctgtagtcctaactacttgggaagctgaggcaggaggatcgcttgaggcaaagaggttgaggctgctcagagccataatcatgccgctgtaccccagcctgggtgacaaacacagagaccctgtctcttaaacaaaactcactaggatataccagtgagtccatatgaagaatcctacccatccttctcaccttggcctgaatgaatgagtacaagtgtcagtaaaacagctgttatttatttccttatcccacatctgtccttgaaggctgtcatgtggtcaaggaccatggagccgacagacaatgtttctatcaacaggcagttcaaaccaagcctgtggctgaccatattgagtggatgaaagagccttggagggactgggccttttagaaaaataggctcgtaagtcaagagcatggtgtcagctgtctgtgtgtatttcatggtgagagtgaaagcagatctaaattatgagttgttgagtcacctgcatgaatcaattcaattcttaatttgaaaggaagctcagtgccaagggaacataacatatggaaggagtggcctcaatgactaacaaaaccagggcctattagggttgcctgagtttacttaggtgcatttataagacatgacatttccacagctgttcaactatgtgaaaaccttttgtaagcattactgtatttgataaactctgtgagatggatgttattgttatctctgaattggcagatatgggcaaggatgttccaagaggtctgcagtgtcacacaagtagtaaatagcatagcctgggctagacttagaggtcttttaaccagtcacattccccctcagcagtgagaactatggtctgcccctgctccctcagtgcacgccaattagttaggcctgtattcagatgggatgagttatgttctgattaggaaccacatgtagtatatgctataagttaaaagtaggcagatgtgcctgtagccatagggacttgctgggggagctggacttgagttgagtcttaaaacatggaaaagccttaactaagtggagtggagggccaagagcattccagacaagagaaaaaggtgagcagggggaggaatttgcatccttctttggggagccaggaagtggactggtgtgaatatttcagagtgatcatatagggaggcagctgagggatcctcagtgcgtggttatagtaactggagtggatttactctggggcaggacttactccgttgacacccttggagaagagcaggggaacaggaggagagccttcccagttaccctgttagggaccttctctttgaccgtgtcctgcagatgcacagtagttgggattcatccacctccatccacttatttctttttagctcattttgtttcattcaacagacattcccattaccacattctaggcactgtgtcaagtcttactgaagttactaaaaggaaccctcaatgaatgttttgtgaatttagacatgaatgaatgaacaaaagaaaagggacaagggctggtgagctcattcatgggggagaaggaagtaagtaaagaattccagtgtgttgcattgaatatggcaggagagtgctgggggaacaggcagaaaagagacagcctgacgtgtcccagggaagactttccaaaaggaggtggtgttctggctggttcctggagtctgaagtagaaatttgttagctacaggaggggggaataggcaggtcaaactgagggcaagtgtttgcaaatgaacaaaggcctgaaaattaggggaaaagcaaggatgtaggtgtaacttaagttgaagtggagaagaaggtaaggacagaagaccagggaaaacatttccacctgagactgaacagaaccacctggtccaaggtcacttcgttatgtctttaggcaagccctgggccaaaatggtgtggctctgggaactttgctcactcaaagccctacataagcccatctttcccataagaaggctgagggaacatctatctaagatagatgctagtaatttaacaaaaaaataaaaggcaacgatactatagggaagaaaagaaagaaaggagcggatgatgttacttggctattgttttcctaaaacaaaagcaagaaatgaagcatcttttaagagctggcctagaatgccattctgggggcttaggaaaaaaatcaaaatgtattagagctctctcagacattggatggtttatggcagcatctaaaattgctggtaaaattatgaccttgtaattcacagccgtgtcatatattctctagcacacagtgtaatttatgtaccaagccagttgcttcaaaaaagaatggggaaaaaactcacacaacacaaagtttataaaatgtggttatttttaatggataatgtctttagcctaaacctgtgttgttaggaggaagggtgtgccgttgctcaaggttattaccacagttcttgcagcatggggtgagagtatgaggattacttattacacttacgcattggctggccaggctaccatatccacaactacacagtcctcccttcctccctccctcaaagagagctatcaccttgaactccttcttcccttgaaataaaacctgggcaactaccgaagcttgaccttgactcatgccttaaacctgagcacaaaacttaacctctgctgggaaaccttcctccctatgaaacaaaggggtctcaagacaacttcttagcaagccaaaaatgagatttccactcagcttctcaagttagcctggctttgaccccagttatggagctagagaggggagaggagctgggagcaaactaggaatcatggagggggggactatggggaatatcagattcacacaactctcacttccatgaaaagggggaaggggagagagaggagactcccatggccgagtgatcaggtccagagacctccttgtggtccaggctgcacctgcaccagtctgcttgaccttgagcaacaagctatagtctctgaatcctatcaccctcacctataataaggagatgagctcttgccttcactacctaaaggagttactgtgaggatcaaagggtctattatagcttttaatcttgagccaatgactaggtcattatttttctcttgctctgcctgtatcattttctcctcatggcatacagctcttttgcctcaaagaagattcttgaggatgatgacctgcctcaaacttccttctccctaaaagtgttttcttttgttcagtttcatttctgtctttccacttattcctgattattttccctgagcctcttagagatctgatcacctcattgtataggagctatttacactccttctttgatatgaccacatgcttctctggatctgattcttaattctttgctacttccctccctgcccccaacccatgggggcaccagaagctgtgggaaaggaggcagcccatcgctaaggaggaggaggaccttgtcagggtgttggtggcgcaggtgaccagaggacagagctcactgctgtgatcctggagagggtgccaggacgctgttcccattaaaggcagtggggcttggagacactgcagcctcatgctcaggcctcctagactttggcccttgctgtggggctcgcctcgctgaaggcaggatgaagggcttatttttctggctgagatattgcatcccagaaaccacagaaatacttccaaaacccccaagataagagtgctcttattttgctccagcgtgaagaggagtttatttcatatgatcaagtaaagcaagtctggacgtcttccttatgtattttcaaaataattattttattatttaaaaaactcaacatattcatttaagagaaatggaagcaacacagaaaatgccaagaagaatgtgtccaacaaaccaaagcaaatatcataaaacatttgatcacattggataaagatcattctagatatttttctgtacagtagataagtaaataagttagacaaacagaaatttatataaaatgaacttgtactagcctcccgagtagctgggattacaggcacttgccaccatgcccggctaattttttgtattttttagcagagacagggtttcaccatgttggccaggatggttttgaattcctgacctcgggacccgcctgcctcagcctcccatagtgctggggttataggcatgagccactgtgcctggcctacatgtttttttaaaaaataaaactgttaagtttaagcttatttgtgtagtcacccagtggattttccctgtctgctgcacagacaaaagtaattcagtgagatggcagtattgctgtaaagaaagagtttaattaatgtgagtctggccaccctggaggactagggttatccttcaaatcagtctccccaaaggctaggaggttaggagtttttcaggatggtttggtgggcagggggctagggaacagggaatgttgattgcttgggggtaaaaccacaagcgtatggaaaacagtccactcgtgttgagtcctctgggtggggaccacaggactggctgagtcatgagtcttgggtccaggtggggtcagtcactcgccagaaatgccagaagtctgaaaaacatctcccagggccagtcttcagttctacagtagtgatgttatttacaagagtaattgaggaagttacaaatctgtgacctccagaacaatggctggttatcatttaactgcgcttatgtgttagcagaattcaggcacctcttataaccctaaccttatggcctttcgttagttttacaaggacaatttagttttgggaagggctattactgtccttgcttaaaggttaaactataaattcctcccaaagttagcttggcctatgcccaggaatgactaagggtagcttggaagttggaagcaagagggagtcagctctgtcagatttctcttgttgtcataattttgcaaaggtgatttcacttgaatgtagaaaaattggagaaaaatgaagcaattgctaaactttgtaacttttacctcctaagacatgctgatatgaatatgagaaagcaattaggagaaaagatgaaggtagagtcatgttttcatttaactttttttttttttttttttttttttaagatggagtctcgctctgtcacccaggctggagtgcagtggtgtgatcttggctcactgcaaactctgcctcccaggttcatgccattctcctgcctcagtctcccaagtagctgggactacaggtgcctgccaccgtgcctggctaatttttttgtatttttagtacagacggagtttcaccctgttagccaggatggtctcgatctcctaacctcgtgatccacccaccttggcctcccaaagtgctgggattacaggcgtgagccaccatgcccggccaactttgttttttaatttggtgtaaaacagatgaactttctgctgtgaaagaagagaaaatgacatttcattttctcccccatcctttcccctcacttcttagttatgtaattgtttcactgtgtcagggttttgtgacattctcttctgaggctatagctttcaattctatttagccttagtaaagtcttgcattttaaagtgttcagtactcacccaggttcattttttgcatagcatcttcttattgttttagttcagatcgtaatggtggaggaaccgtttccatgggactgagaagaaagacacttgtgttgacgttcaggcatacagggaatgaaatctcgggggcagcatgggagaggcagccagagccatggctgagcgtgcttccagggaggcagaacagggcagggtgagcacacatctggagttccactgcctaaatttcaaccgcggctccatcatctcattgctaggtgagcttcggcaagatgtttaagctctctgtgcctcaactgctgccacatctgtaaaatggggacaaccatggccaccgcatgtaaggtgttgtgggaataaaatgagtgatttaaaaatgattacagaggtatctgactcactgtcaatgtttgctcttgttatagaatcacactttttggagatcaatagcaggcaggaaagaattctctgagaatctcacagtcatctcctttctttagttgtttgcagggatcttttaaaatgtcaaccctttttcaatctgcttttgtggcccacctctttaaactttttccttcttcttagatggaaaccaagacctccttacggcccataaagcctgccatggccttagagcttctgccttctcctgcaccccccaggcttcttctccctgcctcagcaatggcaggcagcaacccgctcctttggatggcacttgcccctgcgtcccctgatggcccactctctcccttcagttctccactgatctatcacctcattagaaaggcctctgtggccacacagtctaaagtgtccctcactggaatttgtgtgttttatagcaatttatacaagcatttgcttgaagcaatttgtaattagttgtttgtttgcttcattgtttagttgtttcttgatgtgacttgtctgtactactaggccgtaacctacttgtgagcagggatcatgtctgtcttattcagtattttcatccaacacagagcaatgccaggcaccagcaggtgcttaataaatatttattgcatgaaatatctctgcctctatatatctgtatctctatatagatacagatggacattgcatattaaggtacctacctgtagagaggtagctacacagctgtctatatggatatagatactcactaagtggcctgaattattcaggcaacagtctttccatttcatcattctattttctctttatatgacaattatctaagtaatgaagaattggaatcagggctaggggtggttagaggaagaaatttgaaaggcaagcgacattcattgagcattagttggtggctgcacagtgctggatgttttgtgctgtaattcatttaatttctataataacctgtggtattagtccattctcacactactatgaaggaatcctccagaccgggtaatttataaaggaaagaggttgaattgactcacagttccgcatgcctggggaggcctcaggaaacttacaatcacggtggaaggcaaaggagaagaaggcaccttcttcacagggtggcaggacagagtgagttcaagcaggggaaatgccagatgcttataaaaccatcagctttcttgagacttactcactatcacgagaaaagcatgagggaaaccacccccgtgatccaattacctccacctggtcccacccttgacaggtggagattatagggattacaattcaagatgagattttggatggggacacagagcctaactatatcacctgtgaacaacagacattttctcattttacaaatgacgttgggaaagttaataagcaacagagctgggcccggagactcctgtccattaggtaatgctgcctctgagagaagcaggacttggtgagcactcagcaactttgggcagggtgcaacacctgtaaactccaggatgtaagttgctcatgcagctcccataaatgatttcaaatcacacgtgaaaaccattatgaatctgagaaatgcagaataaaaaaatcatcagggtgggtttgggttcattaaaaaaggaggtgaggctgggcatggtggctcatgcctgtaatccagcactttgggaggccaaggtgcttgagcttgtgagtttgagaccagcctgggcaacatggtgaaacccatctctagaaaaaatacaaaaaattagctggatgtagaggtgcatgcctgtagtcccagctatgcaggacgctgaggtgaaaggatcctttgagccctggagactgaggttgcagtgagccaagatggtgccactggactccagcctgggcaatagggccagaccttgtctcaaaaaacaaaaagaaaaagaaaaaaagaagatgaaatcagaagatttgggtgtagttaaggaaacatatttgtcagcagaattttgggggtgagctggaaattatggaatgcttttctgggtaaaattcaccagtctcaggccttcttttcccaaaatgtgcttcatggagtgttggattacactgaaagttggcatacattatttggaaagagaactctgtgctccagtaagtttgggaaatcctcatttaattaaagagtttcttaaccataagaatcctcagagccttccgtatgctaatgtgcattgtcagtttccaaggctaggaagtggcatttctctggatctataaggtctcaagatgcccttgagactgtattctacctgatgcatggctccaggggccttagtggggagcgccacattttccatgttctcatgacagcaggaagccctcagtgaatggaggtacagtgtgcagggtcgcaatcagtcctttccatccgccgcttcatttaagcctcacatcaacctaagacataggttttattattcctgggaggctggccctgttggtgcctgtcaccgcaacccagacccgcttgcccttacctgtagtgcaggtggctagattttgaattgccagcatctgcatttctttgccagaggactttctccagtcactgaagcttgcttgtgggcctgtctacaggtcgtaagtgctagggacttaatgcctcctcaaccagtgaccaacaggaggtgatggatcaatgccccagccccctcaccccttggtcgcaaggctcttctgtttacacataaagccatgtgtagatcctggctgccagagtaccccagtgggattttcctttagttgcccacagtgataaatgcttgataacaaactctttatggatgctttcccatctcctccccactttcctgttcccttactggtgtttcctgagatcacttcccaagttaactatttgtaatcaaatccttttctcaggttctcctgcagaggaaccccaactgagacatcccattttacaaaataatgacaacagcaacaacacacacacacacacacacacacacacacaaaagcaaaaaaacagaagagtctccaagaggttatggaaggtgccctaggaaacagcttatgcatggtagaaccaggacttaaatttcacaacacatttatttagcacctgctatgtaccccttgctatcctaaatgctgagatgacaagatgaaaaagacagtcttggaccctctgtcctaaaccataggcaaaaataaattagtccaggcctgtcttcaaagcctctgcccttaaccacaatactctgctaattctcccaggatggacatttgactctcttttaaactgggagtccatttccataccacccttatgaagagaagctgtggtattcagctcctattctgccctctaggccatgaaaaaactgcatcagatcaagacttttgattcatgaaatatgctagagaaaattgcaagatttcctgactcaatgattttcctgcccagtgtaacatctctcttaattagtgagttgcaattagcatttataaaaagaaatcattgcacaaggtgagtcaactgagatgtaacatcttgctctaaacactgtcctcctggtgtgagtgggatcattcagaaattaggtatcttaatcagctgagtgctccagcattcaaatgtatctggcccagctgggaggccagagtctgtggcatgcataagaagcttacaggagggagggagttttctgtgtacactagcatttgttcatagttgcaaagtagctgtagaaactgcagatttatggccaggtgtggtggctcatgcctgtaatcccagcacttcagaagggcaaggggggcagatcacaaggtcaagagatcgagaccatcctgaccaacatggtgaaactccatctctactaaaaatacaaaaattagctgggcctggtgactctcacctgtagtcctagctacttgggaggctgaggcaggggaatcacttgaacccaggaggtggaggttgcagtgagctgatctggcaccactgcactcccacctggtgacagagcaagactccatcagaaaggaagaaagagaaagaaagaaggaaagaaagagagagagagagacagggaaagaaagaaaggaaagaaagaaagaaaagaaaagaaagaaagaaagaagaaagaaaggaaggaagagaagagagagagaagaaaagagagagagagaaagaaagaaagaaactgcagatttatgagaatgattgttatttttcctactttggctatttttaaagttatatttctttgttattgagtgacctccagaggcagagagccacattataattatagaaatttgatctgaatgggatattaagggttatctattaccaacactcccagtcccttcttcctcccttccttctttccttccttttgatgagaaacctaatcacaaagagagaacatgacttgtctaaggtaacatagtgtgttggaatactcctgaaactagaacctacttagaatcaccagaaacttgaagttcttttgttattattatcttctttatctctctcagcggttctgacagaagaatgatcatgaagggaagtttaaattgtcagccaatgtaaggttttgcattatttatgcacttctgccatgtgggctatgctctcagcacttttaaactatccatagtccatagttggttctgataaatgattatttatttgctgtttttcagttttgcttttatttttggtgattgtttgtacttctttaaagcagggactgtgtcttacagtccctttctggccctaacagctcccagaaaagaacttaccatgtaatagggatgtggtgacttattgatgattaattcattttatatatctggattctttccctttgctcacataaatttcctgggtttgaaatttatgcctgtttatttcttctgttggcccctcatgttgtcagtgaaatggctacaagaacggcatttgatggaagaagaaggaagacagggctggcctatttcattctctaattggataatcagtccagaataatgatggtttgattttatttgcaaacctacacctcaggcagtgggtgaagaacaacagcataagcaacaatgcgagtatggtgttcatttacatcctcagtttgtctgtggcaggaagaaagaatccacttattgctaatgataaagtagtagacccactttatttattttcatataaatcatattgtggcagaaattttcatagcccgagaccaacttctggagtttttcttatctgtgagattgttcctgttgtgtatgagctgttttgcagagatcaagaatccctgctcaagtgtgatccatcttcatcagtgaagtcatatgctgcgaggacttctgagatactgtctgctgccacatgaccactaagcagatggttttgtgcctcttgcatgggttctatgaaaagatggagatttcagtgtccatcctctgtcactcaccagtagtatgcagaaatgggtgagcctaacagagttgttaggtcaacaaagcctgccattcaaattcagatcagtgaccttgcactcagggacaaattggggttaggatgcaggctgagattggagacggattatttcactatgcatgggtttgaccaggcagcccaacagcacaggtcttgcccatcaaaatattgtaactgcctaaaagagttggcaaaagtctctaacaaaacaaagggtttatgagctaagcccatcttgcattcatttcctcattccttctacacatatttagtgaaggccactctacactggacattgggatatgaacacaaagaaggagacaagtcacacagccatttatttataggaaaaaaatgttgaaataaatacatgagctgaagactttagaattacaaaatgagacttgctaacttgttttggattggaagaaattagtttatgcccatgacatcgctttattccagactgattagaagcataatgtacatggcaggggcagggagaaggggatgacaatccattctttgaaagagactcttctccccttaggttaaatagatcgtcaagtccttgcatgtcaaaagcagagatgtgaatcactgtccttcagaaagggaagaaaacactttaagcaagtgcaaagttcccagctgtgctaggcacgatggattatacccaaagaagttggacagagaccttgacctcaaggatttcatcgtctatttgaatagaaatgatttctatataactgaattaagccagagcaataaaaatagcatgatattaggttctaaagtgagtgttgcaggaaacagaaggaacttccaaatgttgttatttacagatttctaccttgtgaaatgtagaagtacctgttctcaaattaaacattccttcctcatttcaagatgtcagctacatcagaggttgaccaactatggcctacaggctacatctggtccatcacctatttttgtaaggaaagttttactggaacgaggccaagctcattcatttttgtatcatctgtggctagttttctcactccaatggccgcattgagcacttgcaatagagattgtgcagcttacaaagcccaaaatatttatgatctggccctttacagaaaaaaattgccaacccctgatttagattatccaggttgatcctggtgctaatttagagcttcagaataaaacacagctgaggtgtgcctggtagcaaattaatcccccccaaaacaagtacttcattttccttaaattaatgttgagcatcagaattaaacagagctaaatctcatgatacctgaggcccttgtgaaaatgtttttgctgacccaagattcagtgttatgctttctgtccttacagagagctaaatcaagagtccccttttggaaggagtacctctgttctttgtaaactgtaattgaagatataactcaccgtgttcttcagtctttattcaaagccgctggcacaaaaattctgcttgaatttaattttaggatagatttgatctctgaattggctttataggttttctcagttcacaataatcataacctagttgtttctctcttgccataggtgacaggcaatgcagagccaatttcagaagtgagctcagtagtaaactcatggcaggtgcaggatgaggcaagagagaggcctgggtgcaaacatgagggtggctcattcccagggctatgcaaaggcagggtcagtcccaaaaggagcacctccttacatgttgtgcctgaagtgtccctttctcagtcttttcttggtggtggcaggtgctgcctggcaatccccatcccttctacttttagatggtgggggccctgtcctgctttatccttgtatatggcgcttttattttaaccatgtaaactgattcaggtcctccctgtagtcaacagagataaaagtctcaataatcaaacctgtgggtacttcagtgaccagggaccaccatctgtcccctgtgggtccagacatcaggcaggagaaaaagttggggccatgtgtcagcgtcccagctggggctcaccatgggaagtgggattagggaggattattccagttctcttctttgagttcaggtttttatctacgggaagaagagggagattggacgaggttagattcacttgtctccaatgtcctgcatggggttctgggacagacaatgcctcagaaatgggaggtccaagaggatggtgactttcactgctagctgatgatgaaagggaaagggatgagggaagaatgggctgaattagaggctattccacccctctgatggttagctttcagggggaagggaaggagggagggaggctggtggggtgggagacaaagacgaattggagattaggaaagattctttggaatagtcaaaccagagaccaagcaaagcatctttttcccttgtaacttgagacctgtgcaaatgacacaggcttctagttcccaaacttaataagagtaagtgcgtgaagaagagacctgcagacacttaattcaaacagtctagaattctgagaataagttatagtacaagttatatgtggctggttatagattcagccttgatgtttatgttccctgtttcaagtcacacacatcagattactcacttgtcagctaaaaatagggccatcactggcttgcaagtcgagttaggttttatttctctatgtgcttcattgttcgttcttttgtgctccctcctctgtgcctggccccctctgccatgcccaggtggcttcacagtcccccttccccatggtcaatacttctttctaactgagggataaatgactctgaaaaggaaatgtatttcaatggggaccaatccattacacccgagagagagaggccaagtgcagggacttctggaggagaccaggaatgagtgattatgtagcatattctgtgtgaaaggcattttaaaacacacgtagatcaatttattgtcacagcccctgagaggcataattctcatcttttttctttccttctttctttctttttttttttttttttttttttttttttgagatgaagtcttgctctgtcacccaggctggagtgtagtggcaccatctccgctcactgcaacctccacctcctgggttcaagtgattctcctgcttcagcctccccagtagctgggactacaggtgcaggccaccacgcctggctaatttttgtattttttagaagagacgaagttttgccatgttgactaggctggtctcaaactcctggcctcaacctatctgcctgccttggcctcccaaagtgctgggattacaggcatgagccaccgcgcccagcttctcatctttattttttacatgcagtcatagacattcaggtttcatataagcagccagggtctctcagtgcatcaggagcagagccagggtcaaaacttacatccatttgaacccaaggcacagttttttcttactgggtaatgctgctgtcttatgggggaattttaggcatcaataaacaaggaagagaagaaggctaatttcttttgggggctggtggatcgtcccctaaaattatgtagatagtcatctttcctatcttagctaaatacaaatgtagattgtaaacagctcctcaagactgtacattttttgaggatagatttagagcaaatcacatttgtatccccaatatggttagcccagtatctggctcctagtaataattatagcaagcactgactgaacatttcctatgtgccaaggacaattttaactgttatagatattaattcattcctcacaataaccccatgaggtaggttactattactgttcccattttatagttggggaaactgagatactttgagttgaaggaacttgctaatgctcactcccaattaatggcagagctgggatttgaatcctataacactgggcccagattccgtctcttttctaaataggtactccatgaaaatatgttgttgaataaatgtactattactttgtacagggttgagggaattagatatgacttcactgaagaggtcaatttcgtctgagttcatttcttggtcaatatttttaaatgaatgaatggattccagtgtcctttttctctgaccacttctgtctcagaaaaacaagcctaatgcagaggaagaggagcaagggagttttcccagtattggtagatgaagatctatgacttcagagacaaatgaagccctcctagaattctttcaggcagacaataccaggtggcaccatgggacacactggtgggaggagtgcaaaatgaggatacagtttatgacagttttttttggaatagacacatgtccagagaaatgggcccacattcacttgtatgtgtgcatacgtttgcatagaattctcttttaaatatttcaaatttataagaaatcctttcttgtgatgaacagatttatcttgaaaagtgtttcccattttaaaagtcagagacttgaggcagggttggaataacttccaagagcatgtggctcgtatgtggagatgccaggaaccaaatcccctgctgctggttccagggaccacatttattgccacacctacagggtcctaggaagaggctggcagatgtgccccatggagataggtggggtttttatttacagtaggagaccagattgcccagtgatgatggggcattcgatggcagaatatagaccagtttgactgggccctagtgctttggcagatttttggaggagaatttgctgagtgtcagaccctgtgcagagctttgcaaacatcgttttctttaatctggatagttcgtctgtgaagtagatgtcataatccctatttcggagatgaggaaatgaggctaggagttacataacttactcagatgtgcagctgctggtggcagagcctgaatacaaatccttcacttctccaattaaaccagccatctctgagttgcaggggtttcatgccatactgcccactggaagttgggagggaatttacagggttacagcagatgatctctgtttaggcatcaggtgaaactttagtgttccctaaattggtacaagcagactctgtttgagtatctctgttgacagggagataccatctaacatggcagcccatctcaatgtttttaataagtatattatacatgcaataaaatgcatagatcctgagggtgcattcagtgagttctgacagagatatgcaccactgtaaaatggtctgtcatccatatcaacatagagaacatttttactatcctggaatgtttctttatgctcatttctgtcaatatctgctctctcctcccttgaacataaaaaaatcactatcttggcttcaatcactatagattagtcttgtctgctctcaatttttgtatgaatggaatcatgcagggtattcacttttctaactagctcctttccttcaaaataaggtttttgatatttgtatatattgttgtatatattaataatttcttccattttattgctgctaatattccattatgggatataccacaatttgtttatcaaaccaccctgttgatggccattaggttgtttccaactttggcttattttgaataaagctgttatgaacatccttgtacaaatgattttgtggacatatatttttttttcttgggtaaatacttagaaattgagtctctgggtcataggatagatgcatgtttaacattacaagaaactgccagttttccaaaggaagatacaccattttacacttctactagcaacgtgtgagggtgccagctgctttgtttcttcaccaacacttgataatgtcaacttttaaattttagccattctaatggatttgtggtgccatcttgttgtagttttaatttttatttctgtaagttctttgtcatataaatgtactgcaagtgtttcctcttaatctgtggcttatcttttaatttattgtctttttatgagaagttttttattttactgatatttaatttatcagtctttttaaaaatgtgagtgccttttgtgtcctatctaagaagcctttgcttatccgagtgtcctcaagacactctgctgtgtttgtttatagaggcttcagatttagcttttacattgaagtcagtgatccatctcaaactaattttgtagattgtgttaggtaagagttgagactgatttctttccctttgtagatatccatttttccttccatttgtggcgatgactttatttttctcattgagttgtattggtgcttttgttgtaaatcaattgattgtatatatatgggtctatttctggactctgtttcattaatcaacttgtctttttggggggcacgacacattatcttaacacaacatagtttcattattttttgatgcctattaaaatgatcatatgatttgtcttttaatttttcaatgtggtgaattacattaattaattttcattttttaaaccaatcttttactcatgggataaactctatttactcgattctaaagtattattctttttatatactgctggattcatttgactagtatttatttaaggattgttgtgtctatgttgatgacatatatttttctgtaattttttttcttttcataatactcttattaggtttcaatgtcatgattattctggcattataaatcaagttgggttctcttttcctccagtccctgaaagagtttgtgtaatattggtattatttccaccataaatatttggtagaattctgcagtggaaactgcctgaacctgaaattttctttgtgggaatgtttttcattgaagtttccatttatttaacagatatgtagctgtttacattttctattttttcttgtgtcagttggagaaaattgtatttttaaaggaatttgttcatttcatcagggtgtcaagttttggagacataatattattcctaatactttaaaattatcctcttagtgtttgtaggacctgtagttctgtctatcatttccagacaactttaggtgttggagagttagtttctcaccaatttctttttaaacacattgagtttctttcaagtcaggaccaggccatctacttccctcttcaagatattcgtcatgctgttccctcggcctaaaaaaattgccatcaccataatttttttacctggctgtctgctactatatcattaggatatagaattattgtgaagcccttttgcgtatgtatgtcacattttccatacacattcactcagatacacatttatgtaacatacacatacacatactcagataactacttggggtttttcctttttcttttttgttttctttttttcttttcttttcttttttttttttaaatggagtctccctctgtcacccaggctggagtgcagtggcactatcttggcttactgcaagctccacctcccaggttcatgccattctcctgcctcagcctcctgagtagctgggactacaggcacctgccaccacgcccggctaatttttttttgtattttttagtagagacagggtttcaccgtgttagccagaatggtctcgatctcctgaccttgtgatccgcctgcctcggcctcccaaagtgctgggattacaggcatgagccactgcgcccggcctacttagggtttttctttacagcactttaaccaaattgttaattacagttatgatatattgtttcactctctgattatactataaatgccaccaaggctggacttgtgcattgttcctgttaatcagcaaatacccagtacccagcaaaacgcttggcacataatagatgctcaatacatcatggtcaggtgaatgaactaatccacattgagaagaaatgttatgctttgaaaattctaccaataattttagccttgctagaggtctgaaaaaataggtggggattaaattatgaggagcctcagctaacaacttgtggaatgtggatattttcctgtttatatttttaatgtttcccctctctctgtctgtgtcatatttttgtttacactcagtaccctgggaagggagactttcatagtcactctgggctgccttaacaagatatcaaaaactgggtggctgaaataacagagatttattttctcacagttctgaaagctggacatctgagatcagcattccagcatggtcaggttctggtgagggctctctttctggcttgcaggcggctgccctctcactgtgtcctgacatggcagagagggagaaagagcaaactctctggtctctcttcttataatggcactaatctcatcatgagggccctatcctcatgatcttgtctaaacctaatcgctccctaaagtacctcatctccaaataccatcacattggggtttgggcttcaacctacgactttggcagggatgggggtccataatgtagcctgtaacagagaactaagagggggctggggttggtaatgagagaagatgctgaaaacaatgggacaaagaagcagggggtgggccaaggagctctaatgagtgtctcctcccatcttcctctggatagcccagaatccctcttcttcctcagtcctgtatgtaggattagcagaggatttgcgtatttgggttatgttagtggtgggaggtggccacgacaggaggagtaggacaattcagtttttctttcttgttgggcatcacatcctctaagggaatcctccttatgagtcctcagttgttaagcaggattactaaaataaaagaaacgacttagtgggccccaaactgcagcctctctcacactctattctataccacttgatttgaggaattatagccttttctctttctatccccctaaaccatgtccaaaggagcttacatggttatttccagcgtgaagctgattgatcagctcgcaggacatcgtggatcagagtgcttcccccgcccctcttaaccgcctttctgatgtggctgcgtgcatccagtgcccagagcatgccggggttcttgcaagagggactggagggtgagggaggagagagtgtctattggctccaccaggacatagatgctggtgacccacactgcgctggacaggaggacctgtttgcagcacgggtcagaggaacacaggctcctccaggtctttccagagcattgactcctgcaagaagtgaatggaagggagccgaaagcctagcccatctccctccttctaccatgatccccagtaagattctggtgtaccgccacccatccagcagaaccggcacagagctttacagacccggcaggcgccgcaagaagtccctgggggacctgttccataatggctaccgggtgaagtctgggcctgctgctccggagaaggaggaaccgccgaacttccggcagtcattggtgtcttgctgtggtgtttgtgcatcctggggtaaggactcacccgtccatggctcttctcctcccaaaagtattccgtattcctggaggctgcctgggaaaaaaagtgctttccgtctaggctggatttggggaactgtctagtggagaggtgatagccaccttgattcctgttttcttggcatacccacccaacgcagatgtgctgggtgaggcagaaatctcgtccttcctttttagatgaatttaactggcctctagtgctcctgaatgttattgagctattaaagaatatatttcagaaatgtgggagaaagtttggcaaacgatgtaatagcttgcttcctatttattaaatggcaataattttcagtgagtcagcatttttggaagaggcatttggacctatcgataatttttttttcaggggctacagtgcgagttgtggctcattttctgtccttacatttgaccatgggagcgtggtcttgcctgtcttgggtggtacttttttattcttacccagcagagatcataagaatagttttctaggcagattttcttttctcaactgctttctgataggcatttggctttatttaggcatccataatatattacagtttaaaacaaatagattaaatgtacatttctggccataaaaatgtcagtcttagggagggatagcttttatttccaggaaagttagcagtactaggaatttctttaaaatggaatgtagtccctttgaaacctagtttaggattctgatgtgggtaggcacagctcaaatacttctgcattatgtaattgtgcctaacaaaattccagttggcaagcaataagtgaaacctagtcaatccttttcattagaactgatataaaatgtttctgtcagctgaaatgcctggaatctaaatattcatgcttctgtgtctataaccctagaattagctggccagattgttatatttcctctcccttcatcacagagaagagctgctctgtactgtaacatctggccttggagagaatcaggattaaagccactagagagaagagaccaaatgatggaattattaagctaagggcacatacactacttcctgagaaaacgttgaataattgagtaaaaccatgggtttaacttagtatccaatacccttcttacttttcctttgaaaggattaatgcatttattaattttcagtagtgagtactcactatgtaccagtcatcactgttctagaagagggtgcacttggtagtgagccagtgagtgagacacctgccccaatagagcagatagtctgctgaggaacgggcaggaggcaggcacctgaacaagcaaatgagatcattttagattgtggtaaaccctataaagaagaatggataatggcggcgaaggactgggctccagatcgggtggtcagagaagacctccattagccaaccttgcaatgatctgggggaagaacattcccaagaaaagaaacagaagggaagactcagagctgaggacgaactgggaaatgtttctggagcagagacactgtgtgcagggcgtgaggacatggagagtggtgatgaaatgagcagaaaccatggagagccttccagagcgagataaggaatctgaaagtaattttagtgagatggatgccatgtaatggcttttggcagggagcaatgtaatctgatggatatttgaaaagaccatgctggctgctttctggagaatgctggtggggcctggggggactggggtagagaagtgaagcaggaagacccgtgtggggctcttggtccagatggaggtaacagcagtgtgaaccatggttctggcagtggagagggaaaagataagttatttcacatatatttaagatgtaaagtcagaccaggcaaaatggcttatgcctataatcccagcatgttgggaggctgaggtgagaggatcatttgagcccatgaggtcaagactccagtgagctatgatcatgcaccccaggatgggtgaccatgagacactgtctcttaaaaaattcaataattttaaaacaaagtaaagaggtaaagtgagtaagtcctatttgtttacttttaaaaaatgtgtttctctacttactggctcctctattcaaatagaagacctggaagcaggagcctcacccctgtgctgcagcatctggaaccacaaggggtggtggaagcagtgactctgtgcatgtgtgtgggtgaatgaatgaatgaatgaatgggcgacaatcccagtctgaatatcaactgatgttgagcatctatcagaacaggaaccaggactgggttaaggtagggagccaggattggcaacatggtgaaactgtgtcactaaaaaaatagaaaaaattagctgggcatggtggctggctacttggggggctgaggcgggaggatcacttgagcccaggaggtcgaggctgtagtgagctgtgatcgtgccactgcactccagcatgggtgacaaagtaagaccctgtctcaaaaaatttttttaaaaaagtagggagcaaaacaacctgaacaattaccaaaggaaaggatggtgaaaaggtcagacaagcaagaactgtttatagaacacacattctgactgtgggaacaaaagcccaggggcatttgagaggaagcgagacagtcctttttctccagctgggaaggagaggctcagattcactctgtgctggggctaagaagcaggtggtcctcacagtgaccaagctggggatgggaggtgggacctgtgatggcagaagggtgcaggggaccaccctgaagaagcctccccatgctcctgggcatcctctgtttaccctgatatgcctgccctcagtttgatccctctgagctgcaaggccagataacaatgaccttgtcagacaccacaaaaataattgctcttcaggatttgcgtggggctgcagggattggaaacgacagacgtttattggaacctttcagctttttggatttaaagattaaggagtgaaagggaatggaaaatagcaaattggaaaaccctggcaggctttctggtatgggcttggatgtgtttgctgttgtgttttctgtcttgtcctctcccgagacctcacatgtatgaatctccagagtcttttctctctggggatcacaggaaccctgaagcagtgaatgagttatcatttacctgtttatccctcaatttctgtcagtacagtaactctgcttttatctgagaagggagttcaagatcccttaatctgtctggtcattgctaaaattccacagcaatagttctcaggaggagcctcacctagttgttcaggccctgggcagcaagtttcgaagggaaagctctggcagggggtcctcctcacctggagccaatggtctcatgtgactgaatcttgcatgtgagtacagggctcggagccaggaaaacctgtattccagtcctgacttgccactgactttatgactacagcaataagtaattatgcataaaaatagaaattttgatataaatattacaaaaaaattaaaaaactcaagaatattaaagaaatccaaaatgtctgcctttgtaacatggccactgtcatcattttatgcttttcttctactttttcattttacacatacctatagttttcatagttttatcatagggaccatgcacttcatcttttacttcttttttttttttttcagcatttccaatttgctatttttaaaaaattgtggtgaaaaacacataacataaaatttaccattttaattatttttagtgtacagttcagtaatgttaagtatatcctattgttgcaaaacagagctccagtactttttgatcttgcaaagttgaaactctaaacccattaaacaaataatttttcctctcccctcagctcctggtaatcgctattttaatttcgacattctacttctttaacttaacattatgtcaaaaattttccttgttacaatctttgagcatatataatatcctataaagaagatgtatcagacgtaagacctatttttggattttaagctgctttctatttttcttgcttaatgaacaattttgcaatgagcatctttgtttctgtagcatatttccatattttgttatattttcttaggctatattcccagaaatggaattactttgattaataatgctgaattactttctgaaaaggttttatcagtttataattccacaatcgaattataagactatttcattgtagagtcatctccactaggtgaagctcaaatatgttgctattaagtagaataaatacagtgcttacttatttttgtttaatttgcatttcttttaattttttaaagcatttttcaagaatactatatggttattaactatagtcaccatgttatacagtagatatcttaaacttatttctcttatttaactgaaattttgtatcctttgaccaacatctacccaaccacccttccctccaaccgccccagcccctctttctatgagatcagctgttttatatgagtgagatcacgtgatgtttgtcattctgtgcatggcttatttaacttaatataaactttaggttcatccacattgttgcaaatgaaaggatttattcttttcttggctgaataatatgccattgtgtatatatatcacattttcttcattcatctgttgatggacactgcggttgatttcataccttggctattgtgaatagtgctgcaaagaacatgggagtgcagacatctcttcagcacgttgatttcatttcctctgaatatatacccagtggtgaggttgcttgattgtatggtagttctatttttgggtttttgtggaaactttttacctttttccataatggaaaatagtactaatttaccttcccatcaacagtatgcaagggttcctttttcccacatcctcaccaacacttaaccttttgtcttttcgataataacccttctaacagatgtgaagtgatagttcattgtagttttaatttgcacttccctgataaatagtgatgtcaaacattttaaacatttactgttggctatttgcatttcttcttttgcgaaatgtctattcaggtcctttgcccatttcttaattgggctatttgctttcttgctattgagatgtgttctctatatattttgaatattaagcccttatcagatgtatagttttcaaatatttttctcccattctgtaggttgtctcttcactccgttgattctttcttcctttttttttttttttttttttttttttttttgagacagagtcttgctctgtctcccaggctggagtgcggtggcatgatctcagctcactgcaatctccacctcccgggttcacgccattctcctgcctcagcctgccgagtagctgggactacaggtgcccaccaccacacccggctaattttttatatttttagtagagacggggtttcaccgtattagccaggatggtctcgatctcctgatcttgtgatccacctgccttggcctcccaaagtgctgggattacaggcgtgagccactgcgccccgcctctcttcactcggttgattctttcttttgttgggccaagctttttagtttgatgtaatcctctttgtccatttttgcttttattgcctgtgttttaggggtcatttccaaaaaattattgccctgaccgttgtcatggggctctttctcaatactttcttctagtagtttcacagttttggatcttaagtcattaattcattgtgagttggtttttgtatatggtgcgcattttttttatttgaaccaagttaagataaaatagtttcatttaattaatttatttaatgattattcactagttatattatctacttcatgatgtagctgtttgatttttgcctacttatcaactaatgataaagtattttacatacatgcttttgacattacaaagaatttatccttattgtatcatatttgattattttttcattggatattgtgtttattatgattttaaacatgcagaattttgacgtttttatggtggtggcagagcctgtatttcaaagattgtatgactccttttacacatgaaattagaaattcttcttttcagagggctaataatatatacctatattttcctcaatttttctgtcccttattatctatatttaatttttaattcatctcaaacttatttccattatggtatgaggtccatcattgcatgatgcctgtcttccttttgatttgtgatgacctctttattgtctgtaaaattcttctgataaaatagagtctatttctctactgcttagtcattgttgccatgctcttattactttcttattctattgctttgtggtaaatgtgacttagatgatttttgcattttagattttgatgaaatttctttgtggcctaatatgtggtcagtttttgagactgctcatggctgttattaaagaatgtgtgttcctagtttactaatatatgtgtgtgtctttctgcccatccattcagatacatatagatacgaatatatcccaagggattaaatgctacttaaatgtcctatatttgtgcattcttgtcatatttgctttatttatctcaaaggaatacttttaggtgtataaagtttttttttgttacacattctttgtggattgtttcttttatcaatatgagatattactttttattctttttaatataatgtttatatataatttttatataactttttgcagtagctgccactttatttgatatagtcattgctctatttgttcctcttttctcagcatttgccaggcacataatttccattctttcatttctaacttttctgtatgtcttgtttgcagtgtatgtcttttaaatagcatgcgcctggaatttattattgttgttgttttcatatcatgtgaatctctgtctttccataggtgaaagtaattttaatttaattttattatgattacaaatatatttggactcttttgctattgtaactatgttttctgattaatataccttttattttttttttcttttcattggatgggctgaagtttttgttctttttttcttttctccatttgattaaattcctttgtccttttttttttctctaggctatggaatttatatccttaaggttttgatacacatactttaatttttttctgttaatatatatgattgattgtatcctatcaagacaagaatttctgcacacctttctttttcccattgccctctctccttcacacctccatcttccatttatttccagagattttaattttggatcattgttattatttattcatttaaaacatactcagtcaacacataaatgaatccattacttttatcttttccatgttgcttcttgtatcttgcttcttttggatttatttttctttcaactggctaagtatatattacttggttcaaattaatctgtcctgagaattgtaaagatatccttcttttgttttcttgcaaccagtgaagccaggagaattgtgacaataatttgactcttgttgctttgaagggatttatttcttcacattgatgttataaaatttatccacaatatgcttggatttaggtctttgaaaatgtaatctgctggccgtggggcggagcttgcagtgagccgagatcgcgccactgcactccagcctgggcaacagtgccagactccatctcaaaaaaaaaaaaaaaaaaaatttaacctgctggacacttaaaagacctttccaatctgaggatacaggtcattctttcggtctaggacactttaatgttattttaaatgtttcctgttctctatttccttcattttttccttctggcagctcaattacatggatgtggaaaactttattcctgttttctgggtctcttagtttttcttttgcacttttcattcctgtgcccctttgtatgaagatggctgtgtgatagttcagccctctactttgctgtgtggctatgcccattcttctattaagctggccttttaagattttgatgttcaaaattttaattgctaagatatttagttgattttttgagttgagatagtttttcacaactctttatatttttcaaatatttttctaaagcattttttgtttaatgctttgttaatgttgtatccttaagggtcagttggcctgaagtgtaatatgtgcatttcttgaaggaaagttgcctttcctcaaatgtttggcaattctttagttcttttcttcccttttcttttctttttttttttttttttgagaccgagtcttgctctgttgcccaggttggagtgcagtggcgcgatctcagctcactgcaacccctgcctcccgggttcaagcgattctcctgcctcagcctcccaagtagctgggattacaggtgcctgcctccatgcccagctaatttttgaatttttagtagagatggggtttcatcatattggccaggctggtctcgaactcctgacctcaagtgatccgcctgcctcagcctcccaaagtgctaggattacaggcatgagccaccgtgcctggcaacagctggataaattttcacgaagagaatgcatttgagaagccaacgctcagctcaagaaacagtcattattgcctgtcaccccctagtcccttctcctggcaaccttctagtcactacaccccacaaaggtaaccactctcctgaccatatatcagttttgcccagttttgaacttcatataactgggttatatagaatgactctgtgtcaggccttgttctctcagtgttacgcctgtgtgattcatccatgtggttatatgtagatgtacttgacagtgtttttttgtttggagatggagtcttgctcagcctcccaaagttctgagatgacgggcatgagccaccgtgcttggcctgttttgtgcttatctttgcatttgagatcttctgttagcctatatgtgaatgctgtctttgtgtgttgcagtttgtctggggagtactgagatatgctactgtgtgtttctattcggtaactggtcttacagctgtagagacagtgtgtttcttccaagagttacagtttactcaggatattgctctattttaacacctcaagtgtatgcacttgctgccatgtagtgactactcctgtttggcaccccagtcaatcagtgttattgtcacagcctccttcttcccagggtcagccacttcatttcaccttttggatggttgttttcttcttcactgtgatctctgcatcccaaccacccccccatcaacctcagtctttatgtattgaccaaagacatttttaatattctgtttatcattgtggagatagacatatgtgtgtgtatatgtctttctttctcattatggaaatatatacatggaaaatatatgtatatgtttatataaatataaataaatacatatatatgtatgccaagtcagtttctaacagagtatctacccacattttgtgttcgtctgttctgtgttgtaatctcctcttccattctttttgttcttgtgggattctgctgtttcctaccccctcaacatttgtattagtttagtgaagttttgagagggggcagacataaaccattgtgatccatctgctatgtttaactagaatgctctggattatcattttaattcattgatgaataatttatgttggtattatatacagaattttggcatctatgatcttagtgatattagaatacagatgcttctcaatttaaccatggagttacatcctcacaaacccatcataaactgaaaatattttaagtttgagaatgcatttaatacccctcacctaccaaacatcacagctgagcctaccctatcttaaacatgctcagaacacttacattacctactgttgggcaaaatcatctaacgcaaagcatattttataataaagtgctgaaaatttagtgtaatgtattgaatactgtactgaaagtgaaaaacagaatggttgtgtgaatacttagagtatggtttaaggtgaataggtatcacttttgcaccactgaaaagtcagaaaatcattaagttgaaccattgtaagttgagggccatttctactttatttttgtgctttgagagtcagtttttggtcctcagtttatgtttattttataatataagttagtagctttagatctcgttttgtattatggaacagtttagaattttaataaaatgtatgtgcaataatttaatcataaattatatatgggtgcagagtctgtaagggaagctgttactatatatttcaatgtatatctcaattgttatcctataatggatttcttttttgtgtgtatcaagtttcgaagtttatatttttcagaaagtcatccctctcactgaggtttttcacagatttattagaatatcattgtggataatttttttctttttttattggatcagccagaactttattttgtttgttttcttgttgccattgtttgctcccataaaattctacagatttttaaaattttttttcatatttattggttttctggttatttagtcataaacactaaactaaaaaatcagctttctcctattgtcaagactacttttcccccaaaatcttaagctgaatgctttgttttataaataatctcttattgtattattgatttaacttctagttagccagtatgttctttaaaattgatttaaatagactggtagtgtgcttagagggtagattactggttttaaattactcaagtgattactcggattaacggaaatttgctatttggagaaaaaataaagcattctccttttggcatactactagccaaaataaataaatacatcctgatggattaacaagttagaggttaaaaaaagaaaataaaagatactctaaagcagtgattcccaaacttggctgtacactggactcatcctcatccatcatctggctgtacattagaatcttcttgattagaaaaataaagcttggtccttttggtgcactgttaaccaaaataaataaatacatcaaaacagattaacaaattaaaggttagagaaaagaaaatatattctgaaccactggttcccaaacttggctgcacactcgaatcagaatttataaaaattctgatgcccagcttgtatcccagacccgttgaatctggtgggaagcaggcctcagtattgctttaaaatcctcgggtgattgcaatggcagagaaatctggggaccactgccttgcagccttgttttcccaaagtgtggtcttctgaccaacagcattgacgatagcttagagcttgttagaaatgcacagtatcaggccccatcggagacccactgagtcagaatctggatgtttacaaatgccaggtgattcatgtgcacaatggatttgaatcccatgcctccaaagcaagtgtagaaaattagtgtccatggcctatttatatgaataacattttactggaatatggtcacacctatttgttttcctattatttacagcaaagttgagtcgttgtgacagcctaaaatatttattaatatttactatatgttcatttatagaaaaagtttgcaatgcttcttaacctggatggctcattagaatcactctggagccttaatactccctctgcctgaatgtaccccacgcccattaaatcagaatgcaggtagggggtgctgagacccaggtgtcaacaattctaaaagtttcccaggtgatttaaatgtacagtcaaagtccagaaccagtgccccaaaagtacaaagaaaaaaaaatagatgcagtaaaaaaaaaaaaaaaaaaattatctatatgatggggatggccaaaaaaattttaaaaaaagggaacatggtagaaagattgatatattttagaattcatggggaaagaaacccaccttaagtaaaatttgacagtaggaaaaatactttaagccaaattgagaagaatgacgaacggtgggagataatatatggtatacaaaatcttctttatatgagaacataattgtattactacaattaagataaatacacaggcagactggcaaaggccactctaaagcactttagagaagaaaataaaatgactaataattatatgaaaaaataattagcttcatttgttaagatagaaaagcaaaataaaacagccatgagctcttatttggggtctatcaaattaggattttttttttaatttttaaatttttaatttttttgagatggactctcactctgtagcccaggctggagtgcagtggcgagatctcggctcactgcaacttccacctcccaggttcaagtgattctcctgcctcagcctcccaagtagctgggattacaggcacataccaccacacttggttaattttttgtatttttggtagagacggggttttaccatgttggccaggctggtctcgaactcctgacctcaagtgatcagtccacctcagcctcccaaagtgctgggataacaggcatgagccaccatgcccgacctcaaattgggattcttaccctcgttctctccctctttcccctcctgccttcctgccttcctgccttctctccttctctcccttcttgccttcatgccttctttccttccttccttccttcctattttctctatcactgtactcaatccagtgggaatacaggcaaaagagcatttgcatactgaagggaatgcaaattgtgaggacaagttggtaagatgtatcacaagtcttgaaagtgtgtgcttgagtcctaatgtctgaattggaaatgactggctgaagtctgtacagggcagtggctagaagcttgggctttgtggagtttgtcacatttgtggtgaaacttggctctgttgctttcaaactatgctggatacactgtctcatttgtgtctccttagctattttcttctgtgtacgtattttttaaaaaagatatagttagaagttttagtgtgtgtaagtaaataaatatactagatatcatcaataataatagattaatgtcattgtcaacatcatcatttcaccagtaatttaaaataatagtaacactatatgtactctgtgtgtgtgtgtgtgtgtgtgtgtgtttgtgtgtgtgtttctgggctttctagtccagtttgatgacttttctgtggcgtgtgtacactcctacgctattgtaattcttcatatgatgaaattaccatttactgagtgcctccagtatgcccacatggactcttagaatgctcggtcttctggtatgcagatcaccagggtaggatttaatgcccatgcctgtgagggaataagggtggagaactcaggctggcttcagctgcctgggaagcctcaacccatcccacaggaaaaagtaacccaaattgaggcaaggcagctgacctttgtccctacatcagccagcatttgtgtgtggtggtggggggggtgggggggtggggggcaccaccactgacaggggatgtagccccaggtgaggcagctccttgtagcagagggcagttctcatgaagggactagctctgagcctttagcaggtcactcttcaagagcccaggacaaataaggtccctgaagaggggatttgggctgtaccctacagcatctgctatagctcatgtcttttattcatttaatgcagtcttggatatgataccctagtattttatttaggattattgttgttagtcattagtgtgataagcttgccatttaagaaaaaatgcaagggaacttgtgtccaggtaatgccaactttctaaaccaatacagagcatggaaaaacacagataagtccatttttaagaattgatcatataatagagaatagatagagaagttactattttttgaaactgtaaaaatctcacttgtaaaactctctgaacctggaagcttttggggagggcatgtaattcctggcttttggtatatacacattttcttcttcacaactctattatagctattttgtgttaccttagaaaatcatttatttcagagattttatagaataaaaataataaaagatattataaaatagagaagatgaataattgtcaccaaagagttccccctctcacctctcttatcttggtctcctctcttagcctgaagtcgctgtctgtagtcttctgggctctttctgggtatagccagagtggtcattggttaaggcttttccctgatgaggctactttctacttcccaagagtgcagccctgacctctctcaggggaccccgcagggcttctggcttttccctttagtaggcaacatatagtctcagaattctgaatgtggattatctaacctttaactccgccgtctaattatttctcaaaactttgattcactcattcagttcaagcaaggatttattgagccttcaccttatgccagacactatgttcaatgctggaaatatagccctgaacaaaacagacatcagctcctcccctcatagagctgatgctaaagagaggaaggcagaaagtaaccacataaccgaggtgctagtgcttcatgctgaggagaaaagtgaagcaggaaagaggatagggagttgcacgggtggtgtgggaggagttgcatgtttaggtcgggtagccagggaaagtcacgctgatcaagggacattgagtaagaacccaaaggaggtgagggagtatgccatgtgggcatctggcgaacagcattccaggcagagaggctgcatgtgcagaggccctggggcagtagcatacctgtgtgttcaagtgtcactgaagacatctgccagatcagcggacagtagtaggagtgacagtaggaagccatcagatccaaaaggagatagtgctggtggtgggatggtgttgctttaggcctttgaaagactttgacttttactctgtgtggaatgggtggcattggaggcttctgagcagagaacacaaggggtccagggcagaaagcggttaggaagctgatatggtttggctgtgtccctacccaaatctcatcttgaattgtagttcccataatacccctatgttgtaggaggggccctgtggaaggtaattgaatcatgggggcagttacccccatgctgctgttctcgtgatagtgagttctcacgaaatctgatggttttataaggggcttttccctcttatgctcaacacttctccttcctgccaccatgtgaagtaggatgtgtttgcttccccttctgccatgactgtaagtttcctgaggcttctccagccctgtggaattgagtcaattaaacctctttcctttataaattacccagtctcgggtatgtctttattagcagagtgagaacggactaatacggaagctattgtgaatgattcctgaaagaccaaccatttctccagatagtctggcttgatctgaggatgaaatgtagactgacttttttaacctatggagaacttcattggctcatttgcattagtgaaactcagtgccataaaaatgcccagtatgaggcagtcaaataagcaaaggccacccttgttcagcccacaggggtcttgctcctgcatcaccctgggtcccttttgcaaggagatatttccctctggtctccatgttgggaaaaataaatgattctcctgcaagccagtttgtttttctctcatatgtatacactattgatcttatcctgtctgcctgcttgcttttgttaagaaggtgctcagagctagatctgcagtttgtgtctagcaagagtataggaccttgtggcctctgcattcatttctttcctgcccttactttcatgcaccttaattaaaagaaaagcttttattctactatatttgtgtaactcactcaaatgtggcaagctgccaatcagcaatggatatacgatacaaacaccatcgtttaaagataaaaagaagaaatccagtttgaagttcaggttgtttgtattctatttttagttccataaataaaagcatatctatgcacacacagaatgttcaggattaaacactaaatggctaatacattgctagcatgtatttctacaggagtgcctcttatctatggttttgcttcctgaggtttcagttatccccaggcaaccgtagtctgaaaatattaaataggaaattctagaaataaacaattcataaggtttaagttgcatgctgtcctgcttggttccatctgggacaagaatcctccctttgtccagcacatccgtgccatctgcactccctggccattagtctctcagggcacttcagtgggcagaccgatgtcttgctgtaacccatgttacctgtgttcaactaacccttattttacttaataacggccccaaagcgcaagtatagtgatgctggtacctattgtcataattgttctattttattattgccattgttaatcccttcctgtgctaatttataagttaaattttaccgtaggtgtgtgtatataatgcatataggatttggcactatctgaggtttcaggcatccactgggaggtcttggaatgtatccctcaaggaacatggaagagtgttgttatctttcatagtttcagtgctaactgccagtcgccttctactccacgtttctacatttgtcgttttagctcagcaatatgcgacagtgatactggtatgagataacagtctaggttgggctggaaggttaggaccagcagtagagtctgttataaatttaatttccagcccttgccccctcccattctgatttagcaagtcttgtgaacctctttggaaactttatgcacacactgagcaaacaatgtattttttgagaccttagaatttgaaattttttttgttacttttattcttgaacaaccacttgactgggtataaaaatcttggtcaaattctgtttgtctaaaaattctgaaaattgcccaattgctgtttaacactttttttttttttttttttttttttttttttgagacggagtctcgctctgtcgcccaggctggagtgcagtggtgcgatctcggctcactgcaagcaccaactccctggtacacgccattctcctgcctcagcccccagagtagctgggactacagggcgcccgccaccacgcccggctaatttttttgtgtttttttagtagagacggggtttcactgtgttagccaggatggtctcgatctcctgacctcgtgatcctcccgcctcggcctcccaaagtgctgggattacaggcatgagccaccgtgcccggccaacactttttgttaaatataatgatcttagttacattaacggtaaataaccccatcaacactggtggtttatttttattgcttgattttaatacttgaaatgtgaaaatgaaaagccagatgcttcttggcattggtctctaagaactgatccttcattttaccttttagtctccagtcattttttcatatctcaaaagttcttttctgttatgtcctggcctttgcttatgatcaatgtgatgttttgacttccctttggccaacacattttatccatgggttggatctctgtgatttctactgtgtttctattttctgaagtttcatcttttttttttctccctttctcatattttctctgctttctgaggtgacttcttagttttgtactctgcgccgtggtcggttttcagcggtgctaagtcagcctttcatcagctcagttacaactgtgcttttggccgtgagcctttttatttcatcaacatcccgtctcatctctgcaattatttaataaaagttatataagtattatttagcatagaaggagaatgttttcaaaaaaagtcttctgttcatgatggttaatccttttcagatgagaaattatttttttgagccaatccttttctccctctttccttgtacagattttcccccaccccatgaactttaagttaattttcccttattacctaaacagctccacgttgcgtgcagttagtgtactcctcattcaagtagaaggtagtaaggattccttcccaccactgtgccctaggctgccctttactggctcacgggcgtgggagaacaaagccccacccacgggcgtggagttgtctgtcaactcagtgcactggagggcttcgcactgcctttggcacgtggcggtgcttaataaaatgcttctagaaagtctgcaaaagaaaatccccttgggagtgggtgtgacattcaatgtgtctcaaagcggtgacaaaccagcattttgtaagtaattcccttgcatgatagccaaattattatagcccaggactgactgaatgttttgaccatgaatttcacctgaacagaaatataattcactcttagctattaaaacataataatttgcatttttaaaatgtccttgatgtgttttccttctccatctctcttctgccacctaaacactgatgcttctttttcattcaagagaggttgttgatttagaaaggacaaaccatttatcttaacacttaataaaaggggaactatataaattttgaatcctgaagttgtggggtgtgatatctcactgatcttttttttttttttattgggaggaaaatatagaagtttgtagaaaacagataacactgtgggctgtactcttcattttatcagggctgaagataaagataaaaaataaaatccatcaaagacataaggttatccgatttattctcaatctgctcttagcacaagggttaccctgagctatcacaattcctaggatttttcagagacaaaatcctgccagataactaggtaacttagaaacagtgctttcaatcagagatcaccaaatgaaaagtctcattaacctggcttctccccatgagcccttcctctaaagaggttccaaacaggccacctttataaagagaaagtccatttcccagtcgagattaaaccagtcaagaatcagaatgaaggaatatgtctgaggtaccagctggtttatcttctgcaagaacttcccatcccttcgacccttgggaactgtaaatcaaatggcagactgtgaacattaaaatcacacattgaaaataatgcatctctatttcattcttttttccaggtttgagatttttaagagctctgagactgatacagttttcagaaattttgcagtttctgaatattcttaaaacaaggtaagatgttcttcgtcatatttttttcattccagtcccctatgccaagttgcaaatatcaggtgtgcttgctttcatcacaatgacattattaatagttatattattcacagaaagagtgatctaacacagagagggagagaaaaccagagtagggtttgagttgctctcttctgcagggccagggaactatgtggtgaaaagagagaaatagctgtgcatgcagggaagtagggacacttttagggacacatagctgatatctgtgtgcccagtggggttgcccagataagagccacggtgtcaaggggaaaggtgcacagtgaatgagggatagatttgctcattgattgggaagtccttgctgccagattctaaatcgcccctttattacatcactaaataagaaattgaacccagtcgtaaaggcaatagaagcaatgctgtgagaggcaatcacaaacctcatacggcaaacagaaaatcatttcatttcaaagcacattttagatgttcactttatatccgtatagcccttggggctttctctgtgaattgccttttgggggaaaacctacaaacctcctgccgaatgcaccatgaatacttctgttaactgcgttatgatctggaaaacacaactggaccaggaggaaaagcccccagaggatccctttcctgatgacctgccggcttgcagagctggcctgaaaccaaggctgtcttgatgaataaactaataaaagaggttagacgtgctctaatggagaataagtacaggccataaatttctcttctaggaaattacactctaagaagctaacttctaatgttccatttcctctttggttgcccttcatgcatttgataaatgattaaaaacaggacacctccatattttgtgatttgtaattaatatatctgtagttttgaggattagattcagcatcattttcctggtaacacaggctgggacctagcttcctgaatgaacctgacacagccaacaaattcaacctatgattggctttactccttgggtgttagtgttttttttgcttgtttattttattttgctttaattccaaattggtttcctctctctgactgctcatctatgtgactgtgaggtcaaattcactttctattagtcaagttgaaaagaaaaagagaatccaatggcactgaagtctttaaaagtatgtcctcctgccttttactgttcattatcctgagataagaatttatcagtcctctatttattagcaataatgtaatattattcacatacagtgaatattgtatttcttcatgtttttctgattgccaataaccttgatttctgccttttaattattcttctatgtgctagaatcatattacttttgaaatgtaaacgatcaatgaagctagcatctcgccaatatttacgtatgtcagattcactccactagactgtgttttaaagatggaacgcgtgagtacccagcaccaagcatagagccttgtccttaagagacacttacttttttggtagggatggtgttttgtgacactctctaacattgggtagtgtctgtctctccctgtttcacaattacatcatatgttagggggatttttattctctgatgccagcattttgagaaggttccattgctctgaggaatactgtctactccctggaccgttttagaacttgagaaaatgatggaccatctgaatatctttttctgactttctgctaggacactcacctctctttcctttggatgcgggaagtggctgtgggatccctggtgtcagctcacctgccaactgcactcagtgctgcctctctcagtgcagagcggggaagctgaagcagccagccaggggacgagggagagaatggccctagggaagagtcacggggtggaaggctgtctgggcatctgccatccgggccccaaaacagcctttttccagcaccccacttcccactatatgaaactcttgttgttagagggtgctttttgccacaaacccacaacctgggttttcagagttcctttcacttatggtcataaccagatggttgagataattcagcaagcctggagtgagcacccattggtatcagcagcaaggtgcatgctaggagtcctgctgtcagagaacttgctgcgtagggggccaggccacctgacggtgtggttaatgctgatgtcagcatgcccaggggttgagaggggagtaactaagctgggcttagcctgagttgcagggcagtcaaggatcttttcgaggagaaggttacttttaggtaagccttgtagaaaaaagtgtcatcctcatggggctgggcatgtgaggggtagggtgggggttgacttctaatcaaggaagatgctaacagcacactggtgtgagagcataacacttggggaaactttgggtaattctgcactcctggacattaagcgttctgtgatggaaagaggaggatgaggttaagagggtaggaaaggccaggtcaccaggcacagaagcaaacgtcatgtaattgtaagaaatctagaagctttaggacaactctctgaggccattctctctccaggtgccagcctggctaatcttggctccttccttttgggcatccccaagtgtggatcccaaagttctgtcccagagaaagtgcagccttggcttttgtagggttttggacttttgagcgattctcctgtgactcttccatactctgctgctttcatagcggtccttccagaagggtgggttgggggacccatgtaatcgtctttagggagattttgtctggctctctttggcggtgaattcctgccaatctgtggcattaggcagggatggaggctttgcaatgcaatttgaaataatgatttggagttgctgtttcatttccagtactttggctgcctcactgggccaagagctgaaagaaataaggcagagaagcataaggtgggcagaaagattgataaagaattaagaatgcagcagaaggaaaattaaagtgcatgggatgaaatgggcaaatcacaattatgtgaccagcatcagggccctttcccaaactgcaagcccatagggggcctagaatactccatagcctgaaacggccaattaaaggggagacaaggagactccctctcactatctgaggttttggcagtttctcagttgccctgcaaactggagatctaacacacaggtgctagaacacttattctactgtcagaggaaagtcagcagctgtgtttaaaggctgtaattccacatctcattgactgtggtaaatattgatgactaaaacatggatcactcagcaattttttccaaaatgggaatttccttattgtttcctctaatttttcttttcttttcttttcttttttttttttttttttttttttttgagatagactcttgctctgttgtccaggctgggcgtgatctcagctcactgcaacctccgtctccagggttcaagccattctcctgcctcagcctcccgagtagctgggattacaggtgcctgccaccacacctggctactttttgtatttttagtagagacagggtttcaccgtgttggccacgctggtctcgaacttttgacctcaggtgatctgcccactttggcctcccaaagtgctgggattacaggtgtgagccactgtgcccagcctgtttcctctaattttgaaaatatgttcatggtaaacattgcaacaacacacaaaatcacataggataaagtaaaattgcctccacatcacactactttgagataatgattacatctactatgtcaccttttgtttctcacatagcattccatgatatgcatgagtcatcgtgtacctaaccaatatggttttgggaggcgtttttgaaactaaaacattactactgacatgaacttagaaatggctccaagataaagtttgtaaagaagagtattctatatggagactgcaagagatgtgcagggagaggccaaatcatgcaggttcttagattcatggactttactgagaacaaatgagagctgttgaaggattttaatcaggagaggaaatgtggttagactgacattttagaaagatccactattccaacagttgtatagagaatggggttgaagcatcaaagacctcatagaccataagaccaattaggaggcagtagtccagggaagaggtattagggcatggccttaggcagtgcaaattggggcagagaaagaagaagggatctagagataattaagggattgaattggcagaatttcactttgttccactcatgttgtcattcagaccatttatgttagtgtggtgcagtccagttaactttttagggggtgggtattttacatctgtccagcaaagagagcagtaaaacaaacaaggccagcagcacctggcagtaccagaaacaaagagaaaaattagagacaagcagaacagggacaaacgtacacttctttgtacaaagtgcatggcattttctgtgttaactgaaacatgtcttgttaaacatatagaggacaaaggaggccccagaagctctgggtttacagctgtaatctctggagccagaccttctcttgcagcatccacagtttcttggaagaggtctctaatctacaagaatcctgtgcctgacctatcatgattcactgtgtccatcgatgtgaattagaactcatgggatggagactcaggaattgtataggcaacatgagaatgattgactttagttggatcaggtgttgatgataagatcataatctccctcaaagcttaggaagcaggctagaatctgaatggttcaaatcattctaaccgctggtagcttcgtgtttggcccagatccctgggcttgaccaggaaggctatgactatctccacacagagatatataacctttgctatgcagagcacacagccctgctcctggcgtgcctcactctttcttcccaaggagccctacttaacctggcaaggttcacatttcagactgtggagaatgcccaccaggggttaaccttgcatcttttgcttgtagctttcagatgtgtggtcatacagtttcatttagaaagcaaattcctaaacctagggatctgtgataatactgatgtcataaaaataatcagatttcagagctaaacatggactgttttagcaacaatgattaaatgttctgcatatggcaagagctccctaacgcactactaatatcactgtaaccatcatttagagtttagtaatcaccatatttaggtcatttttccaaagcaccaaggagactcagactctaaataggtttaatatctcaagaggactctacatggttgttggtgggacactgctgtgttcaggtcccaagaatccaggagtatgtaagtgaagccacttggtatttaacgataccctgagaaaatgaacaacacacacctccctaagaggcctccctttgtcgccggctatcagttcttcatctatttcttaccctccaatgtgggagcacaccttagaggacttacaaggtacaggcaggagagaattctgcttaacacaacatctaacacataataagggctcaataaatattggcaattattataatctggtaactctagaaatgaccaagagagacagaatggacattttggctgtttttccaagttttcgagccagaagaaagttgttccacacattttgaaatatcagtctcacccacaaagttgaatctgtttattctttccatgaactgtcagaatcaactctggaaaaactaagactatggattcctctgtgctcttccatagaagaagaaagattgttgttatgagcattaaatgacttagtatacataaagcacaggtgatcctaaagcacttaggatggtggcacatgtggtgagcactgggaaagaactgtaaacaagctagctgaaactattactgtgatcttaaatgcctagaatttaaatcattggttctccaaaagagaggtaagagagggcagtcataacagagatgaactgaccaaaactaatgggttgggcaaccctgtaggctgcattaagccactactgggaaaatgcaagagctagaaaagagagttcttttctgcaagatgcagcaaggaacacaagagtcaaatagcaacctaaaactttacaaaagacatcttaagtcagtaggatcaattaccaatgaatggctggagttgagagccggggaaagtcactttgtcttgcagatggatggaacgactttaaggaagcagtagggattgaactgggctttgaagaatggggaaatttgactagatgggaagggctttcaagttgagtaaatagtgtaaacaatagctatagtaaataggtttagctggcatggcagtttcaagagtttatgtgaaagaggggtggtgggagagactgggacttcacaaggtgttgacaatggaaggagagagtttgaatgtcatcttttagtcaacaagaagcctttggacagtgaagtgacctgctgacagcagcgttcaggtataccccagtgggactgaacaggatgcagtttagaaagagagcaggggcagataccagtgcactcagtgcagagtcacgggtctgctatgctccagggacccagggctcctggaatccagacagacaaggcctcagctcttagggacctcaaaatgtcataaggtccagttgatccactcaaggaacaccagtgaatgctaaagctattaggtataaggtttttggggagcaggatattcctgcagtctcggggcctcactcaaggtggcatattcattacaaagggaaatgggcacctctcagtggagacattagcatttctgccttagccacatggatggagctagtcattgggctgggatatcctgatgtgatgccatccccgaagagattcttaacagaaatacttaagtagggagctatgtaggatgatcaagtctagaggtctaatgtacaacatgaggactattgctaataaaattgtatggtatttgggatttttgttaaatatgtagattttagctgctcttgtcacacacaaaaacgtaactatgtgagatggtaggtaatatcatgttgtaaacctcaaacatacacaataacatttatttaaaaaataaactgggctgggcgcggtggatcacacctgtaatcctagcactttgggaggccaaggcgggcagatcacctgaggtcaagagttcgagatcagcctggccaacatggtgaaactccatctctactaaaaatacaaaaattagctgggcgtggtggcgggtgcctgtaatcccagctactcgggaggctaaggcaggagaattgcttgaacctggcaggcagaggttgcagtgagccaagaccgtgccactgcactccagcctgggtgacagagtcagacctcgtctcaaaaaataaaaaataaaataaaaataaataagtaaataaacaggatccagaatatagaacattatagaagacaacctaggttcacacaaaatttaatgtcattacaaaggagtggtgtcaattatacattagaagggactgaagctgggattggcaaactatagcccatgccggctgcctgtttttgtaaataaagttttattggaacaaagccatatctattcctgtacatgatgtccaaaagctgctctgaagccacagtgacagagttgagtatttgtgacaatgtctatatggcctgtaaagcctaaaatatttactctctgtccttgtttcctgacagttggatttaagccacctaacagccaaatgcagtgcatgaaacttgggtctggggggaaaataaaaaaaaatcaataaacataattttggggcaactggagatatttaaataaggtctgcatattaaatagcattactgaatttttatgttttaattttctgaggcgtgcaatggtattgtgattatgctgtgcaatgcccttcttcttaggagttgggtgctaaagtatttagggcttgtgccatgatgtctctgatttattggtaaatggtttagcaaatatatatatatatatatgtacatggcaagaagaagagaagaaaaaagggcgggggggataagagaaaaagcatgtagggagataaagcacccgtggtaaaatgttaataattggtcagtctaaatgaagagcgtacaagtgttcattatactgttctttccacttttctgtagatttgaagagttttttaaataaaagttaatttttaccaaagttaaatttgttcctctaggctctgtcctgaccttcatcccagcagcttcctccaccttccagaattcccttataatggagaaatggttgggagttagatgtggcagcctctcctgctaagcgggtgctgttaccctgtaaggcagccccagcagggccttcccttggtaacgtggggattttgcttgttgtctcttgcacagtaattccatcaagctggtgaatctgctctccatatttatcagcacgtggctgactgcagccgggttcatccatttggtgagtaaccttgaagacccttctgctctcgcttgcctgcaacaagaccctctctgagtcattttattacctaaaatttatcttgctggaaattaacttcacctcggttgtagacaggaagatgggaagcaaccacacaattgtctgggtttccaacctttttaccccaaactagttccaaatggtgagtaatgtttgcactattaacctgcatttttcagttcattgctcattggtattgtcatgggggctttggtagattttccttctgtctgcaataactatagtaagccacaagatggcagtgcttcctaagcaaacacctggaaaaggtctggggacaaggttggaagttggacccacacctcctagtaaacaacaaattcagatccctcaatttctttccacttccgccttacgaaaagccacctttgattattttgtctgatttgtacctcaaaaatgttcattctttttcattagtgactctttgaaagccttgtattaagtcaagcccctcacaccacccgaaggcagactttccccctgcttttagagagcacagccattgtgggaagtgtgtttcatgcaaacatagactgttacaactggaaggagcctcgtctagctctgagactttggataaagttgaccaccagtggctgagcctctatttgcataagggatagaaggacgcgcttagctacccacacttgggatttaggtaattatcacccaaaggaagacaggcctgggatggcagtggttggggcatggggcctcacgtagtcaccagatctagagtctcctgcccagcccttaatgctgatgggattcatggccaaaatcaaccttaatcaccctaattcttgctgtaaccaagcacgaagcacccaaatcacatatgtggaggagatagttgtctttaataagatgatgaccccaccttactacgggtattagtgaagtcccttcaggttcaccaggaaacttttgtgaaaatggcacattgaggacaaactgatgtgtgaaagaggccaggccctggaaacattttgcagaggcagaggtggaggcctgggggccaccgtctacaggccctgtgggtggatcacaggcatatttgagtaaaattgggcccgcagctccctctctcctgagagtatctaaagtacctttcctgcccacctactagccttgttggcagatcaaatatgatggaaggacaggaaagtggggaaactgcagtctcgggccaaagctctccaaatccagccacacccatttgttgaagttttgcctctgcagagttgaacaggacctgtgtcgcccacaaaactgaaaaagtttgccagcccttgatctaacgggctgtgccagtgcaagctgttctcatgagctcactttccatgcccctgtgaagattccagcagcctcaaggctgggaccaccattgccaatttgcaaaggagggagagcagggccagattccagagatgctgtttgaatcagaaataagcagggcccatatatactctttggataaactgatggaaggaggcagccccctacggaagtgtttagaatttctgtgggagaggcagatccagggccatctgggccttagaaacccattgaggaaggtcagggacggaatctctggctctttccttgaagagagtgctctaaaacctggccagaggcaatgccctgaattttagctggcttcccacattttaccagaagaagagaaaaggcctagagatatttcccttcttgctttccctctctgtctcaatcagccaggaagacatctcctgcagctgcttctccactttctctgtgtcctgctcaggagctctgcatcctgactcacagaactcagcccgggaaccacacatctcgtgtggagagtggtgtgcagtagcaagtggccttcgagagtgccgagcttccgcgtttattgcatgtatacacttcaatagcatgtttttcttttttctcccctgtcccatttgctttaggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggtaaaaaaaaatctttattatgatgttgattttgatggctgttaatattttccatgatacatttccttaaagctttgtattttagactgtattctgcactagaagcaagccttaacgttacaatcaggctaagtaaatccaaacacgatggtgacttttctgcataattcttggtgtattacacttgtcccatagatccaggcacattgcccttgtcggggacagccatttagccaggagcaaacctaattgtcttaagaaaagtgatgctgttaataagggagagtgtctaccccttagcaatgtaactcagcatctggtatgctacaaggacagtggctgtcacctgcctctggtagaagctgtcgatactttgtagagacagtttgcggtttcaagagctctcccttcccctttatgttcctcccctaacttccaacaaacactgtggctggggcctgccctaaagagaagggtccctacatcaaaggagagagagcaccttagtcttgtccaggcggacatccccatgtgagcagagtgcagttttgcaaacagctcactccattctgcagcggacacatggggtatttttgctcctttcttctaagaaagtttcactgtttgctttttaaaagtctacgcagctctttatgttgcactaaaccaccccttctaatgtaaatcgaggggatttctggccacacgttggcagttgctgcattttgtctttcaaagtagctcattttaagtttagattttttttgccatttatgaagcgagtgattaaaatcctaatccatacacagctttcatgtatgtacaccgtgcgcacatttatatgtagtgatgcatacacctctctctgttttgtatgcatagggcctatacattttaaaaatgtatataaatgtgcacatgcatgtgtacattcacgcaagcatttctacagcatccgtgaggtgcctatagataaaaagacccatccagccagccacaggccagatgtttgttggacaaaacatggcagatttgtgtttctccttgctatcttctcctcccaggtgatttcctaaatttcccttttgagcttttcagtgtttttttttttttaatagaaaaatgtagtttttaatcttttggtgtttattttcttttgtcactcataaaagcattgattctcctctgaattttaatgacaaaggaagatcttctcttgcgaaactgtgtgtgtctgtgcatgcacacatgtgtctgtgtgtgtttagtttcactagcatgtccccctcttgcctatttttcttcagcaagaagaactagatatcaccttatttattcctgtctcctttgtatttttctcgactgtgatttttttttgttctttagttgtcaaggtggccaatgtttgtttgtcttgtgtatttctgggagcttgctctcttcgtgcttttagttttttatgatccaacatatcaatatatacctttgcaggcctaatccttttgtgttttcagatcttagtgcccccaccctctgaacaggtccccccttttctttggcctgtctttttagtctctcttctgtctcctatcttctcaggccatgtttgccagctacgtccctgaaatcatagagttaataggaaaccgcaagaaatacgggggctcctatagtgcggttagtggaagaaagtaagtatgccaagaggttttgctgcctctgctgcggtagaatcctctctgcatgccatttttttttttttggctcttgtttctttgtttcatgcatgtaggcaatgtttgcccgctacgtgcccgaaattgctgctctcatcctgagtcggaataaattcggcgggacttttaacaaacatggaggcagaaagtaagtcagttgcatcagaaaagatgtggttgagtgactttcaggagtccctgtggaggtgccatctgaattctgcccctccccaaccccaccaggtgcttctgtgagggaaggcccagtttctgcatggggtgtgatgtcagaggtgacccgaggacgttgccacgcttggaccaactcccattcacaaattccaagagatgtaatgaatttatcctgaaaggagtccatttataactgggcccatattttctcttctgacccctaacaagtaaacaaaactcgttcattcttccatcatctggctatgtgataaaattctggtccctcaaactagtatgatgccctcctatggtggtttgtgtgtagcaagaacacaggataagactctggcagagaagtccttgggtggcagatccaggtcatctggcctactgcaaaggcactgcggccactgggaacccagttctcctcttcatccaggaggcaccgatcttatcctcaaagggactcattactcagctgaaattccttccgggcaagaaatagtatatttctggtagtttagggtactacatgctattcctgccaaatcttttgtttggcttcccaaatgtgaatgctttcttctcgggaactattttagtgtgtgctcagatcactttatcactctcgatatcaatgtgcaggttcaatagagaccccaaggttttttcctaagtagagggcagtaccttacaacctcaagaggagaatgccatgggggagagggggctggcagcagccatcctttatttatttttttaaagctttttctggagtagtcacctttgtttgtttttggttttgaggtataacttacatagagttaaatgtacacatctttaacatataaagtgaggaacttgtacctatgtacacacccagtcactatcatcctaccatccggatcaggacacagaaaactttcatcactcatgcctcttcccagtcatggacgttcctatcatggaactgttttgttttgttttgttttcccttctcgttctgtttcaaatgaactcttaaagagcttcttttgtttttttaagaggaaataaaatcagactgggagcattgtatttccctccactgctgccttctctttttgacagtcagccgtgtgggacagagtggaccctcccctttggtcagtgagtccagtgcttcctgagctcaggtgtccaggcctctgcacaggaaatgaggaggtggacaaaagggctcattttcttgaactacccacaggacacccgtttcctttcaaaggcacaaaggacagtgggccagaggaggccagttggcgtcttttccgggaggcagcacatccctccatcttccctctaatggagccctcccctcaatattatcttaacagccctggatgaggttagaaccaagctgttctgatttctgggccattggttggatccaaaaggccaaataagtccaaagattcccagtggtcatgtatcccatgccaagaggaaaacagcatctcaattcattttgccttgaaggtgtggacaggtctccataaagcagaaggcattctgagggcctggggctctctttatggcctccctatcttctgacgtctccgccagcatttcccaatcactgccccaagaagtcaataaaatcaattgccctgaaggctaagttgaaaatatttcttgactttcattccaggtgattttttttttttaatgaaataattttcctagtcaaatgtgggtgagctggtgggtgggctggaggccggcagcttttggtgccagctgacccagatggggctctcagcccggcactcactcactgcccccagtccgatccggtcatctttcaccctggcagttccactcaaactttcaggtgctgatgacttcagatcacagacttcctgccactctgttctggctctgtaatcttttatcaccgcttttagcctggttttctctctctctctctctttctcttttttttcttctccgtttatgaaaatgcactttgcttttaatgttctttttgggtccccactgttcctgaccctgcagacacagagtccgtcctgtcatcagcaccgggcctgttcactactttatgcattgtttcctggttcaaaagctaattactaagtagtttaaagaaggcctttggtcacttagatctttcatcagaaaatataagcttgggaaaggcacggtaataaagggccattagcaccctttgtttgatgttgtttttccagtcagtaaaacaagattgatgaaatgttatgtttggccaaattttgagttttcatttggaattcagtgttgagagaatgggctgtcagaatcaataagttttctttcgcttgggatatgggcatgtggtagtaattagcaatataaggtctttagttgagcaaccaagcatggattctggcagcaaacataatgagaaactacagttgttctatttctaacgtcaaaaagtttccagataaaattaaatgcatttgcaaaaggaaagcagctaaactttgttgaaagataaagttcagactcttaaaacagtgtgctgtgctctgagtttttgtgtatgcataagtccatgtgctctgcccatggacacacacatacatgttctctgctccccaggacccaatcaaataaatgcccagaaagaaattagaatgtatacatagttaagggatttgtttacttgtgcatattttattcagaaatgatttctctaacaatatattaacttgtcagagaactcaaggtaactcatgatctaaagctacagagacataaaactttgaaattcaaagattatttaaagtacaaaatttaggcagagaagatcagggttttgtttgtacaacacccaaattcaggatatttgagaatatgaagatttcattggcatttcattttcagttttaatcaatgtgtttggcataatataaacatttcaagtagcattctcaaagcctcttcaccatcaacactatttcaagggcctagagtgccttacccaacattttcatcacctcctgaaggatacccagtccctgcagtaggtatgggtaattgtgcacatgtgcgtgtgtgttggctatttcatgtatgttatgatggattggagcatctaagaataggggtttgggtgtccacaaccaagggttcagtgagtagctgaggcaggtaatctctctgagttggagggattagagctctctgggctcttgggctgataccctaaatcttattcataagggagccctcctgcagcccagcctgcctcccaaggccactgcctcctcctcctttcctttgtgtaaggtcaaagctgcttagagacagggaaggcctgagggctggtgacgctcccatggcctttgggatccccagctctctcctccctctcacagccccttgcagtttcccccagaggtctcctccctgagtgtgattcattccactcctggttagtttatgagaactgacaagatcgtggtccaaggtcacatggccaagggccatggaaaataatcagtcacagagaggaatccatctgctgtaacccccttgttagagggagtccagccgggagccacccagaccttgtgtttcccatgttgggacttgagtgactcaagtttgaggcaatcctaggcccaggtgtttgggacagagagaatgggatgggtttggattattctactgattcctggtagccaaatgctgacagggcacacgagaggggaatgagtcatgaaagactagatgtagccaaggtgggagaggaaagtgagtgtaattaacttgaaggaaggtcctcaggatgaagctgctgagccgccattctggtttggggaatagttgtcatggactaacccgtctcttgctccaattcaagaaagctgcctgtgaaacttaaatgctgtggcttctcttggaacatttgcctatagagacaggagtgccacacacttcctgaaatgagaatgtgaatcagtgcagcctaaagccccaggactgccttctctggcaatagtaatacctacaaatatttgcatatttcagaatcctcacattgatcctgtgagaaaggtattaccatcatctccatttggaatgagtgaagaaactgaggaacagggaggttaagtaacttgcctgacatcacgcagctagtaaagagttgggctggggtttgaacctggacagcctgcttccctgcgtcctgctgcctctccatgtcatctcttgagactccattctgctctaaactcagtgatctcctattgtttgtatcttcctccacctttccgtataaggggagccagagtaccgtgctcatgatggagaggaagagaaaggcatgagcttcactttggggctgtctcctctcccctcctgcccacccactacccctaagggtcctggccccaggattgaggggaaaaagatggagaggggacaaaaccattccttcctttatttttcccatttggttagactagaattctaattccctcttgaacacttctagcaatgaaaggctctcaaggacagacagatgaaccacacctaaagtgagaattgtgccttttttgtggatttcaacattttcttccccttcctggctccatcctttaaaggtagttccatggagaattgtagtgatctgctaaacttggacttccctgctgggcagatctcacctgcagagccttctatacccttgcagatggaaccacctgttccctttcactccttagttagtctgccgcacagcacagagcagtatctggaggtggtttcttccttatcagtgaaaggcacagtagagccccacgtgaccagttctgcagggtgcattctgtgtgtttgtttcatagctttgacttggaatattcaccctcaggagcctgtatcccgctggagggagttagggctgtctgccttcaacctcggatgtggtctccacattggaaagagccttacattcagagagatggggacagtttgtcatgcttttctatttaaatatgaaactagagtacttaattatcttctttattgtaaatgctcatattttaaagaggattccatactttagaagaaataattgagtattcaatagttgagaacaaaattcaagaactaaaaacagcccagcacagttagtgacctgcctcactgtccattcctgtggcccctctccatcggttcattcactcactcggcaggcaggcattctctgtgttatgcatcaggcatgatgctgggttttgttgggtgctcagggttcattggcgaacaaactaccctcggaacctgtcctcctggagtttacagtctcaaggaggttgcaagcactgagcaagggtacaactaaagcaaatgccaattacacatttttaatgtgtgctgcaaaaccagaaaagactaagattctgcaactgagaaaaacagggattagttacactggataaagtagtccaaggaagcgacacctcagaggaggagatgctaactaacgcttgttcaatgaccttgacccagcttgcattacccactaagctgggggagctaacactcttgcttttaaaatccaggttatgcaagccccacttgcaaacataggtcttcagttctacctccactagaggaagtcttaaaaactgattgctcgctcagaccccaacctgcctgagcagtgcttgcttgacttatcgggagatggcatcctgcgtatcttccctgcttcctgattattgggttatttttaaactctgtgtctttccttatatcagaatttggactctccttctcactcagaacctttgttccttcctgagagcgcacactattccctcctgcctggctgtcttgtatcaacgtggaattccactccatttcctccaccacactcatgtcttgtccaccagggttctagactgatttctaaaggatttggaattttaaattgtctagtgtgccagagcatggatcatttatttacaaagactcatttaatctatggccccatagcctaccctaccttaaaggaattaacatgagtcacgccttcatgtccatccattccacatgtgtttactgagggcttgctaccaggcactggggacagatgcatttctacacatccataaaaatctccaactataccacagcttttctgagctacacatcgtactatttggccacctaagtggttgggaagtccaatatcagggcttattgaaacctcttctcttggttctgagagagtcttgctacaacaccatttccctctcgactctttctgggaaggcatggcctctagcacttgggaatcggatttgagatgatttcatgttatactgacttgggccgatccacaggccttttctttccatgtttacttgtgtcttgggcaacagctattctcacttttcctcgcctgcaaggggcggactgctctcatgaggggtgtttcctataaaatgtcatttacgatttctctattgcagacatggctctggtcgaaatgtgactgaagctttgcatcctacacagacttagatccctcatcaagtagccattcagccctcattgcatgagccacgtgacttccccagcctgaacccctcagcaatgtctttggattcctagattttaaaagccataaattagcaaatcatcaacatatcaccaggaaggatcatctggtagcgattctagtcagaaggaaacacaggccccaataaccgatctttacaaagatatgaagaactgtagacagacagatacagtaaataagaagacaaatagataattcaagttgacagaacatcttggactgattaggcattctgctttgattagcattaaacttcttgggaacagggaaaacaaaaaatgagcttgccctaatactttggaaaaatgacctcttgactacttctgaaacgtggtgctgaggggtagatacccaaagcgcttgtcattagatgccatgtcttctgatgtgatgtgctaggtatcccttcctgatgagaggggtcttggcgggcgtgggacatgggcacttctttcttggcatctgttttggattcctctaagccatatcttcagtccctttcaaacttgaagctctatttaaagagacttggaagcatattaaatcaatttcctgataatactgatagaatgaagctcccctcctttcctgctgtcactcttcccttccacacacttagcaaaatgttccagctattgttctgaaaacaagaatagaaatgtaggtgggagatgaactgtgtaccttaaaaaaaaagtcgtattcaagcctagattttcactctcaaatattctttcttccattaaaaaataattcgaatatgatttctcaaattataattgctgaagattctgatcaatggctcctttgattgggtgaatccttgccgggtagattcagaatctcaggaacaattgcagccatccagactaggttgccccctgttttctgtcttcgtaccatgtcattcactctgctggacttctttccagagctgtgcaaaatggttcctggtagctttggggttccttccatgctgctgtcatcatactatgaaactaaaccaggaaactttctaactggccaagtccagtgtctctttttattaaaacattatagaggtcaatacattgtgagagttgtggaaatctgattctcttgtcccaagggttccagtctccacagccagtactggtgttgcatcacaatggcctgctgtcacccccagaaccacagggactgttccaaatatgggtaccagttgctggaaaagtaatctatctcccctccttgtacctttctaacaagaggacatgggggcagttcagagatagatatgtgcccatctcagtgggagcttatatgaccttagccattgactccaaaggcaaatgtcagctagtgtatagaacagccttaggaaaactcccattctaacatattggctcaacaaacaataatttgaatccccaccatgtgctgtgggtaaaatgtggttcttgctctcctggagcttatctgagattctgaccaatcagtaccacccaaggaaacagtggcagtgaaacagaagcttgagtatgcaggagcgtcttcccagtgaaatgctcttttttcaggaattttattcattgaaatcatggaagtgtacaataatcatgaaagcaagagacattagagggaagcctcccaaaagcatttgataattcacgttgttgaacatacccattgaacagtggagagcataggtaatagcagattgccttgttcacctaaaagcttacagacccagtaaaagaggggtgcagaaagatttgggagggttgggaatccgctgatgtgatcctgaggtccactcctttccagaccccacaaaggtcctgctgtggcctgtcatgcctcgtatcatgccttctttttacttttttccttttctttttttttttttttgagatggagttttgctcttgttgcccaggctggagtgcaatggcgcaatcttggctcaccacaacctccacctcccagattcaagcaattctcctgcctcagcccctcgagtagctgggattacaggcgtacgccaccatgcccagctaattttgtatttttagtagagacggggtttctctatgttggtcaggctggtctcgaactcctgaccgcaggtgatccgccagccttctaacctgtagctccttccagtccctgtgtgactaacagatgctggaggtctgctggggcctatgcaagtatgttgagtctacagagtgaatggctagcagcttatgctagctgtggcaacaccgttgggtgtggctggagaacaaggcaaagatatgtcaagttggttgtcattatgggagggtcagtcccaacagtatgtgctcaaggaccatgatacatgattcaccaggggtgttagggagggaggtggggctcgctttgtaaatcaaaaccctctcctgggcaaaattcagagccatttctttgcttggactcattctccctctattccaccttcatccctgaagagtgaggctgacctttgcctgccttagtcttctctcagtctctgcttgtacagaagcagcattaaaaatgaaatcgggcaaatctgctttgatctgaaaaaaggaaagtgccattcagctccctgatttctctgtaagagcagagaaccatctagcattgggagattcaggtcaagggaagacttgcttattttaaaatggccaaaggccaccaagcccaaagtaatgggatgaataagatgcagaggggtgagggtgttggggagggaggcataggaggaatcagtgcagtttgtgagggttcagcaactgtggaattgcttactgaagaaagctgcagaattccccttccagagaggaaggaaggaaagaaaggaaaggagagagaaagaaacctaaatggtggtaatacttgcatactaggtaacagtgagaattaggtgagaaaccaaagtaaaggtaaacaagtctaccagttaggattctctggttgcaggcaacagaaacttatttttttgctgacttaagaagaaaagttttttgttttttttttttaaaggttagggtaccttagagattccaatgaaaaactgaagagcaagatcccagaaaggacagaaaagaaccagagatgcagctctgacactgaggaagtggaaactcgggagtagtcattacagggttttgtcatcaggttgaatcaactcccactgtgattagcatcagcccatccaagatttaagagtacccattggcctcacttgggcagaaaaccttcactaaaggtcccaagactgtatataattgggagactgtatttaatttggggaggagcaattccccaaattaaaatgaggtgctgtccacagaagagagggtgtatgcaggacaggcaaaatctaccaatgtccccggcactgagtttctcagaatttaaagacttggactgaggctccatgtaggctacaagctacaaaatatgtgtgatcatttctcaccacggtctaattatggaggtctaactgtgatttgggatggtggaggtgtagacacagatccctctagggtagctgaggttctgactgtctgcatgcgataagatgcaaagttttggcccaggtgggacatcccggtattccccactggggctgccagttgtctgtcctctaaccttggggctctgctttagaggtgcctttgctgcactgttgggatctatttgctcagacttctgccccatttagggaaacagcagcacagcctgccacatccagaacagctccattgacagctggagaagaagattactttattcacttcctcactaggagggagaatgcatttccttcctttgtgattagcaaagtactagatgtgtccatggataggaaattatcttattgctgaacctccttttttttaaaaaaattattttaacaggaaatggtgatagtcagggtttggggttgtgggactgatacacactctcatttgctttgtttttatttttctttatgtgtacagatcccttacaaacttgaaatatgctagtagattcagggtggtggaataagcctatggtctaaaaggcttgcagtgaactacctgttaacttttttctgcacttaccatgggatagagtctccaagatgcatactttgtcaaccaatccatcagttaacaaatagttcctgaaagcccagcaagttttgggggttccaagccaggtcctggggtagggtggagggatgaggcagcacagcctggagttaggcttcatttgcccatgatgtctcccctatctttactgaagtcagtctctttgagacattgagtaaaggaggaagtgggaaggtgggagttggattagtcttattttttggcagtgggggattgagcctcaagggaagcgctgggaaacagtaaccctgaaggacatgccccaaatcagggaaacctgcattaagactaagtagccaagaaaagcactaccaggtgagaaggaaaggaaaggccagcttgcaggagtgtcatggagaggtggtgatgcagacaccaagggttcaaggtcaacctaggggggcaaacgtgaagctttggtgctgaccactgtgtggtttaggtcgttgggtctctaaccccccacgccctgcttcctgtatgatacagtgctgctggttctcttgagaagtacttcttaaaattcattcccatcatgtcaggggctaccaatggtgagatgcattttgggaggagcaggacgaggaaaacacaattagaaggctcagcagaaagacagagagtctagcatatgtatttgatataaatattatagttttacagagacatctagatcaatatgtgccacatttcatctacctctttgacaaagtgagcacaatgtattcaggcaaagctgtataggattttcaatttactctgtctgatttattgtgacaagatagctctgggttttttaagttctttatactcgttccagtaaaaatggatatagtatctttaaaaataaacagcccagagctgtgcattttacattgtcttcctagagcgaggctctgctaaagaaagatctaaggcctccccgccctcgcagaacctgatcgcagtaggatttgctgccatcccttctctttggcttttttgagggagtgtgggaatggttgggggcagtggggacagtaaatagggaaatcagttaggaagcgattgcagatgtctagataaggtatgatggaggtgtgaactaaggtcggacagagaactggagccctgtgtgaggattcatcagtgtctggtgggtgcagcccagtcagcctgggcctcttcattttagtgactggccccaggtcactgagaactcgccccccagtctcccaattcccagcttaggttatcctccctggcaccagctgctttctttcatcagaaggcatgaaactgagggaggtgttgtgctctggatctggcactcatcttgcaacctgtttccacatcaaagagaagaaaggtgctagattaaacaattgccaagggctattcattcagatgctgagataaacttaagaacgtgggagggggcccaatggtgactattccatggtcacagtttcccttttcaaaggctactggctctaacaaccagtatctgaggcttgggaaaagtatgtagattttccttgtcatagacctaaaagtcatcttcagtggctctcttgatgcctcagtcactgccctcctgtcctcttctgccttctgccttaagtcacttcccctaggttgtcctgtgtacctgtggaattgagctctgaaactgaagttctggctcaacttgggcatgcaggctttcctggcccatcactgagaagagagtagaaggattgagaagaatttgtgggatttcattctggaggcagcgatgcttaaatggcaggagaagcacacccatgtatatttagtgaagatatgcacatgaaataagcaactggcgaatttatggtgaccctcaatagtgttcataatcatcaaacttcttctcatgaagtcattcttacccctccaatgccgtgacccaccgcactgcccttttcagttaaaccagcccatatttatggagccctgacccagcaccaggcactacttgctcacactggatgaataattcctctccagaaagtgccgttggatactattttggcattgaagatgcttccttgtgtttctgaggtggatcttttattctaagccatgacctgtcagcttatatctattttatgttacctttgcccaagaaatatttgtttacagatccagacctagcatttaaaaccaaaaacttcatcagatcagaaatggttattgattgaggactattggtcatcttcacaaattgagtggtcaggccctatagaaattggtcaggacaatcgctgatggtctaagaaagttcagatccacatccacagatggggagagatttagctactctcatagctgaactttcctaaatattccccattgtaaatggatcattaagattcttattatcttctagattccaggctggtgaggaagtcctgagctgtacatgacatgtctaaaatagacatttggggtagggcgcggtggctcatgcctgtaatctcagcactttgggggccaaggtgagcagatcacttgaggttgggagttcatgaccagcctgggcaacatagcaagaacctatctctacaaaaaccaaaagaaaattagccagctgtggtggcatgcctatagtcccagctacccaggaagttaagacaggaggatcgcttcagcctgggagttcaaggctgcaattacctctgattgagccactgtactccagcctgggcaacagagcaataccctgtctctaaaaaataaataaaatataatataaaataaaatggacatttgcatcactttgcagccccttagcttgctccaatcatatggcttcagttaagtttggcttagagttcctgaccggtggaacttatgatttctgcctgtaatcagactttgctaagactatcatgatactgcctatccagccagactctagtgatcttgcaaaactgtgatggtttatccactccagttcccagactaaacctctcccttggccagtggaggacccctccaacaccccctccaccatgtatccaggaggacctctgtgggtccatttctgcttgccctgaaggagcagaagctgagatatacaagcctctttcctttccaccaccaccttcatcttagtgggaactgaagtgggagacccagattgcatcctgggcaagtcacttttacttgctgtgggatgccaggcatatatgacttaaggaaagagtttcagagaggttacctgaaaagactcaggcagtgagaacacagggttgttgaaggattaggtgggattgcataggccacagaatactttatattggttacatcctaatttacagataccatatggcacttaccatttcatagtgcttaccatggagcagattacttggcccttccatgtatcatctccttagatatcaggataacttcatgaatcaggcaccagctctggcccctcaaaggctctggctttttaattgtaaaatgcaaaattggtacattgtccaagactatttagttatttagtgtctgagctgagttaacacagggctatcagagtatgaatctcacatggtagatatgtaggcatcatggaacccaacagagataactttggatggggatcttttttggcattcttcaaatcatgccctgtgaacaaccattactctgcctccaatgaggtcacaccctgctgtctatcttaacatatttgtgttgatatctctaataattgaggatgcaataaattctagttctcttcttcctgcaataatatccttccccaaactatggccctagaatcttcaaaagtcttgaaaatatttctggtaaataaatgttccccattcaccatccatccctcatgctcttgcagggccctcctcagacacaggctggcggaagcagatctcctaataccgattgctgagttagaggcagcttctccccatccatcaattctaactgcattcaaacattttcaatatgtgggctccttgataactttcactgtatggaaaacaaaatggagggaaatgattattggcacaaaagggggaggccataaatcttcaaatcagatataggacagattggaacaatatgggttctccaaggttgccatgataatgtacctaataactctccttgggcaaaaaggcaatctgctttcaatcaatctcgctttttttctgagcaaaaataccaattacgttgaaggaaggttttttttcttccttttttgataaagacagctctccaccccagaaatcatgctgtggctaaaagatatatattttcaattgtctagaatggtattggatagctagcaccaaatgaaaaaagtcaatcctttttttctcctcactcttgccagcatttgtctacttcttaagagaagtgaaagttaattaaaggcttaagggataatattgattgcattggaatatattttatatgtacccagtacattttcaaggaagagaaccctgactttttctaaggctgaataaatcagccagctgagcttttgattcaagggtgagaggggggaactcatcttttccccttgcacttctcacacatctttcctagggatgaatgatttcagagaggaggaggagatgctggctgatgttcattcagttctttgcatgctgggtaggaagaacgaatgttcaggcatttccccagacctatcattgatttgagcctagctttgagtaataaccaggcttatgctggtatagaacttcgaactttacaatgcctggcacaggaggccggctgggtggtattaacctctcagcttcctcctgcactgaatgggaataaatactttgcccacacccttggtcgcagagcagggaatcacatctggcttactttcacatctaagtgatgagaacagcctcagccacgtatctgtcctgtggagatacccacgcattggattcatgttggctttgctcctaatcttggaagtctatgtgcagaggatgttagaatggcaaagtagccctattgtcagttgcaaggaagttaggtcagtaggggaattctgtttctcattcacttcaaacatatttggcaaattcaaagtctgaaatcttattcagaacgtgcaaatttatttgaagtattttgtccatgtaaatgtacatgtgccacaagaaacattttaaaatatatgataaaatgcatatcatccaaatgttcaatctatattgtgtattctgatacactgtgtgtcacactgtcttagcctcatactactcaccatatactaatgagggggttagtcatatgggctttgggcataaaatttgggtgggtggctaagggaccttcatcaacctagcaggagagcaaagtgatcatgttaagacatctcttctgaagtagctcattgacactcttccctcaccttggtggccgctgcgtgcctgattgctaagtgcaccaccgtaacaataacagtctataatggtgatattattaactgcatcgtgcatattattgatttactctttgttctgcatcattatcctttcaccaatgagtttactgcattattctcacatacttagtcaagcaccaaattacaacgaaagggcaggctcttataatggcatctaatggaacattgcataagccatcatcactgcctcctattatgagccacctccagccaatgagctttctgccttagtggaatgtgcacagagcaattatgaagtgcaagggacatggccattctaaattttacccaggaaattaccatgctgcatgttcaccacctgcccaagtctcagagcgcagctagagactcagatgctgtcactatgagcctggggggcacagggacaggagttgagcctcttgctacatacagtctcttcactagaagccagtggttttatctccacagtcagtccctggctttttgtcttgtggctgactcttgcatcaaatgctcactcctgactgggcattatgtggcacatataagtggccatgacattgcctggtgccaaagtcagattggccaggagccccgagcggttggagggactgtcagtctcaacagttgtggggctcatctcttccgggtgagccactacttccagaaacagaagtccaaaccaccctcaaacaaggcgagcaattccagcctcatcccttcccagcatctccccatcttgaggtaaattcctttagctctcctggaaatcccgggcaccctaaggaagcagccctctggggacgcacagccagctggcatgatcttccattccataggcatcccagccccatttagccctgagtaatgctcacttactgtaaagtgttacatgcccccattgtcggaggagttatagtggaaaaatgcaaaatttcctttttactgcttatggccagcagaacctataacgtgtcaggccgcacattagccaccctgataaaagtctgctttcttacacacaaaatcatcgtttcagcaagatttgttatctcattacctgataagctctatgtcataaaccaagactcatacagtaaatctccccggaggacgctttgtgggcagaaagggagagatatgaatctgcaagggacttgataatgcagcatttaagcacaagcataatgtcacttattgttaaatgcataaaaccacttggccaaacagttgggcttttaataggattttgtgcagcatcaggtgagaagccatatggcttttctgtctaggagtctcagcacctgctagcaccgctgctttgcctcactgccctctggggatgggagctgggcttttatggaggcggagggaggagatgaatgcttcccctgcagctgcctggcttctgctgtcttgccagggggtgggatgcagggtcctgtccgtggtgcctggcctgatctaactggcctctcctgttcaggcacattgtggtctgcggacacatcactctggagagtgtttccaacttcctgaaggactttctgcacaaggaccgggatgacgtcaatgtggagatcgtttttcttcacaagtaagagcttcctactgctgtcagaccctctgcccaaccacacaccctgcgagggactccctgaatgtctgtaagagtggaggtcttggggaatggcactggggatggggccagagttgggtaagccatgatcccttttggcctcgttggagaagatattgcagaaccaatggaaagggaagcaacacactggttcaatgatgagagcagagtctgcctctgtggaggcgattctgggaccacatccgagtttatctctggaagaaataatagtggagctcattgtgggtccaagtcatcatcattgtccccttagcaatctggcgtgtccacattatctgctgtgggatgattagctgtatggtgtggatacgttaggagttctggagtcagttggtgaccaagcaagacaccaacttaagaggaagcaggacagaaggtaatagtaataacaactgccgttcctaggaacccccagcatgggaccctagcccgtcactgtgcatgcaggctcccatttactccacaaacagagtaaaaatacatattctggactcagattccctgatctgaatcctgactcaaccaactactggctgagcaagttacttaagctccctgtgcctcagcttcctcatccataaatcatggagatgatagtagttcctacctagttgggctgtgatgagaatgaaatgaattaatccatatgaagtgtgcagagcagagtcaggcgtgcagtaagtcttcaataagtgttagctatcagcctgaaaaataacatatatttggttgtataatccacttaggaggtaggtcttatcttgtatgttttacaggggaggaaagcaaggtatctcccttctacccaatgttgaggttttcaactttgactaatcctctttttagataaaaggtagtctgccccaggaatggagagaattagggggctccattatggtgacatgtgtggtaccatggtcatcttcttttatggagatggggctgtcatggggccagtcctggcaccacatcgcaaagtccaggacaaagctaacatgtttgtgctggcttgacgtgctgttgactacccagcacgcggtcctactctgaggttccactgaggtcggcttccctacaaactccctgtttggtggatcgtcgtcctctggcatttgctcacagaatgctagacttctgacttgtcaccatgttggggcaccaacatttctcttttctgcactgatttctccaaactttgaaaaaacagaccaggctatgttagcacaggagcaggtacccacaggttccattcagtgcttagccactgattacctgctgtgtggcccatcctctactgagcgttttggaaagttctctagaggtatagtgtgtaggctgtgcccccacatgagttgggcatttcaagatgaacacacatgcaaccattagagacaacatcaaccctgtgttatccaagggatgctgaagtcattttgatcaggtggcagaagtgactggggacatctctttcaaggagcatcagtctatggtattacccgggcaggcttctgaatgaggtatgacttgtcatgggtctgaaagactggtcagattcacagaggcagccacttttctctcatccactgctttagtttgaataaacaagctggtaaggtgtggttgctcatgcttgtaatcccagcactttgggaggccaaggtgggaagatcacttgagctcaggagttcaagaccagcttgggcaacacagtgagaccccatctatacaaaaatagaaagattagccaggcataggggcacgtgcctgtagccctcgctactctggaggctgtggtgggaggatgacttgatcctgagaggcagaggttgcagtgagtcaagatggcaccactgcactccagtccctgtctccaaaaaacaaaacaaaacaaaacaaaacaaaacaaaaactggctgctcatgcttccattgctaggattcacctttgtatccctaacatccatcaatgtcatacttatagtagatggcccagttaattaacctcttgaagctctgggttaataacatacctgcctatagggttgttttgagatttaaatgaattaatgctcatcatggccaggcatggtggctcatgcctgtaatcccagcactttgggagggcaaggtgggtggctcacttgaggccaggagttcaagaccagcctggccaatgtggcaaaaccctgtgtctactgaaaacacaaaaattagccgggcatggtggcacatgcctataatcccagctactctgaaggctgaggcacaaaaatcacttgaacctgggaagttgcagtgagcagagatcctgccactgcactgcagtctgtgtgacagagataaactctaagtaaaataaaataaaataaataaatattatttattttacttatttatttataatactattttactattatttatttaaaatgttatctgccatatagtaaatgttacaaaacatgaactattattattattgtcattatggacttcacaaatgttaggcaagtgttgacttatcacggtacctggcgtatagtaggttctaactaaatatcatctcccagtgcctagcacggtaccttatcgacagtctttttcatctctgcagaattaacaaatgaataaataggtcacttgtttaatccttgtcctccaaagagaaagatgtcagtacagatcagcaccaagaaatgtgatgagtcgcatacatgtgtgtgaatcaagaacaataatgagagtaaattaagtctgtctgtggctcctcagagtgatactttttgatccaggccttgggggatgagaagtccatgagacacagaagcagagataaggttcatgatggagggaacagcaggatgcctctcccaggggaaccttcggctaatccttgattgtattagtcagggctctccagtgaaacagagtcaataggaaatatatatatcaatatatctaatacagatatatatcggtatctatatattgatacatctatctatctatctatctctagagagatttattaggaagaattggctcatttgattacagaggctgggaagtcccactgcctgccaccagcaagctggagacccaggaaagctggtggtgtttgagtctgagggccagagagtcatagagccaatgtcaaccccagtccaaggataggagaatgacaagagatgcccagttcaagccggcaggaaagaagcaaaagggacaaacgcctctgtcctctgttttattgttctcttcagaccctcaaaggactggatgatgcccactcccacaaaggagggtagtctactgaattcactgattcaaatgccattctcatccagagactctcccagacacacccagaaatcacactggatctgggcaccctctggcacagtccgcataaaatgaaccatcccactagtggcgcagcccagcttccatatttataagataggaattccattcataccgaagagaagacatttgtcctgaggtcttggccttcctaaagcccatgaacctctttcttttaccatggtactggtttggttttcagttgggctggggttttacttctcttgagtgtgagtcttttatttatggcaagcaaaagggtgactgtaggtcacagcctctccccagggctccctgtggaaattagagaggaaggagcccatggaggctgaaacccccgagtccattaaattaatagcgatttcttctctccctgtgtagcatctcccccaacctggagcttgaagctctgttcaaacgacattttactcaggtggaattttatcagggttccgtcctcaatccacatgatcttgcaagagtcaaggtaaggaggaagaggtgacttctgcttttattccatcttggtgtgggtctggggggagtcctgactctgtgctgaggggacacacctcctaggttggccacgagtcatctcctaaacacctaatgagatcaatcacataccagcaaccttgaggtcacccttccactggtcccaggacctccttctgctggcatatgcaacactacctataaccatcccacacttggactggtcataacatgaaacttgctttgctggattcctcaaaatcagctactcatcaaggaagtagaccagttatatggacccagtagctttatacaacataataatcaagtaattcctatattgaacacttaagttggactcaatatagctctgacttctattatttacatctgaaagaaacattaggctaaaatataaaataaaattttactaagcgataaaacatttgagctttcttttttccccatctaagacgcagggtgtaaaactaaacatgcagttatctgatatcattgataatgggcgaatctttttttccagaaactggtaatttagaatcttctcataaagcacacctgaggcttagaagggaaaggtacaaggcaaaatggcatctgctactttacctatgtaatatagattttgtaagcatgttcaatatttgcatgccagggggtgtacattaatataatgaattcactgaagtctaaatgctaactgtggtcaccgcataattttgtaaataatataattggccaagatgaataatccaaaaggatttggataaattctttctttatattattaaagaaatcagagatgatttgtgacataccacggaggatattatggcctccctcaaaatccaggaatgatctattaagtataacataccaagtaggacagattgcagacctgagccagcataagaattcttatgctcatagagtccagttaatcttgatattatccagacataactcaagttattgcttatgtaaaatcttatgagaacgtagggacaattgttattgttcgtggacctaatttaaatgcaagcaatcattagcacatcaaactcatggtcccctctaaggaataaacccctgtgggctcgtgtttggataagtcagtaggtatattttgagttcaactgtaacacattatttcatacatagatttgttgtcttctgaatatctgaatactaatcggatactaagcaatatggtgatgttatctgatttagagctctgatctcttcccagcctatagaaaatgaagatgtgaaaaaggtcagatgaaggacttcagagtgtacatttctgaatccccaatactcagttaccttgctaactggagagaagggatttaacccacccacctccaactcctgataggaagaattaggatgatggtgcagatggttgagaaaggaggtggggaggagactgaaaggcttaattaattgttatttaaagaaatctggaaatcctacaagtaagcaacgatgccaaatgaaaagtataattaccaaggtacatgttgtaccctccaacagcaacaagatgaaatgtttataccataacaagaacttggaacctacacttttgacaaaaactataatctctcaggctctcaggattgttttttttttttctttgcaaagcttccccaagaagctgtcaacagagagagactacactcgagcatggctatttatatgtttgtgttctgtgaattttcctttcggtgtcttagatagagtcagcagatgcatgcctgatccttgccaacaagtactgcgctgacccggatgcggaggatgcctcgaatatcatgaggtaactcttggggcgctgcggaaggccctgggcttggcagtctgtggctgttcacggcccttttggatcttctgcagaggactatctctatgaggcctttttgccccacaagccactgtacaactcaccagctgcataggcctgggggagccgaggctgtctgtgtgggttggggcagtggcacacagggtgtcaccaaccggaagctcaccctcagcaggtggcagctctagggcttacagctggccttgggtttgagattccttgagacagaactaggaaatagattgagatgggtgctggcctgaattaaagtaccatgttccctaaaggaaatgggcctgagatatcttaactaaaggcagatgcccccaggggacattttgcaatgtctggagatgtttttggttgtcacaactaggggaccgtgctgctggcatctgataggtagagcccagggacactgcgaacgaccctgcaatgcacaggtcagcccccaaaacagagaattgtctggcccagaatgttaatggtgtcgaggctgagaaaacccttactagggctttccaagtgtgtctacggcatattgattcctatcaccccaaaggggaatttagtgaccagttaggctgtttcatccagtttcccaaaattaatgttctttcttgaaaggcttttcagtgcttttaatactaatatgcatctctgagataacgtactatagaacactttccaaacctatttgactataagcctctgctcctctcccacctcccccaaccccccccctttttttttcatagagacagagtctcgcactatcgcccaggctggagtgcagggactcaatcatagctcactataaccttgaactcctgagcccaaacgatcctctcacctcagcctcccaagtagccgaggctataggaatgtgccaccacacatggccaatttttagatttttttttttagtagggacagggtcttgctatgttgcccaggctgatctcaacgaactcctaacctcaagtgatcctcccacctgggcatcccaaaactctggattacaggagtgtgccgctgtggccctgccctgccctgccctgccctcccttttttttttttttttttttttacagaacatctaggggaggtcatactgggaaacactgtgcagtgctttttgtgcacaagggttaggcctgtcaactgctaatattggccccaacaccagcaccttattcttttcttaattcagaaaaaaagcaattgttcagtttttgttccttgcataaacccagtagtcacattgtgtgacaatgaaatgactaaaaagtcaaggtattttgctccaggtagttagaggccctttggaatttgtcttttctgtagcataaattgcagaagagttaagagggctgagaggaaatgataaagggaagcttctggagagttgagctaaattcagtgggatttccgtcccactgcattcccaggaacttttacctaactgtgaacagccatctttcgggccaaaggttccccctctaccggtggcttggtttactgcctcctgggaacttacctgaggttgaaggtcaagaagttacctttacatcctgacaatgtttgcattgcctttgtctttgctttccatcagtggccccaagtgaccggagcttccccatcagtgaggtgggggaattcctccagtgcatttcagaggagccagtcctcccttaagcatctggtccttgtgtctggcaggcaacatctggcaccatcttctcttgccactcagttttctttggcaatatgcttagtgaggtcattttaaggaagtggatgcgtgaactcttctaagctttgggcttgccaggctgcagagagagggtggaacagattctggcttcacacctgggctcattcccgaatcagttacagctgcacagtggctacaccaggatcagggttgggtgtgtcacttgttcctttctttgaagtaggaaggattttcaacttttgacacctttttctgtcattggaaatgatttaaaaaaaaaaatgtaaccctttaaggaacctggcttcactgtcttcaaaattccaaatggaaaaccaaaagaagatgaagcttaatgttttgactccacagagatgtttggggctacctgagtaatagttttgaaatgggtgtttctcttaattgtagtattttatttaaaccctaactgtggtagggttaatatgaagacacataggtactagggtgactggcaggacaaggaggcatagaaattactggtcaagggcggggctcagtggcttacacctgtaatcccagaactttgggaggccaaggtgggcagatcacgaggtcaggagttcaagaccagcctgaccaacatggtgaaaccccgtatctactaaaaatacaaaacttagctgggtgtggtggtgtgtgcctgtaataccagttactcaggaggttgaggcaggggaatcgcttgaacccaggaggcggaggttgcagtgagccaagatcgcgccactgcactacagcctgggcaacagagccagcgaggctccgtcttaaaaaaaaaaaaaaaaaaaaaaaaaaaaaaaaaaagaaaagaaaaaaagaaattactggtcaaaggtagtatcagaaatgtaattaagtagagccagaactgaggccttggctgcaaaaagaagtgggaagttcagggttaaaaatgggctttgtctttctcttatttgtataatcctccttcctcctcagtttaatgagaccaatctgcctcctttgaaattaaaatgtcaaagatccatttgaaatgagctaatgcagaaaactggctgaagctgtgaactgcaaggcagggctgacagaggctcaaagtccttgagttataagcgtgggccaacgcaacactttttcaaaaataaaatgaaatccttcaagtgcaaaaacgcagggtgaatttgtgctgggagaggctttagcgtgatccatttcctaaattcgtacgttgcagcttttcagataaagctgctccctggctgccttctctccatttctgcactaaaaggggtgaagtggggagcgctgctgggtgggaagtttgtgggggtggtcataataaatgcacttgcatttctgattaggcttaggaggtgggcctttctgtggaattccattctttagccttccttgtcacagaaggaaatgtacaatgtcacttctgacagacttggtaatgacaaaaaccataacttacacgtggagagaacttttaatgatttcaaagcattttcacatctggtctcccatttgctgctcataccaagcctgtgaagtaaataaagcaggtactgttgctcccagtgtccagatgaggaaacaggaacagagagcccagggttttcctaaaggtcgcgcagttcattagtacaatagctgtgactggaacccacgtgtttccattcatctgcgctctgcccctccctttagcaccataattgatgtggggaggacacgtgaggcctggggtgggtgcaggccatgcttaacattgagtttggactgagggcaggtaggagacaattttccaccagatcatgacccccgcaatgccttggcacttatttttaaccagcgtttaagtcatcattttctctattagctatggaaggctgagtccttgatctcatcctaaaagccctgcttagaaatcattttttgtgatagtggccaagcatgtgtcacaattagaaccatttgtcatcctgcttgtttgatttgtcattgttgtctcaagttgttaacttggagaattggactcagcagattgtttctgggctagtccctagggtgtgggagattgcaaacctctggaggccccatgatttgggctcgctttcgatgtctacgtaggcaataagctggcagcccctgctccaggccccctactccccagtacgcacatgcatacatcccatctccaatgcattccaaggggccctcaaatttttcatgcccaggacacagactgtggctgttttgtgattttgttttcacactagcaagaggtatggtggtgggaatactgtttaacctggcccagtgtctgcaacccctcaggatagccctggctgctggtcctgatgcaggataggtgagccccaaaatggggcttagcccatgaaggtttttagcttcccccagaaaagaattcaaaggcaagctgatggtagggcagaaggaaacagctttattgaagcagtagtattacagctctgtgactgctcctgcacagcggggctacaccatagagtagcagctctgggcaggctgtcgtatttatacctacttttaattgcatgcagattaaggggcagcttatgcaaaaatttctagggaaggggtagtaacttctgggtcaccgggtcattgccatagaaaggcaagtcccatgagcccagtgcagatagaagcaagttctttgagctttctttctcactgtccacccagacacttaggcaatcatattaaagggtttcctctttcatggccttctttgttcctcatggtggcttccccaaattgtatgtagtgagagatggaactgggactggaattcatccatgcattacaacttgctttcaggaaaggacctggtatgtgcctgtaaagttatgtcactatgaacatattccaagagatagttgatttcataattggacaacgggcttgaaatatgaagcatttcaatcccctatgatctagtaatagtaatgttctagggcctagaggttatagggaacctcctgggtgttgccatggcaatggtaaactgacagggcacactgctgggcttgtccagtgaaaagttgcttctgccccatccctgtttcagctagtcttcaattttgtctggtatctgagccctgcctctggaatcaagtcctgcctcctacctcagtcccatgggtaccccatttggagacagtaaaattgatctttttgtcagacaccatgcataaggcagacctgtctcagcattggttctttctttttcagagtaatctccataaagaactaccatccgaagataagaatcatcactcaaatgctgcagtatcacaacaaggtaggagtgcgagagcccgctccaggtctgaagacccatccacaggtccagcctcttcttcctcattatacaggctcacacacacacacacacacacacacacacacacacacacactctcacatgcccacatgtgcgcaactcaaagacctgggtaaagaggtgtgattgttaaaaatcttcctgggacatttctttctttctttctttttttttgggatggagtcttgctcttgttgcccaggctggagtgcaatggcatgatcttgactccccacaacctccacctcccaagttcaagcaattctcctgcctctgcctcttgagtagctgggattacaggcatgcgccaccatgccaggctgattttgtacttttagtagagatggggtttctgcatgttggtcaggatggtctcgaactcccaacctcaggtgatctgcccacctcggcctcccaaagtgctgggattacaggcatgagccaccacgcctctggcccatttctttagtccaaacaacgtgtttgcatttggtcactggaaggatgctccttcatgtactgattcattcattcgggaagtgtctattggaacccgaggttcagaactattgatttactcttggatcccatccatacttaagttacaacaacttttatttgtatgtgctgcagtcatttatttattcagtaaatatttattgaatacgtactgtgtgattagcactctccctgacacccacaggaatatcagtgaaggagaagccctattttgtgtcctcggggatttagcagttaaggtgtagaatgctccaggcaagtgagtgataggatttctctatctgagaccaggtgaactagtgagtgcataatgcgctctgtaagagtgtaatgtgggacacattcccagagtcgagatgagaatttgcagagttgaatcaggaaaatagtaagctatccagagattaaagagaaaggaattttccttgtgttatagcttacagtgggggattgattagaaagaagacaaaagtcagagtctatgctgtttccctgtgattacttctcagtaaaccagagtccagtgtctcattcaaaggcagtgctccttctctcggccagtcaataaacttccaaaaaaacagctttaggggagggaaggtggcacctttctccatttgatgcagtaccagttatgtccttaatgaaacctagaaaccggaggctgcccagtacctggagccaggtgtcctgtctgtacagaataactcgctgctgggttatgagtaacagcgtaccccctcttatgggccatattccctatgaaataggcagtcaggtgatgcagagaaaaaccccattctgccaaatgcaccagtgccatgccgttatttcttaattgctggcaagtgctggcccattttgctgtgtggaggcccatcagaggctgtcactgagtggagcctgctgtcagtgactggcccaccatccagaacggctgactgctgccagccactgcccagccctcggcaggtggctcccttgcagaacgtgttgttctccagccaacggatttggtggtgggcacccaaggtcacattcgcctgtttgtctctggaaaacccaaggacactgaagagataaagtgaggatattggtaatgtacgggtgtcaagctggagaagtttttgatggcagcccttgtaggtggaggtgaattttattagcaaggctgtgactagtgacagctcctgcagcaacgagctctccttctttcatttgtgatctgaaatttcatttagtgtgggagtgctttaagctgttgtttagatttttggctgaatttagattgaataggaaaattaatgttgtatgtttagaaggggttgtcagttccttttttttctctttccaatgagtgctgatgcagcatcttcaagaaattaaggaggattttagctgtggttattgtccaactcaaagcagctcagccggcctgggatccagacagtccctggtcagtaatcacatgatcatagcaacctgaatgtgtttggcaaacctctgtgttgtaattattcagaaacagtgaggaagatatcaaccaattcatgattatttgcttaaaacacattttgtttagaaccatcccaaactattcgagttttggggttgggcagaatcacttacagatccttggatgattagtcaggacacagggaatagagtgactttgacacagggcattttgttgttgttgttctttcatatctctcttctagagaaagaagaaaacgtccactcatcattgtttgtctttcattccttgtagaattgcaaatggacattcttcaccttgcttcacagttttgctgtgtttcctgagatgtttcctactctttcaatacattttcttcctcttccctttcaacattttttttctgcctttcttggcactttttgctgcactcatcctagatgcttagagatctccatgcattacaatttgctttcaggaaaggacctggtatgtgcctgtaaagtcatgtcactatgaacatattccaagagatagctgatttcataattggacaacgggcttgaaatatgaagcatttcaatcccctatgatccagtaatagtaatattctagggcctagagggatgtagggaagctgcctactttctctccatgtaaaactggccctgagtttgtcatcatcataattgtagacatgtgtgtcatattttatggttttaaaagagctttgacatccattatcttctttagtactcgttggaccatctgtgcattttagcatcccagggtaacttcagagcagggcatctaagctctgtatagacagcgcagctctgctgggcacaaatcatggccaccactctgcagccagcgagcggggagacagaagagcttactgccaccgactctttaaatggagccacagcccattgaaccaaactgtggttcccgagagtaggcattatagaagggctgatgctctccaaagtgtatcttttaatatcactagaattcttggagagaaacgctttcatgctggccatcttttaaatgctggccctgcatcttctgatttgagtgtaaatggctcaaagctcttcaaggaaagattggtttataacttcttggaaaagtatcactcctgatgatttacctctcagtggattttttatttttcccaaagactctagtgaaagaggcctttatctctggaagccaagtcccatgagcccagtgcagatagaggcaagttctttgagctttttttttccactgtccaccctgacacttgggcaattgtattaaatcgtttcctctttcatggccttctttgttcctcatagtggcttcccaaaattgtatgtagtgagagatggaactaggactgaaatccatctctcctggttttccaggacagcgtatttccagttccttctccatgagaggagggaggggtggtgaagtagcagaaatgaagggcagccaggtctgccagacctgctctttatattctccaagttagggagagaggatttgcctccagacttctgggcactaacactggcatttttcatcagactcaatttacttcaaatggaaaaggacgaagtttccagaaacaaaggatttatgttcctgggtcagtctcttctctttgtttcatgcacagagatttccctccaagcattcagcaggtcaccctcactccttccctgcgttggagaaaatataatatccaaaaaaagagggcacagaaccctgagataaggaacaaactcaacttttctatataatcacatggccaagtgtcaaggtggacagtgagaaagaaagctcaaaatatgcctacagaactcaaaccagacagggccatgggggacccaaggatgaaatgcctcagccttataccttagatagcacatgcggataggagagactttctctgaaaggttttgcttgtttgtttgaaggtgccatgaaggttcagagctgtctctttagggcttggaccaaaaaaatctcctttcacacacaatgcttgacttgttcattacttaaactgaatttctcctcattcctctcaggttctcagatgatattactgcaagtgagtatttctccagttataccaatgtgttctctacgatgcccaggaagtaaaagggaaagtggccatctgaagccactggagagtagggagaggaaggaataaagggtagggctagttgttggaattgagtctgcagtgtggggaaggtcctttgatagtttgacagcaattaccacttgctgtggcccctccatgagactatttaaccatgctctcatcagggagggcactgtcatctctccctggagtacccacttttggcttaggatgcacaagattgtcacagaagcggattttgcaagaaggaatttcacaagaatagtatttttgaaagcagagtgtggaacccttggacttgctctttgttttcacaatggagtcttccatccttctagttcaactattgtatattgttctgaaagtgaagggaatgctcccttggtgctccttgtgtttgctgagatgtgcagagaaataataacttcaaagccatagaatcttggcactagcagagacttagaagggctctctgattcaacctcctagtgcagagcaaaagttctttccatagtaacttggagaaatacttactgagtcttagggacaaagacctttcattttttaaggtaaccttctccgtttggtagacaaattacatccttaggaagttcatttataaaacaagacaaaaatctgctttcttggaatatataccagtcagtcttaattctggcttctagaacaaagcaggacaaacctaatcttgtacacagcagcacctgaagtattcagatgtaaccatcctgtctctgtgaggacgagagccttcttcaggccaaatattactggctgtcttaactgttcctcaaaagatcttttccagacgctacctcctcttgtctttgtcacttttctctggaagttattcagttgatcattttccctctttaaatctgactgaaaactggatcaagtactctggaactagtctgaccaattcacaacagaatgaaatgttcatttcccttgatctggggagcacttctaaaaagtaaacactggctttctctgtaatgtcacatggctagcctaaaatttgaggttttagttacccacacacttaaatttagctttgtgtgttttgttttcttttatttctctcctgcctgctgccaagctaggtcttctcattttgaatttatatagttgattttttttagcctaaatgctgtacttgacatgaaagccttgtaaatctttttagtttggtcttttgccgatttttccaactctggagaaccttttgaactttgattctttcatccaatgtattttctatgactctctgcttcatgccacttaaaaataattggatgagcatgcctctgggttcttgtctcagggcctgacataagggttgaataggaccagtccatttgcaagagattggaaacgtcgacactgtgatttacctgatgttttaggccagtggttctcaaagtgtggcccctagatcaacagcgtcagcgtcacctccaacttgtgagaaatgccaaattctccagccttaccccagatctactgaatcagaaatgctggtggggggccagcaatctgtgttttcagaaactgtacaggtgattctgatgcccgctcctgatgcctgggagtcactgatctggagtattggaaaggcaggtaaaaaagaaactgaaaatatacaggcatttggcactcctacggtctattagaggactcaacttaatgatttagctagacatcctagtaacccaggctgttgggtctgtcacaagaggaaattccctctgggctctatttggctaaatgacaaacccaggggaggacttgggcttggtgggtgcagaagcaacagtccagagagactgaagtgtgatgagcagaagagttgcataaaacagcaaacatcagaccgcagcaagggaaaagaagggcaagactggatggccctgagtggttgggcaatgctgcatttcccagaagaaatgttaaacaattgaacatttaacagagcaaggtctcatacctgcttttctttccccaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtaacgtctcgtcttattagagcacattagctcgggattccatttgtcgtggggttgagtagagagcacagcttaaactcaaaacagatcgacgggctctaaccacttgggttaaggagaaattccttgttacggatttgggcatgaagccaacttctttcaaaattatgtttttatttttatttggcacatccacggccattaaatgattgttcaaagcacaatcccctctttttttagataaaccacatgtttatctatcaacaaagcctccgctgttaaaacaaaaatatgatttatatacattccatatggcaacagagcgcctaaagaaaagaattatcattttgctcttttatatcaagtggctggtggacctctcactgtgtggataaatgcagaccatgtgtttgtgctgaagcccaaaccccaacagcataattcatttatttatttctgcacaatcaaggaggccagcaggactgacatgccgcggttgtttgaatggagagcgaaacaatgtactgagtcctcggcagcagtgccctttgcaccgagagacaggcggtctggatgtgttcatgtccttgtcagagctggctggacagacactccagagtccccaaggtggccatacctgctgcaccagtgcaggcaaggagagaaaaaaaaccgactctgtcctcccagggtgggccaggttaggattgtgtttccagagccttgcattgatcgcccagccactagcaagggggcttctggagcctgggataacagtcactccagtcctcatccttagactgttcttagattaggcagtcaaggtgacaaacccgtgtgtaaaacgggtctagcttgagcctttctgttatggcatgggaggcagttagctctggatctgggcttacatcttgcctcttactatgtaaggagcagaattaatagctggcaaggtgggaaattacatccttagaaagttcatgagtcagcacgaggtccataaaggaggctggaagctctgcaatcaaaggtatgagacctcctgccttttgctgtcatgtggctacctaattgactgccaagttccttgatggttttgaggaaatggcctaggttgcaataagagggatgggtgggaagcatgaggatacagatgcattggtgctcaccttgggcacctatgagtgatattatttagagcaggagtttttctaagtccttatccttcgtacctgccaaatcggcattatgtagccaactgatagttaacattgctccacataaaggaacaaattgctttggagctccttcaatcactttagcaacactgatagcaagggataccttgatttaaaaaatcctcctatgctcattatgcagccaaaggtctcagctcagcagaactctgagctcagatccagcttacaaataaagatgttgcattcctttaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaaatggatgtgatgctgattcttcagtgctattagcagcagggaaaacctctgcccaaccttcctccagaccctgatgggcctcacctctaaagccaaggatgtccgctccagctcagctaatcccattgccaagttcctatttaggaagagcttgtgggaaaggctgggcctggccctggtgtaactgaaaacacattttcctctgggggttatgttaccacattatttctgtataaggccaattcccgcctgtttggaagtagctctctgaatatgaccttttgacactgagatggtctttgtgttggaattggctaaggtacatgacctggaaatcacaagccttcccctcatatatttttctcagctaaaatagagatgccttattcacatgctccccattctacattgctatctttgtgtacttacctccaaatcccagatcttcgtctcctttaggtcatggtgaacaccataatggcaccctccttggcatgttttatgtattatctcccattccagggatcacaaagccctcacttacttttgttgggggtggggggtaggtggaaaagtaaacctacaaatggattattgtttacagaaattgcttccttctccaatgacctccgtatcctatgacggagaattcatcaatatttccatggggacaagcaggcctattaggatggacaaagaaggggtgaggctttggcagcacttgatcctttgggaacaattagcatttctggaagccaaggtaaagtgttagctcaccctctcccttcccctaggccggtcgtgtctgttttttggtgcggcagaacccctgttaaaataagagaaacaagactgtaacagcaaagatgtggcacaggcagaagcacagtgactatccactgggctttttaattttattttaattttttgtagagaccagtctccctgtgttgtctaggttggtctcaaactcctgggttcaagcaatcctcctgcctcagcctcccaaagtgctgggattatataggtgtgagccacttccactgggcattttatcatgcatgagaccaaaatgccaagactgaaagtgggggtgatatgtttaataaaagaaagagggattactggccaggtgtgttggcccacacctgtaatataagcactttgggaggccaaggcaggtggatcacctgaggtcaggagttcgagaccagcctggccaacatggtgaaatcccttttctactaaaaatacaaaaattagctgggcctggtggcgcatgcctgtagtcccagctactcaagaagctgaagccggggaattgcttgaacccaggaggcggaggtcgcagtgagccaagatcatgccattgcactccagcctgggcaacagagaaagaagaccccgtctccaaaaaagaaagaaaaagaaagagggactactggcatacaggaattacaaaagaggcccagcctggaggtaccaagaaatatggagcaatgcttctttatctctccatcaatgccactctcaaagataccaaccttaggaccctaagtctttgtccctgaaaacctcactcctatgtggatatatctctgaattgatctaaactttttaggaatcttttttatattttatatacccccatatctttgggggtaatgaatttcttaactttgctaactactgctaaatattttttttctggctatttgtccttaatttactccatttaaacttcaaggcatgccctctacagcttctgcagtgctaggatttaacaaatcttatgctaattttatatctaatacctttaggaaagagactcaagctggcaatccagggatcctccagctcagcagctgctgttaaggacaggttaagcattttgtgcaataggatcttatttgaacccttgagttcctttaaggagttcgcacgaacatcctggtgcctgtgacttatctgcattcacatcatcagccagccctggaacatgctgttcatttgccactgtctgatctcctactcctagcctgtcaggttctagtgagactctccctgctgtcttctgtaaagacccaggcaatgaacttacttagcctatctgctattgcctcagccctgaataagtggccacacttactctctacttggcttcctcacttggatgtaatttaagatccattgatttgtttttgtttttgtttttgagtcttactatgcatacttagcttctcttcagcgtatgaggtttcaagttggggcatggcctgccatcttcatgaattgtgctatcattcttactaggattagctgtctttgcacatgacaaattgtgtgtgtgtgtgtgtgtgtgtgtgtgtttagagggtgattaactcttaaaattgtttttcaatgtacattgggacttccaatgtagcacatttaaatagttctcagaattgccaactatttgaagtctgttaatctatcattttatacacacacacacacacacacacacacacacacacacacacacacaaaacctggaacacagtatgctctccatgattatttctttgttgaataaatcagttttgagaatgaagaaaatatgttatgtatttctagtgttgtttttttttccctatgccgcaagatttggaatttgcgggtgaaatgttacttaatatcgataacaatacacgcttctctgtcatgttttctgtttctgaatgagaatgcactagagaaatcagaagcatgctattcagattgtatcttggctgaagtggatatggctggacacacaaagtttttgtcctagcactaaccatagccaagggaatcatttaaatatttttagtctgggttatgtttatgtgtatatgtgtgcttgtacatatgtatgtatagaattagtctggtttagcagctaaaaatgtaaatcaaggacttttaataatagctaaaaaatactgattcccatgtgctaaatcccgtattaagtgctttagctgcaatatcacatttaattctcacaatgaccatacccaaacttgtcactattattatcctccttttacagtggcaggcactatgggttaagagaatttcaacaacctgcatgcggatgtgtgatttggaattcacaaactcaggtgttcaaacccaagcaaactggttccaggtttgcccttgagtatactgaaaggaaatgtgagaaacgataagggaaaactttagctagtgccatcatcttagcacaaatcttagctttctatagttcattctatgtgaactattgatgcaatagagatgccctggggacctaccatgttccagacagtgcgctaatcccatcagcatccttaggtctaggaagctctggtaagcttcagaaagcttctgttctgacttggatgtatgggcacatgtttgcatagctccattctgtgcatcttctttacctttctgtctgcccagctctgcaaaagcagaggccactgcatcataacagttaccctaggctgggctgagtcagggtaaggaatgaactaggctcccaagaagggattgacacacactgctgttttgaggaggtgaaactaattggagtctaaaccaagtggagctgaagggctggggatgacttaggtaggtgcttctgggacaaagtaagtatattagggttctctacagaaacagagcaatggtgtctctctgtgtgtgtgtgcacacacatgcgtgagagagagagagagagatgttgattataaagaattggcccacagggttatagtggctgggaaatcccaagctctataaactggagacccaggaaagaagatggtatagtctctgtctgagtctgaaaatctgagaaccagcaaagtcaatggtataagtctagatctgaaggcaggaggagactgatgtcccagcttaagactgaccatcaggcagagggaggaaattctcccttactcctcctttttattctattcaggccttcagtgggttagatgaagcccacccacatgggttgggttgagggttgttgggggagcaatctgctttactcactccacaaattcaaatgttaatctcatgcagaaacaccctccaccctcaaagacacacccagaataatgtttagccaaatatctgggtacactgtgacccagtcaagttaacattaatcatcacagcaagcaattcttattgtctggtgggtgtaagctctgctaaccaggttgaaggaggcataccagaagcagaactcaaccttgcgtggcagggttggagttgacaagagctctgaaatggggccagggctgcaactgataaggctgggattgaggtggctctctacttaggaaagaacaactagtggtaccagagtagagagtttgtctggcaaagtaaacccacatggtggaaattagatagggagatgcaagatgttgcttactctattacccatggacaatgtcaccctaaccacagatggcattatgacagcagacttctgcacatattcctcaccagtggagagcagctcccaatacaattatactcacttccttgataatctcaattattctcattgcttttagatacatagatgacttccatatttatatttccatgaagaacctctcccctgaacccggcgtcaccgattcaactgctgctcaacacctacatttgaataccccatctcctctcagacttaccattccacaatcgaattccttttctttgtccacaaacctgttctttgctcattttactattggcaatgccatccttcccatggctgaaactaaaaactctggagtcacccttgactcatttttaaaaatttatttatttgccctcaaacaccacattcaatacagcaggaaatcctcttggttcaagtttcaaaatattcccagaatcggagcacttctcaccacctgcactcctactactagctccaaaccaccatcatgtctctcctagaatattacaccagcctcctaactggtctgtctgctctgcccttaccaccccacctccaatctatcttcaacaaagcatccagaacaaccttctcaagcatgaatcagatcctgtcactcttctgcataagtctctccatggggtcccatctcatctgaataaagtccctacaatggcctgcaggtcctaagcagtcaggtccctggaacctcattggcttaagtcctgagtgttctcctgcttcttatgttagccacactcccttgggctggtctagggatttttacttcttgttccctctggctggatattccttccctgagcagctgcttggctcccctctgtccaactcttgttgtctttgcttaatattaatttctcagttgagtctttcctctaaggcattagaactgcatttttaaaagggattaaaaatgaattttttattgaaatataataaaagtgtgcatgtaataaatgtacaacctgttaaatacttataccctcagtgctcatgtaaccaggacctagattaacaaagagtacattacaaatatcccagaaccccctgtttttttttaaataagtcaggtgatactacatgatcgggtctgtttctggattctcttgggagaattgacatctccacaatactgagttctccaatctatgaatatggtatatttcttataaagggatactttatgattcaacaacttccctggcaaatacaggaaaatcaggaagaaagtaactaagctcatacaagttctctggggcttgtgagggtctctagagagagtagatgtcccacttcatattctctaggaagtatacagctgttcttctcagcttcattgggggatgaagtttccatgtggaaaaaacagaattgcattttaggaatctgcaccccctccccctccacacaccatacatccacatccttatttactctcttggctttgttttttcccgtggcactctttggtgtttattgcctcttttccctgggacaaggtgagcactgtgaagatggggctacttgctgaatcctcagtgcctagaacagcgcctgactcataatagctactcaatacgtgtttgtggagtaaatgaatgcatcggttggcctcagcctagcctgaccagcctgtattacagacagctgggtgggaccaggaccagcggggacttgtaatttggtgtgattttggtgcagaaaacttctttctttgctactgtatatgattcccttgccaaattaaagagctttgattcaatgtagaaacatgaaatgcaaagctctttaatccttggcaaggattgtgcagaggctggttagatttggttataaagctcttcaactgccagaaaatccagtcagtgtgttgtttaagttcacaaatcaaaataaacacccatgaattgaaatgaatttgctaaaccccagtatcctatttgggtcaacgtcactgtgtacccgcttttcaccctacttagatcccattagatcagaggcttccatgcaggatgctgcctcccgcagtgccactcagtctgaccaagcccactaatgcccacctgaaagtagagtaacttctgtgaaaactatttctaataaagagagaagtaatccatgagctattaacagggattcatttcccctatggccctggtaatttctagaacattgaattaaagcgttctcagacctttacaaattctcaaggcaaacattattagcaaaaagaagcccatacagcatgttagaagatagattgccagaaaatgtcaacggatcttctgaataaaataaaagaagttgaaactcctttccccatcttcttcccttctccctccttcccccaacatgattagaaagtcatttcatgtgtcttatatgtttggtgaatcaaaagcaaatgtacatgattgatggtgacagggaacacatttaactcattattctttactttgcagcaaaatgatttgtgtaaactgtctgcctagcattaaaggtaaagcaaacttagaaaccccaaaatgttatattttcatctaatattttcctcttggttttatagctgtaatcacatatggattcttttatatgggtcttggcatggactgaacaaagagaaaggcagcacagaaagattacataacatatacacagagtccggtgcccagcgaggatggagcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaactttttgactttggttttttgagtgccatccactgttagtgattgttacatgaaaatcgcaaagtcctatgtaagccataaggaataaaatatcagatttccttaagtctattggttgtcgttgccctaaggtgattttaagtgtgaatctgtgtccagaacaatgatgaggaatttggaactttgaggcaactattctacacatctaggggtgcaaaacaaggaagcaccattgatttgataccgtgggtattctgttaagaactttggaattatagtaatactttacgtttgcacagcacttttcagtttacgtgatataccttttttttttgagacggagatttcgctgtctcacccaggctggagtgcggtggtgcagtctcggctcactgcaacctccgcccacctctcccccagcaacccagccgctgcagcccccaggttcaagtgattctgctgcctcagtctcccaagtagctgggactgcaggcacgagccaccacacccggctaatttttgtatttttagtagagacggggtttcaccatgttgcccaggctggtctcaaactcctgacctcaagtgatgtgcccacctcagcctcccaaagtgctgggattacagcatgagccaccgtgcctggctgagatatacattttcacttaaattctttatttgaccagatacacaaggaaaccagatacatatggaaaacatgccaaatgcaaagaacctaatgtctctgacctttcttcagttgtagaatagtaagccacaggacccatcaccatagctctttgggaggaggaaatcggaagatgacttctggttgcatggctggttggggaatggtagagctagggccagaacgctacaacatcattggcttctcagctcagcgctttccccactgttacacattgcttctccaagagaaatgtcttgaatgtaaacactgctttgttttatattcaaatcaatagcttctaagaatagaaaccactttgcaacatttgtaaaatgagcttatcctaggtttcccctcaaccatgaaaaactataaaaattaagctcttttccaaggtaggagatacatatgtctgccccattcccttggtggtagcttagtctggaaaagacccaggcaagtgctgtcttgtctagaccataatgccttgtagtgggaggatgtattgctcaagccaagggacgcaactgagtacagaagggagatgatgactggtttgttgagggacatgtaagaaagctataaagtttagtctcaaccatttgaaagaaggaagcagtaggttacagtgcagtatgatagacttcccatgtgtgaaatgtgtctgtaaaggggagtgagatccggacgggttaggtagtgctaataagatgaagaaagaaaagtatcttggagaaaaaaatatagttaatcctaatgtttacagacaccttctgatcataacaaaaatattcaagtaactcaagcaattcgagtggaggtgttggggctttggattgataagtcctcaaggttattagcagagtaatccatttgcattataggaaaatgctgaaggtacatgattccagtaagatttggaaatgattatagttttccagaagtgtttttcattttattttttaaattaacatacagtaaagttgattttgtgtatgtgtagtcatgcaaccaccaccacaatcaggatacaggatagtttccatacccccaaattccctcatgctgtacagtcacaccctcctgtcactcctaggccctggcaaccactgatctattctctgtcattacagttttgtcttttcaagtctgtcatgtaaaggcatcatggagcatgtaaccttttgagattggcttttttcatttagcatagttcccttgacatccatccaggttgttgcatgtatcagtattccatcctttctgttgatgaatagtatgacatcttatatgcaggtaccagtttgtttatccattcatccattggacaccatttagttttcctccagttggggcgatcatgaatacagtcgatataaacatttacatggaagtttgtgtggatataagttttaatttctctagggtaagtatctcgaattaggattgctggattatagggtaagtttatatttaactttaaaagaaactgccaaagtgttttccagaaggactgtaccatttatcattcccatcagcaagcaatgcaggagtttctgtagctccgcatccttatcatcacttggcattgtcaatactttttattttaaacagtctagtaggtgggcagtgtggtatctcattgtggttttcacgtgtatttccctactgatgttgaacaccttcccagtggttatttgtcatctgtatatgctttttggtgaagtgctgggtccattttaattgagttgtttctttgaatttgttttttactgtttaagaattctttatatattttggatctcgttggatatacaatttgtaaatatttgcccctaatctgtagcttgtgttttcattttcttaacttaaactttctttcctggaaagaagtttttaagttgaaatatttggagtttttcttaaaaggttaaacattgagttaccatatgactcagaaataccactcctagatatctacccaagataaatgaaactctatgtattagtttcctatggctactgcaataaattactacaaacctagttgctgtaaatatcacaagtttttttccttccttttctggaggccaaaacttggaaactgagtttcagtggagttagagtcaacatggtggcggggctggttccttctgggggctctagaggagaatctgtttccttgcattttctagcttctggaggctgaccacattccttggctcttgtccctgtcatcgcatcactccaacattgtgcttccattgtcacatctcctatttcttcttctttagccaaacctcctctaaaaagacaatagagattacatttagagcccacttagataaccttcctatcacaagatcgttaatcacttctgcaaaaatctacattcatcccacatgcaaaatacattcacctcattcccccatccccaaaagtctcaaccctgcaaaacaattcaagtccaaaatcagagctgaagatcagcaactcacatgtcccaatgtcatcatctaatcagttatgggtgagactttgggtgtgatcaatcctgggacaaaattcttctccatttttggatctgtgaaactagaaaacaagtactctgcaccccaaatgcaatggcaggacagccataggataatggctatagacagtgccattccaaaagggagaatatggaaggatgaaaggaggtaccggaaccaaacaacttcagattccaatatggcaaactccattgagcttcaaggtctaggaacaatcttctgttgcttaaaatgggcattacaaagtttgagtcctccaaatgtattctttttcaaaattgctttggctattctagtgtccttgtctttccatatatactttaaaatcagcttgcctatacctaaaaaaaattcctcctgtgttttgattggaattgtattaaacctatagaccaatttgggggagcactgacatctttactatgtcgtatcttccagtccatcaatttggtctcttcatttatttaggtcatctttaacttgttttacccagtgttttatagttttcagcatcaagattctgtacatgttttgttagatttatatgtaagttttacatttttggagctattataaatgacatcttaaaaaaattgggttccaattgttcattggtggtatgtagaaatatacattatgtttctgtattgaccttgtacctggcaatcatattgtaccggctagcacttcttgcagaatattgaatagagggagtgggagtagacatcttttctttgtcacctgtcttcaagggaaaacattcatttctttcaccattaagtatgatatgaactatagatgttttgtagatacctttcttttgaggttgagggagttccttcccatttctattttggtgagagttttatttttttcaatcatgaatggaggttgaattttgctaaatgctttcctgcatcaatgtataggatcatgtagtttttcttctttagactgttaatatggtaaattacattgaatgattatacaatattgaaccagccaccatacattcctgggagagaccctagttagtgtgattatttcttatacatgttggtggatttggtttgttaatatttttatgaagaatttgtgtgtgtttgttttttggtgtatattagtttgtacgtttcttagactgtctttgattttagtgtcaggtaatgttggctttataaaatgagttggaaatctttcccttccttctgttttctgggagaaattgtgtagaattggtgatttttttttctttaaatatttagtagtatttggcagtgaaatactactaggtttgggcctagatttttttcttttctgaaagtttttaaatacaaattcaatgtcttcaatggttataggactattcaggttaaatagttaatcttgggtgagttgtgacaattcaaagtttttgaaaaattggtctaatttatctgagtttttcaatttatgtatgtagagttattcatagtatcccattattgtccttttaatgtgggcagtgataaccactctttcattcttgattttgttatttgtgtcttctctcttatttgtcactcttactagatataaagtttgctgatctttgttaaataatcggctttggttttattatttcctgtattttttgtttgtttgtttcctttctgcttgctttagatttactgtgctcctcttctctagtttcttcttaagatgaagcttagattttggatttgagactcttcttttttggtgtaaacattttgtgctatatatttcttcctggtccctgctttagctgcattccacaaattttgatatgttgtgttttcatttttgttcagttaacaatattttctaatttcacatgaaacttctttgatccatgaattatttagaagtgtgttgcctaatttccaagtatttgaagatattcctcttatctttctattattgatttgtagtctgattccattatggttaagaacctacttggcatgatttcaattcttttaaatttgttaaggtgcattttatggcccagaatgtaatctgtcttggtgaatgttccaggtgagcttaaaaagaatgtatattctgctattgttgggcagagtgttctataaatgtcaattattactagtcggctaatggtgttgttcatttcttctatacccttgctgatttcctgtctgctagttctgcatcttactacgagaaggatgctgaagtctccaattataactgtggatttgtctactttagttccgtcaggttttgctttgtgtgtgtttgaaagtctgttaagtgcatatactttagattgttacgttttcttggtgaattgacctttttatcattatatattatccctatatccttgtaattttctttgttctgaagtctactttatctgatattaatatagccactcaagctttcttttttgattggtgttttcatggaaaaaagtatatcttttctcctcttttttgtttgaaccaaacctatctttaaaacttaagtgatcttcttatagacagtttatagtcgggtgattttttaaaaatcgattctttgaatctctctttcttaattggttgcattagacaatttatctataatattattatttatatgtttggatttaggcctaatattttatttgctttctgtttgtttcctgtttcagttttgaaaattagactaatttttcaaaaactttgaactctcttctttcttcttttgaatcattttgaacattttcagaattttttttggtctgtggtatttcttatacttctttatatagtttttaaaaaattgattgctcatgggtttgtaatgtacatacttaactttttaagtctacttggattccatgatttgcctctttaagtgaaatgtagaacccttaccaaactataggtttctttaccctccccattttatgttatagttgtattatgtattacagctgttgcaaactatatcagacaatgttataatttttgcttttatctattttaaagaattcaagagaagtatagtctattatattattctaatatttattaatgttgttgttttctctttgtttccttccttttagtatcattcctgttctgtttgtccaacttatgttagcagttccttcagagccatgctctggcaacaaacactgttttctgtcatctgaaaatatctttatttcactttcattacttagggacattttggtggatatagaattcagggttcaacattttaaaagtgttgttctactttcttcttgcctccattgtttctgatgagaaatccatagtcatttgaattgtggttacctataagtaatgagtcatttttctccgattgccttctagattttctctttgtctttagttttctgttgtttgcttacaatgtgtctaggcattattcttttgggtttatcctgttggagttcattgagattcttcaactgctaggtttgtctctggggaagttaaagaagttttcacttattgtttcctcaaaaaaatttttttttcctgcaccatattatttctgctttccttctaggattcctatgatgcaaatgctaaatctttttctgatgtatcagaggaccctgaggctctgtgtgaaacttttcaatacttttttctctctgttgttcaaattgcacaatttatattgacctagcttcaagttcattgactcttccctccatcatctttgctctgctgttgagcccattcagtgaatgttttagttattgtattttttaattgtagtatttccatttgatttttaaaattttgatttttaaattatgcatcccgtcttttacttctttacaaatgtgttctttcttagttatcgggaaatagtagttgctttaaggtttttgtcagattattccaacatctgtgtcatctaggcattggcatctgctgattgtctttttccatgcaagttgagattttcctggttactcttatggcaagtaattttttattgtgtcttggatattttaatttttttattatgaaactctgattcttgtttaaattttgtaagaatgttgataattttattttggaaggtaatgacctgctttattttattttactttattattattattgttattattattattatttgagatggagtctcactctgtcacccaagctggagtgcagtggtgcaatctcagctcactacaacttctgccttctgggttcaagcaattttcctgcctcagcctcccaagtagctgggattacaggtgcccaccaccacgcctggctaatttttgtatttttagtagaaacagggttttgccatgttggccaggctggtcttgaactcttggcttcaggtgatccactcgccttggcttcccaaatactggaattacagacacgaggcactgcgcccggcctgattggcttgattttaggctacaggttcttatggggcttctatgggttgtgacttcaatgttagttgagttttcaaagcgttggcagtgctatttggatctgtccaatattgccctcagactgggtggtggtctatattgtagtttagttcttagaatctaaatgtgctgtgtagggtcagtttcatccatgcacagcttagcgtgagccccagagtttataaacaatttagtgactacttccccatgtcctctttctatgtgatctctgcaatattttcaggttccctggggtcttcctttttgatcttttgatggaagggctgctgaggctttagttatctggctttctgtatactttctgtgattgtgttcacatctggggccaactggtagaagggcagagagagacaaaaagcaatagggtttggttttcattctctcaggaccataggttttttgggcagagaggaaaattctcctatctcctttaatctttttctggcttgcattgtcaccactgctactgccactactagatggcttggtgttggggcacaggaggagagaaaaagaaaggaagaaaggaaagaagaaagagaggaaggaagagagggaggaaggaatggagggagggagggagggagggaaaaacagtgatttcctccattttttctaagagttacctcgcattagttagttctactatgaggcttctcctggaggttttttgtccacatcttgatgatcccttccaggttctggctgcctcgaggtcaggctagaggataccagaagagaacaatggtaaattcactgctgatttggtggtatttctaattcgggtcttcttcaatctacctgccattgtttattctcaatgtcttcaaatagctgctccatgcattctgtccaggtcttagaacatcattcagtgggaaagacaggatgaactgtgataactccatcttacccagaaccagtaactcagatatctctttagccgccatatgctatgtttgccctgtacagccagaatggggagaatattgcctttaagtcagggtcatcagcatcatggctttttagcatattcaataatcattctctgtggggcaagtttcaggtagttcacctattttttttttaatcagagcctatgaatactataattcagcaaactgcattacagtggcatcctgtgcgtctcctggtagaacaatgtgaggtggccgtttcaacttcaaactcatttggctgatttagagaaacttaggggcacctgtaacatgacactgagatcaatttaggcagccatctgccatcttgaagaatggcatgcaataaaacgtttgaactgagtgtaatttttgtggtttttatcattaactgccacatgtatttcatggtaacgagtgatgcagtcccagtgattagggtttcatgttcggagaaatacaggggtcctgtcttgatggctgtactctgtatacactggaggatgggaagtggatgtaactaattaatatctatgaataagagtcatcacttcctctcttttttccataccctgtaagtagatagggtatctctgcccactgagaagtaacatatatctctgtgcccactgatgctggtgtgcagaagctctttgttgtcagtctggctgtggaagtctgtttattcctggcccccatacctgtggcattgctttttagggtgatggattctatcctttctcctttttctagactgggacaaataggtatagtttcttaagaagcttctgttgatttcttgttttggctaaaatttggcaatgagaaggacatttctatctgtggttgagtattttttttctctttctccttaaataggctagagaggcaagaacaactgaaagaggaatatttgattccccttcagaatgggattgggtattccagtctaactaggattcaattttgatcatctgaagatctcagatagtatttccctgctataagtacccatggaccactatattatccaaaattgctaccacagccctcacccttcctgttatccctggtttgtgaagtgtgaggggggttgtgcggctgtgcagtgggcagcaggatgggacagggcaaggattataagactctgattaggacgcgatttgctgtaagacctggggaaggctactgaacctctcttagctccctatttacctgctgtaaaaaaaatggaagagcttatggtatttttgaaagattatccgtatatgaaagcacctacccctcagtctataaattctctccttcaactttcttaagagatggaggtaggtgctgtttggctttctatttgtgatgagatttgagactgggtcagaactggatcactgatgggagaagatagaggaataatcctgatataaaaccaccctctaaggtggcataaaggcatccctacctacagtgcttacaattttgtgttgccaacacttttgtaaatgactgatgtcggggaaggtccctggagctctttgtggtgagatacggagtcagcagaattttctgactgaatacattttttagggcagcagcattgttcatcaacctaaatgacactggttttcccaaccccttcagcgtctctggcaattcaccctccactccctaaggctagatgattttgtctgcatggataggtgagaactaggtgcatctgtctggtttttcccagtcctctgcaacagtgaagatttgctgactattctttcccatatgttaatgaaaacccatccagcaagtgcagctttgcccagggagagctctgcactggtgttgactgcaaggagaacagctgtgtgctgcaatgagttacctcagtggatagacatgtattattgacttgaacttgctcatgggacaggtgagcatggggacagggaggggtctctttgcccaaacaggatcatagcaagtcctctccctctttccatcttataccaactgcagggtgatggcctgcctgtcagttttctggggatgctgaactacaatgagtggtaaaacattctagaaatgcaacaagaaatagaaaagtgtgcttcccagaactcttctcaggaggcagaaagtttgagattactttgaatactttaataaggtatttgggggaatactttgatacggtttttcggctaggagggatgagtctcctcctcccaaatggcatgttcaagtaatgacagatattttataacttgctttctaaaaagcatgggtctgcttgactgcaaaacttttcttttgctgagtatgcaaaattgggctcaagattgaattactagggtcagtagctgaagactctgaccagggatcattcctctctctatcaccccatctactgctctgcctgtcctccaaatacaagctggacaagtatttttaaaaagaatattttgaataagtacccttttttttttttttgcacactcatcctgtggaccaaggatatgctaggtatccattcaaaatcagtcgtggaggcaaggctggaagtgagtagcaaagccatttgataggaaggagaacgacaggtacgaatagtgtgtggggagtactaactgagagatgtgggcaagtgtcattctggtcatcagggtcctgtttgcccagggctcctttcagaaagccaggctgggtgatcctgcatcatgttaatggtgctacccacacatgatccattttctattttgggagaccatcatgtcccctcaaaatatcaacttctcccttatcatcatatctacccagagttaacttactggccgttaggaaagtccatgggtggcagagaggacctccagagaatattgctgtcttttggggacaaactcaggctgcttaatgtttctcttcaattcagagaaccactgtatgatcactgatgttccagccttttctagcagcagctaagcaataggaagccatgaatcacaggccccacatctaattggcatagttcctttgtctgagcagtagagctatcttgtctatcatcagcatcatcagcatcatcactatcactatcactcattacttataatgacagctgacatgtatagactgtctacaaggtacaaactcaataaatgccatctcttagtatggttagaacacatgctcatctgttgcatagaaagtactccacaaatgttagctatttgccaggcaccctgctaagcactttacatgcaccacctcatttcagctgcctccctaggaggtaggtactagtgttgctctcattttgcaggtgaagggaattaaggcttggagaggttatgctccttggctcaggagcacatgataaggctgggattttttgaagccagaggctgcgtgaacttaggcacttccctgctgtactcagtgagcactcaggatcatggtttcctcctcaaaggaaaactgctaagcccagctaaatacctcagcaatttataggctgcccactttcaatctctgaaccaaatgtctttttgatgaggcctaaaatccactctgagaaactgcagaggggaatttctgaaatcgcttctaacttcctgtgaaaatattctctaactgacaagagattgtccagataacaatgaatacacaataaagctggcgcttctgcctttgctaccaggctcacaaataacccatttggcttcccaatcactctgatacctaaaactagcagaatttatgcttgcggctggaatggctctgttcagccagaaagctaaagtttacgactgaaccctttgctctgaaatgaaatctagtctctttggcgcgactttattaggccatattgtatggcgataggagacataagtacccagaatctgctgtcactaaaacaggactgggttggcgagcgttttcgtcctcacactcaatactgtgtcctaaaatgggaaagttgaatagaaattagggatgcaaatcagggccattttctgaaactttatttttaattgaattcaatatagtcatgatattgcttctgtatctacacaacccacattccaatggagattcagctattactggggtcactgaatcaatggagagagactaagtagataaatctggacccctgaaatattgtttaggctaattatcacaacagcccaaacacttggatacccatcttgtgcttaattgtctaaaagctttctctgtaactggctccaatatctagcaatacttcatggaaagcattctttttcatctctggttcaaatcctttaggctgtaatcgattcttctgaatctcttgtcctcaaggcatcatggagaatacttgccccttattcttcaccgtctttgggaacagctccttgctactcaaaatgtgggccctataggggaagcatcagtgtcatctgcgagcttgttagaaatgcagactcatagacttgaccccacctcaggactaaggcatgagaaactggattttgccaagacccttgggtgacatacgtgcatatcaaagtatagatagcactggactccatatttcaaaggacttttactaagtaagccctcagacacatccactggtgagaccttgtcatttgctaacagcagtggctggtgggattctcaccaaactgtctaaaatagtaaagatccttcaaaggcacaggcaactctctagttttttgtgttatcaaaagcaagctccccattcctatgtggattcaaatgttctttctaactcccttcctcttctcccagttttttttttgtttttttgtttttttattttttttttttagaaaagatcaagttgttttggcctcaattttagaatttaggaataatgaacttgccaaatatcaccttccctgggctcagtctacttcctgttgaattgttgtttgactttactttggaatccaaaaaatgaagacaaggagaagacaaggagggctgagtcacatggggaagatagaataggcatgagatggggagggacggggcttcctctcccagaggaatgcaggcaggacttctagctagtaggaataactccagttagattggtggcaatatatcagttcttgagagttttgtctttcaaattcaagcctccaagttatcggatttagaatttagaaaaccgtaagtcagttgctaagaagcccaagatgttctgtaatgaaaaatttcccagaaaatattgctcatagtaagaagttttttgggaagtgtaaaaatgacccagttatacatactccctggtagatcctaacagtgcagaaattttttccatgctcagaagcagaattgatttatttcatgccccaacactaaacgctatgaagttattgaagttattcatgcttacttatgatcagatgcctagaaaaattgttcttgtttctttaggcctctctctccagttttatcttgcttagttcaactcagcagatattaacccagcacctcttatttgcaaagtactgtgctgctccttctagaagatacagagctgagtaagacagctcttcctttaaggagcttacagtcgatacggaaatggaattccacctcattgtagttctcttcagatgtcagagaagtcaaatgctgtgatggtacttaatgctaatcaccacacatggagcacttactaagtaccaggtactgttctagacattctgtactgatcatctcattcagcccacatggcctcctgagagatgtgtgcagttactattcccattaaggcagggacagcacagcacattggtgaaatgaggaaaggcctcagagaggaggtagtttatgacttgaaagttacaggaagcactggattttgacaactgaaaaaggtcatagagagacatatttgtgatagaagcgtcaagggaaacagagatttcagggtgggaagtcaggagaggaagtttttagattagcatttcccatcttcttaagctgctccttgaaataaaggattctgtgactaaatatcatgttctggccgggcgcggtggctcacgtctgtaatctcagcactttgggaggccgaggcgggtggatctccaggtcaggagatcgagaccatcttggctaacacagtgaaaccccatctctactaaaaatacaaaaacaaaattaaccgggcgtggtggcaggcgcttgtagtcccagctagtcaggaggctgaggtgggagaatggcatgaacccgcgagggggagcttgcagtgagccaagattgcaccactgcactccagcctgggtgacagagcgagactccatctcaaaaaaacaaaaaagtcatgttctcctcttggagatttacaattcctcttaacatgttaaatactctaaggagtattgtgctgaaagtaaaataataaaattaaataaaacaagttggctttgttaaattctgtgcttcccaagtttatttcattcattcagaaactattattgagctatgactatgtaccacgcacagttccaggcagtggagattcaggtaaaaatctgtgccttcaacatttcccacattctagtaggggccaccacagaatcccctccccattctcctttgtttcagataacacctgctattaagttttgtcaagttctttctgtgaagtattagttgagaataattctgcttttctgaagcaggggaaattatgggaagtcagatttttaagacagagtggtgccatgttgtggaccagcacaattccaagtgtggtccatggtccatagatggggactgtgagctgtttgatactcatccgtgacgagttaagtacagaagatgagagtaagtgcttagaaactttcaaagcaattggatggattaattttatatggattgtgaatctatgataaaaattttggatttgtaccttgcattggatttgtcttttcatttttttgtaattcttatttatttatttatttatttatttgtctcatcatgttgtccagacaggtctagtactcctgggctcaaacgatcctcctgccttggcctctcaaattgctgggattacaggcgtgagccagtgcctggcctgtaattcatttttattagattttgcaaaagaatggatattagaaataaaagctaaaccctggtccctcacctcagatggggtaagaagggctgtcctgaaaaccctgcatacgaagctgaactattctggggttggtttggcagacgtctgactgaaaacatttacttcctgctcaatttacccaaataagaattattttcagtggtatttttaagaatccttattatttgaaggacatgtaaatatgttctttactattagcaaggttgcaaaaccaaattcctctctgaacagagagtgaataggccaatctttaaaaaaggctcttaagtgtaaacaccttttctatattggagagaaaattgaggatagggtggcaaaaccttctatgtgttaaaaaaaaaaaaaaaaagaccagtttcctgccacatatgtaacactttaaaaaataatttctcaattattattttaaaaagttctcatatcactcttgctgtttacccttcctttaccttcagttcctctggcactctgtctttccagaaataaacctggttgggataatggagtgagggaaaataccatgtattctggtacttttacatgtggtgtagtcttttaatcgccctctgaacacctcgtgtgggttgattctttttcataatgcctgatggaagaaatctcatttgatagtctgcagcccactggtctgggagtaagagatttggctcaagtccattccgaaattaatatttggagttgtttatttatttgttcatggctgaagcaaccagttttctggcattccatcaaatccccccaaaattgttttaattgacattgtcctgaagcctttggaaaaatctgagatctttttgtcctagtcacacattctggaaaatgctctctgaaagaggccataattgtggaatgccaaattgttatggagtccctgaaatccaagcaactttcagaaaggcagctgaactgagtccacatccaagaagttcagcgctgagatgcagtttggcacagagaagaaatacattctgaaaaggtgcaaatcactattctcttctgctttcttcctttggcttcaacttgatcactagttaactccaccccagaaagctgtgcagtgaggcattctctgtgctggcaccatttggacctcagctaacaagactcaaacatttcattttgtttattctatgaattgcttttaggatttgcaattatactgaagaacgaagaggctaagaaggggtagagaaggagataaccacatgccctttgataaaaactggggcaagtttgttgacattggaacatagagggaaatagaggaggagagaatctgacaagtcccatgatgaagtcttcttaataccttgctggccttaacatcgtacttttcagcaagaaatgagaaaacgcaagattcaattaaacttttccccttgacagagcatgctgttgaggaatggatacaaatgaccccccatccattttagtaaccagcccaaacattcatcaacttagagcccatcaattctgatttcatgtttagtattgtaggcaaggacttgacacattttgtggggttttcttggggggtgtggggtcatgataaatacgttttaatggcatctaagatatgccagtcagttcatatgactgcattctgtttcagacaatcttattataaaggacagtgacaatgtattgcataattgatatatataaatattcattcaaatgtctctaattcttattaagcacttctaagatttaaaactgtggatcctttataggaagaatatttactgaaaattcagatagactttttaaaaatagtaaatgtagtaagttcttgtgaatacactaaccttctactacctgttttgggcagtgttagtgtgtatatgttacgactcatctcttcttattgcagctattaacataatggtcattggtttttataatttccttttagtgctttatttttgatgtgcataatataatgtatatttggattaaaagaatttgcctgttttcaattaaataaggactagtatatgacaatctttggaattatttacatgacttcacgggtagaggtggacttttgcaagattatttggctgtaatcaacacagttattcagactttttactgggaacagaaatcatgatggctgtaacatactcccagccaggagagttgaatttttcacattcactgggctgttagcattagagaaacacagtttcactctaatcagaggaagcataaaaaataaaaggcatcattaccaacccaccattagtgacacacacagaacctgggatcaggaaggtgtgacttcccgtggagccaaggctgaggtttccagttggaaggtacatttgatgggggagctgtctgcccgtggattggtgtgaaaccatttgcttgggaggttcaactagactggatgaaaaattagataatgaagagtagataaataagacagtaaatgagaggtgtaggcaagctagttcattggctcagtcccctgttctcactgatgatcccgtgtgtatttgatgaataaggacccacagagcatcatctgctcatctttgctaggcgctcttctaaaacagctggggtttgatgtgacagccaaaggataaattgctgcctcaggaaatgctctgcctttgactgattgctgaatggctggcaaattaattctggcacctttccctaagtcattttggtcccattccttcatttttttctgctgagaagtgtgtcttcacattacagttaaaaatacattgacaacacaaatgtggggaacagcatgtactattttaggaaagaagttgtaggctaggaagtttccattttgtataatagaaaccatacttttatgctctgagaggaggcttgaaccgccctttcagctagagccaaaatggattattactccttgctagacgtctcgtaaagtcataggctacagagtttgggcttttgagtccttgatgggcttcggttttgatatttccctctttggtacttgtacacagcaaatcctccccattccccgaaatcctaacaccacaacctccctacacctctatctttgtggtgggtggttaagagtgtgaactctgaatcctgtttgtaccacggattcactttgtgactgtcagcaggtttcttaacctctctgtgcctcagttttatcatctataaaaggggaattcataatgacaataactccctttacctggtccagatttctttgttcactttcattttcttagtattaaacacaaggttttatttatttattttagagacaggatctctctctgttgcccatgctggagtgcagtggcgcagtcatagctcactgcagccttgaactcctgtgctcaagctatcctcctgcctcagcctcctgagtagctggcactacaggggtgtgctaccacacttggcaaattttttaattttttgtagagacagggtcttgctgtgttgcccaggctggtctcaaatatctagcctcaaacttcctgcctcagcttccaaagtgctgggatacaggtgtggctaaggatttaaattcaatgtattttacactgttttttttttctgtcctaagaatgcattgtatgagaaatgtacacttttgtttttgcttttccaaagtaagtcaaagataccacactcgagacttagaaaagttaccttgatagaaggtgataatttcagcccttgggtaggtataaagactgaagttctgttgctgagtttgtgatgcactatgatgtaatgactctgggttctcactcctgacttgactgatgtgattggcctattcgtgtccttgttctggcatgacttaaggattaaatggtctcagtattaattataattactgattctcctgctcttatgttatacataagggttttaaaaatctttttaattgtgataaaatacacatacaaaatttactatcttaatcatttttaagcatgtagttcagtggaacattcacatgactgtgtgaccatcactaccatccacttccggaactctttttatcttgcaaaacggacactgtctcagttaaacgatgactcctcattccctctccctgcaacccctggcagccaccttcctactttctgtttctatgcatttgaggactctaggtacctcatataagtggaatcataacacggttgtccttttttgattgggttatttcaattagcgtaatgccttcaagggtcatccatgttgtagcatgtgtcagagttttcttcttttttaagactgaataatattccattgtaaattaccacactttgtttatctagtcatctgtccatggacacttggggtgcttccacctcttagatattatgactaatgctgctgtgagcatgagtgtacaaatatctctttgagatccttcttccagttcctttggatatatgcctagaagtggaattatgaatccaatggtaattctatgtttaattttttgaggaaccaccatactgttttccacagtggctgtgccactttacattcccaccaactacatacattgcttgagaatatgacagtgtaattcaattagcaattttagactctttttaaagtgaaattcctttaccagaaacctcaaaaacatattgactatccatatggaaatagtgttaaagatgtggaaatcttaaacagatggcaatggcaacggatttaaatgctccagcatttattcagttgattcgatgctactaggtctagtgtgtagagactatccgcaggtctacacaaggatgtggaagaggcattttgttttctagaacattctgtacttttttccagttatacgactttcagtcctcaagcattttgattagccacagaggcaaacttgcaggaaaaaagatatggaaaaatcagtaaaagtcagatatatgtggtcaggtatatcatagtcagatacatctggtgctttctctagcaaagagaaaaatatggggaagtaaataccagttttgatttaatcagaagctagaacagatcctaagattaaaaatatatgcagtcaatatttgctgaatgaatgactcaataaaacaatttttgctaaattcaaaacaaacatgaataatattgttatcctacaaaaaatgtgttccttcttatttaaaaagtttagtgattcacctacaataaaatttggtataaagaatagcttcattaggacataaaggcatgaaaattctgaccaaaactaaaagaaccttgttaaaaccatattaattgaggaataccaccaatgatcaataataaaggtttgtattttcattatttttgataatcagttgttgtatttaaattagaccataaacaacacattataaaagaacacatatgaaaagaataggctgaattattttacttcaggaatactatttgcccataaggctctagtatggggatttgtaattagtgatacctcatatagtatcctattcattaataaaacaaattatgttaatactgtttcccaaatattctatattccaacatttttttactaaggcagattaggctttcttcaaattagttagagttagtgacctttgcttataagtcaagcatatcttttattcgaaaaaaattattgagatcttatggtttggagaaattaaaaagttcaggcttagctaaacacattgcagttaatttttaaaatcataccatttagcaatagaattggttgagtgacttttttttttaaagaccccactctggggaaggccaatttgtagataaactgctcatacccagcagcactgcctagctaatgtctaacctgtgggagtaggctggaagcagctcaaactaatgaggttaacctacataatctaatcgcccagactgagctaaaagcagacaaagagcacagagccagggagccttcagtttatttctaaattttttctggcttttgtatgctggagtgtcaccaagtagatggtaggtgtgcccttgcccactgttcctagctctccttctggtccacatgttgcatttctcccagtgaactgactgactggctgccagcaagatgccttttaatacaagataagcacaagccgttctaaagagccacttcctgttggcggggtggcttcctctcatcttcctcttacccatgcccccactggaagggaagcctgagaggctgcagccaaagacacacagcttgccctccttccctcagggaggcctgtgagatccctaagctcccatagcggctcaacgttctccttgtaattcaccagtttctaaagactgactccattgtaagccggtagcagtggctcatgcctgtattttgggagcattttgggaggccgaggcaggcagatcacttgaggtcaggagtttgagatcagtctggccaacatggtgaaaccctgtctctaccaaaaatacaagaattagccaggcatggtggtgcacacctgcaattccagctactcaggaggctgaggcaatagaatctcttgaacccagggggcagagattgcagtgagctgagatcccaccactgcactccagcctgggtgacagagcaagactgtctcaaaaaaacaaaaaagaagattcactacattgtgaaatcctttcagagatgcctagcatgaagagggttgctgggaaaaccagctaaacttgactacttagaaaaaatgcatattttaatgaaatttggagcaagacctctctgaaactacattttacttttgtgatactccttttgaaatttggagcaagacatctctgaaactaacattttaccttttgtgatattccttggggggtcagaaaaatctgtcattttgtgcaaagtagaaatatactgtttcattataatatatacatgcttattataaaagccttcagacaatacaggaatctatagaggaaaaaaagtatcattctaccactcagaggtaacaactgttagtgttttgatataaagcttcctaaattctttttatggctttacaaacattcagataactataggccatctaaaaaaataggatcagattatgtacgctattttataatgtgcctttttacagaatttctgtatgaacaggtatacattttcattataatttttaattgcttcttagtattccattgtatgtgtgccatttacggttatttcccatttttcatgaatagaaaggatgttcttgtatatttttttacctctgttttcctgtttctttgctatgaatacttcaaatggaattgtagtgtaaaagactgtgtacttttacaaattttgataataattgcaaaattgctcttcaaaacagttgtatcaatttccttgcccactaatgtgggtgagtgcccatgtctccgcaccattagaagtcatacagattaaagactgtgcacggtggctcacacctgtaatcccaggactttgagaggcagcagcaggaggatcacttgaggccgggagttcaagacaagcctgggcaacatagcaagactctgtctcttaaaaaaaaaaaaattgccaggtgtggtgatgcacacctatagtcccagctactccagaggctgaggcaggaggattgcttcagtgcaggtgtccaaggcttcagtgagctatgacccactgcactccagcccaggcaacagtaagaccctgtctcaaaaaaaaaaaaaaaaaaaaaaaaagaaaaagaaaaaagaaaaaggaaagaaatcacacaggttaaaaaagtgttttagagggcacacactttatgagtttagggttattgaaggctttatatgggtgcagaggccgtgttcctgattgctgaaaaggtcaccattatctaaccagtgcattcatttgtttgcctaagagtgtaactcaggtttcccttttacagcccaccgtcatattttaaactctccgcatgtgttcctttcctttagattgaggaagacacatggcagaaatactacttggaaggagtctcaaatgaaatgtacacagaatatctctccagtgccttcgtgggtctgtccttccctactgtttgtgagtaagtgacctttaactggatgctctttggctttcagggatattgaatgtgccccttgcaaggaagcctcccacctctgctgggtacagttggagcacttgacaattgccgagggtatcccgtgtgctcggccccatgtgatgaataggagggtgggtcattacatggcctctgcctggggaatttccactggccccacttttcttgacaggcctgagagtcttggacttgaattcatcatttatgctaacttatgaactacagttatcctgcatgccttctgtgatgtagacacatttatgaagagtggcataaacccctgcctgtctgattctaagagggcaaaacaaatcttgccagcccctcaatgaaaggaattttaatctgtcttcccatcaagtctgatcatagagacaacagagaagctactgaaataaagccattcaaagtgttttcaccctttgctgaggaaatgtggaaccaaatatacagaaggaggccttgagcccccacatagacaactgccatgttataataataacaagtcttagcttctctttccactggctcagcaggatggatcaaagccacccgccatggccactgcaggtagaatagatggtcacctatgggggatgacctcaagagctccaggtgtctgccgtgaggcatgacagtgcctcagattcctcacttagaatcctcatgtctgcaatcccaccacttttagaagctgaggtgagaggatcacttgaggctaggcattcaagactagcctgggcaacacagtgagactttatctctacaaaaaataaggaaaattagccgagtgtggtggcacacacgtatggtcctagctactctagaggctggggtagaaggattgcttgagcccaggaggttgaggctgcccaggaggttgattacgcaactgcattccagcctggatagcagtgattgtatctctaaaataataataataaaaaatctcagatgttgagtttaagatgaacggggtctttgtgccctctgaaaacacaaactccctgaggttggtgaaacattaagcctattctcctgacaccttagcaaaggatttgacaaggattcttctcactgggaagaaacaggggtatctgggagctcactgggctgaggaagaaaagccatttgcttgcacttcctgcctacatacaaaccaaaagagaggtctgaagacatcgaaacaaaactgatcaggctttaccacaaaggaggggacagtcctgggtgcccttggcctcctctgtatcacggttttctttctgtatgcaggagggagggaggcggagcgcttggtggcttcgtgtttacctggagcctcctgtcactgaacacagcaggtgcactctgtcagtccctgggcccagaccctaagcaatccaaaatggtttggctgtttactgaaatttctcaccctgtctctaagcgaaagttttaatgctaaatggactggaaaagtgaataggtaattgattcggaaggagttattttctgaaaatggatgccctattgtgactcccatgtgtgcctttctttgagagctatttctcttcctgccactgagaggagttaaccattcagaggcattgggtcctggaacactgaggctgtcccaggggatctccccctccctggagcttggtctgcctaggatacaaagccccgggggaaagcaggctttttaacagaagctagttttataaaaaggcaattgaagccttggctgtctaatgtggtggtggtctgagcacatagcagagctgccagcgcctgcgggagtcttatgttggtgagggtgtcagcaggggctccgtcaagcccccttccttggctgtagggtttccctggcctaactggtgtttgtatctaacaagagtgctccctccccaacccccaggcccttcttgcttttccacccttctcttactctgctcttgggaactgagtccgttcctcttatgggtaacttgaagggtcaggactgctccccctacaggctctaactgggatagtcactaggtatgtttgactcacgtaggtatcaactagttgctgatatttccaaatagtagtatgtcacgtaaaaactagatttctggattctttagaaaatctaatgtgacaatgcaagacctgcatttcctcggaatgctaactggctccagtttgatgtagcaaaggggttagtatagtcatgtagttactcctccctgatatcttaaaccaggccagatttgcacataaatcccaggcctggccctgtggttgtgtgagtttgccaaccctgacccactgggtggtgtggaacttcactggccttcagccagctcaagagctggcactagtggctctgtgaatattccctttgattgatttttgtatttagaacatgtcccaagaaggagacaaattgttgtcagataatttagtatttgctcagtaaagtttctggaatatatatatattccacttctgatgtgagtgagaatgtgtacaacttagtgctattattcgtttaatacaatgatacagcagaggtagaaatgatcaataaaagaaggacatttaatgagatttaggaacatcccaaaacattgaagctctcctcaagcatttgattatctggaggcttaattatctgtgttttctactttaaattaaagaaaagccataactcaaagttaccagcagtttaatgataacactcttcaattcaggttaattaaagcacagccgtaattagagtgtagtgttgtatatcactgggctggcacataagtattttcattacagtaagaattggctattcaatttcaaaatgacataaaggatgccaaaatatattttaagctggttcacgaagaagaaaaagaattggggaatattctgggtatcataaagcacagataaaatatacagattttcagagcagtttctgtaattatgcgctgcgctaaaacaatatgcagccaataacatcttaaagcatggaaagaaataaatgtgctttttctctaggctggcaaaatgctcccttgcagggtgggattgggagagcttggagttttctcagaagctaggggagtcattctatgaaaagatatgggagcaggatgtaggggtgaaatttgagattgtttcccaagagaacaggaaggagagcaaaagaggcagtgggggcagaaggtcctgccaccccgaaagctatctctatcaatttcaagccaagagattctcagtgtagccttcagtctgtggccaaaggcccaagagcccctggcaaatcactggtgtaagtccaagagtccaaaagctgaggaacttggagtgtgatgttcaagggcaggaagcatccagcgcaggagaaagatgaaggctggaagacttcacaagtctagtccttccactttcttctgcctgcattatcctagccatgctggccgctgattagattgtgcccatccagagtgagggtggatctacttctcccagtccacagactcaaatgttaatctcctttggtaacaccctcacagatacacccaggaacaatactttgtatccttcagtccaatcaagttgacactcaatattaaccatcacagatgcttactccaatctccttctctgaaataggagtgctatgacttatctgtcagtacgggttaatgtcttttcccctctccctcctctccttttccttctacctttatctttctcattgaatataatagaagcacttagaaagaaagaaacacattgcgagctatatgtgtatcccagttatatttacttttaacctttaggaaattctcttatcggttaatcaccgattaatcagatatttaatgaattgggatatgtgcaccattgtgccaagcttggtgccacttctagaggaaactgctactagatttgatcaaatatatgtgcatgaaaagattaatagcaatacttacaaatgccaacaaatgccaagtaaaatattcagtttccctagggtggctgcctccagagtttactgtctggctaagggaaatagtacccatcgtcagagagatctagacacccactgataagtgctgtggtagatgcacacagctggaatagagatgctgagagttatagggacatctccctgtaggctggggggacatgggggttcttcctggaagagatgacatttgagctgtgtcttgtcgggagttttgattcagatgggggataaagaaggaagaggacattctaagtggtagggaatctggaggctgcgccacctggtaccatagggagctctctcaacacctaggtctccgagattttccagttacagcaaattgctttcctctttagatgagacaaagagatgcatcagatttattttgacttgtgatttttttgggggaaactgataacagtgtttttggtgagcacttgcgaaagcgagggtgcactcccctacccccagggagggcagaggggaggggaggggctggacaaggaggagctgcaggaaaccatgggttcagcagttgggctgcctcaagaacactgtgttctaggttctgaatctcaccgggaacctattagtcagtcattcatcatttgcaaaatataaaagcttaattgtatcaggttttacagctcagaggggattaggacaaaagatgtatttaaaatatggtatgtgtctctctctgtccctctgcagctgatggagcagttaaaattcaggtttgatgtggagtatttaatgcctggggaacttggggaactccaatcagatcttcctcagctgtgctgaagggcaggagttctgtccccaagcccaggggcaagtatggatgctactgtgctggtttaagagtgcagggggattctcttttccctcctctacctccctgcattcagtgctcccctcctaaattcagaaaatcatgctctcaacctgtgttattttgcacagacagatctttaaaaagaagccgcttggggaaatttaaaatttaagaccgcccggcgaaagctgggcctcttgcccagtgaaaactgtagctagtttaacttcagttctgtgaaatcattagtttttggagaaagacatccaaatttgaacatggagcagaaaccaggcagacccaattgttatatgatagatttctttagcctggctgcaaaaatgagcattttaagtgaatttatggagaggctcagatctctctctttttttttttttttttttgagatggagtctcactctgtagcccaagctcgagtgcagtggtgtgatcttagctcacggcaaccttgtcctctggggctcaagagattctcctgcctcagcctcccaagtagctgggactagagacgtgtgccaccacaaccggttaatttttttgtatttttagtagatacggggtttcaccatgttgccctgggtggtcttgaactcctgagctcaggcgatccacccaccttggcctcccaaagtgctgggattacaggcgtgagccaccgcacctggcagatctcattttttaaaaaatattttcccctcacagaactggctctattcatccacttgattggggagtattgtaattagggttgaacatatatgaatagagatgtgaatacagtattggtggttatttctactacagagacccaagaggtgaccttctatgagctagtgaataaaccgttgaccctaaagtctattgaaatcctcaataacaggctactgaggcagtggtgggtccagaattctctacagaagggtcagggaaggagtcctgttggaaatggggtggacgcttgggctttgactcaacactgggttcttgtagcaaacacatggttttttctttcatattatgtttctcattaataataatagcaaggctctctaaaaatgcagttgttcacactttaggcaaaagttaattgtctgtatcaagtaatgtatttataaattctagtgtcttaggtgtgctagtggagattgtgtgtgtgtgagtgtgtttgtgtgtgtgtgtgaaagagagagagagaaggagagaataagagagtgggagagagggtggggatattctgaaaccttcccactccactcctatcaaagcttcatagagaaaaagagtcttaacatttccatgaacattttaaatcacttctcttttcttggtgctgagtcttggaaatccggatgtttcaaagtttctttacctggatatttcgatttctagcggctgtcattttaaattaaagctcctgaatgtgaatcttttccattccagcccctcgatccagaagaccttgtttcccaatgtgcagtgtttgtatccgtatctacttcaattgcatgtgccaacctgacattcccaggggccctctggatagctgaagaggggctggtgctttgggtggggttgggttcagggggaatgatgacagttgcttctttcatcctccctcacctgacttgtggggtgagtcctcttcaacagccccaaacctcctctttgtattttcttcctgaaggtgcaaactctatgacaggtttccatgtttaattaacaccagcaagtaatgtttccagtaaagggggctgatttaatggcaggaacaatgtatttccctctgggtaggcagaaacagttggactctaattcttaagagcctttgttcaggaacatctgggttgaaactactgtagttaacagatgatgttggcagtaaaaaaaaaaaaagggggttgggctttgtataatgtcgttgtcaaatttggtagacctttacctaataattatcaagaaagcaatctaacttgttattataacagttttattgcagattgctggcttaagacctttttgtgacaagtggcattttttttcttgaaaaaagaagtcatttctattcccctgtaattatttttgcaaccagcaacaacttcctgcgttggacatactggggcattttattttagaaaccaataattaaattattgctagcttatggctgattttatcccatttatcacattgtgaaggctttcttacttccttttttccccttacctcacctcaccctgcttcctgatttcacaccaattctgtatatgttgaaacactgtaagttgagtaaaggcagaattagaataaggattagatggctaatgctcattcttctttaccaaaaaatggtgttgagtgatgcaagtaaatgtttaaccagagaacatcagttctgggtatactgaaagtatatatattcttgggagtgtaaggggtacataagggtataagagggtctctagaaggtcccaaggacaaattgttgtatcttagaattggacttgcatcttggcattgtggattgaaggcaaaaattagattcccagagcatatcactacttttatttccttctgtatccttcctttcccatctgtctgcttctaacaaataagacaagctaagaagcagcttgtttcatgattctatactcacttccaagctttctctgcatagactttcctagtttgccactttatcttttctccatccctccagccagtcatgagattctactccccattcatacatgcatttatttatccagactttactgaaggcttactctttgaactttgcaaaatgccagtgaggcaaagcatgcatcctgtacaggaaaaactcagtctagaggggagagataagcaaacaagtgattaccacaccagctcccctgttcattcaccttgctctgctcttccccaatggacacctccaacagaggctgcatctctgcaacaggatgcagtccttaagcccaggattgtgacattggccaactctctgtggcaggatctaacagaaacgtgtgatttgaacactcacagagggagccatagctcttgcttccagtgtaaatcatggtgtattatacttgatttgtattttgcaatatctagaggatacctattatagtagggattaaaaacttagatacctatagggttcaggcagttagcaagaaagaatgaagagtgaggccatctgagacaatagagagtggtgggaactgtggcacattggagaacaaacatcccatccagagggataagtgcttcacagctgcactcccttttagcatgtggaatgtggtgccaatgtggccctatctgattttgcaaggaaagctgaaaagccagtttctatgtgaattcacttgttggcatctatttacagttttttaaaaaacactgtacttaccaaacagaatgtgtctgcctgttgggcttgtgactgccacttcatttcctctcttctgatgagaagcatctgtgcagcacattgcgtcaaagactcgatttccacttttggctttttacataaaagtcaattgaccttgacctagttgctctcctctgtttgggctcagtttgttatctgcataggaagggcaagatcagccaatcttgaagggcttgagtctgaaaatctgtgttgtggcacggcttgcctatgttctctctgttcacatcattctatccctctcctttcctttggccagtgggccacagcttgttttgggtcaaaggactttttaaaaggggcttctataaggcattgtagaatcagcttgggtatggatttgaatgttttgaagttatggatttaaaactggaagaggactcagatctgcgggtccatcccctataaggttaaggaatgaatacaaggccacatagaccttaggactttcttgtagaggaaactcttttctttttatatccagttggtagatggtactgtagtagctaggaagacataattcaccattactacgaactgttacttcccttcttaccagcgggattaggtttataaaagcaatgaagatctttgatcccatgaactaccagagtcccaaagtggactggtcattgctcataggatattagcaaattaacctttgcacgatccatactaagtttaagatcagccttctccctgatgtttttgtatttagctactatttacattagaaagtggttacttaatttggtaatttggttcaataaacattgcataagctatcttattttttaaaaaaacaatttaagctccagaagtaacagtcccataaagggtgcatgttagcagtgctctttgggacataaattaaggatggcattttccagctgtagttggatatgtgtgttggtgtttcagcaagctgcataatcagcacaaagcccaggtcattagattctgctggcaggaatcagaaaacctgcaaatcaccaggagatcccagatatgcctggatagaagtggtcctttgacatctgactgtctgctgaaggcagtgctgtggaccacaacctcacatgtaggaatgagcaattggtttcactccctggagagcatgaggccttcagcagcactttccttgaaagcaacacatccccctatccagcacatctgattatgtcacttttctcttttaaaccaactaaaatcccccaattccacttataataagctgtagactccttgctctggaaagcaaagacctcatgatcttgctcccccctcatttcctgacctaatcactgtcacgcttgactttgctcactcagctgcagtcttactgaatttattgctgatcctcaaacacccagagctcttccctgcctcagggcctctgtgcttgctgtttctacttcctagaaagctctttccccatatcttctcatcatgctgttgtgctccctgcatcctcagaatggtcctcctgaaccatcacagatgatataccccttctgagttactctttatattcttaggttgttttattttcaacatagaacttgtcatcatctaggaatttattgtttattcacttgtatattttcttattgtctgtctctcccaatacaaaataggcttcactggagatcaagatgtagggtatcctgccaggtattagctagagaccttaggcatgttacatggactttctgatccttggtttcatcacgtgtaaaatggagctatcaatagaagtctgaataattggggtaatagcttcctcttagggatattgaggggattaaattgacccacaaggaagccttccccacactgtgacccagtatcttatcccccttacaatgctggagctaaataaataagcatcaactcattgttcagtctatcagttaatcaatattctattattcaaaatggtaatgctaattgtagacacttgtcatacatcatgtatgtaattattttgtttatgtgagcttttattctgtaagtatgtaagtgtataggttcatctaactgtattgtgccatttacatattcatgtatttttatatatttgttctatttacatgttcatgtctttttatatgatattatttattgatcttatatcttgaaatattctttgaaaagccatttagaatgctagtaccatattgcactgtactttatggccttattattggacatttaggttgttttctatttttctactccatataaataacacttactctgaaaatctttaagcataaacattttactgcaccttttgttattttcttagacttgaaacccagtaagtggaaaccatttgtttgtttagcttctctgtatcggtgggtctattcactatgcactatggagaattccaaacaagtccaggactcttaaggaagttgctctggttaaggagacaaagttcagacacatgaaacaatagggagcgaccacagccagtgtaaaattgactaaaggctcagtgatttggttacagacaaggtgctgggagagttttgagaatagaaaatcacagggtagcagtagctggagaagacccactgcttgcaagattagagttgacgtggcctgtgaggatgggttgggaagagagaagaagggatcgagagtggggaacgcacaagggaagggatggaaacaggaacaagccagcctcaaagcagtctgctctgcagtcgagagcaccaagcagatgaggtgagacagcttggatggagccaggagtgacaatgccatcgtcatgtgctgggcacttacacagaggccaagtattattaccatcattgcaagcacacaggggtctgctcggaacaacaatatgagccatttgtacaaaagaccgaaacggaatccaaataacaggtccagctggtccaaatctttccctccccctgtagttaacattttactacccgaccgagtaactaatgaatctggcccagagtaaatccccaggcacaaattcctgcttgggctctgtgtctagacagccagccctgagtgcaatttgcactttgagcatccagcaccttatcacttgcaagaaatcaggtttaatagggaagatggggaggtgttgcttccaccccctccctttggcacagtgccggtggaatgaggatcccctcggtaatgactgcattaggagaccgaaagatcgtaatagtgtgtgttatgtggctctggtcattcagaagaactgattgggaggcttctccatctcattgcaggctgtgttttgtgaagctcaagctcctaatgatagccattgagtacaagtctgccaaccgagagagccggtaagtttgcggtgacccagcagccagctgacacttttgatggtgagagtgcgttctgagaacggtcggttcacttctgctttcttgtgcattatttatctgcatggaaccagatgtaaaacctctctgaccctagagcacatttcgaggcatgccccatcagacactgcagcttctatgccagaccagcctggcacccaaagccctgctgggcattcagagagtgtttctccagggaagagggatgagtcctcaaaatatctccacctgatcatgccgacctggacttttcaccttctaagtattaaaccagaacttaaaacccctttttactgctgtgagcaaaaaagcaggtggactctggcctcctttacagcagccttggggtagagctgtgaggggagacaccaactctcttgatagccaaattacaagcagcctattgtgtaccatatgtgcttctcccggtgcaaccaaaatccaggtggcagaatatcagcttcatgtaaatgagccaggagagtggagctcagaggcaggagctctctttatttatttattttacacttaattatgtgcaaatcagactgatgagggactgggtctggttgaaatagataacatcccagtcaatatgtgagttcacactggaggtgggaagcatcgtgctaacaagaaattttgctgatggagtactgtacaccttacagataaaatagagatgatttttttgctccccagttcttgtcaatagttttggaagaaagagagctcattgagaaatgctcaagcttttgttctctgaaatgacacccacagtctattcctctatagttcatatttttgatcctgcagatgcccaaatgtagagtgcagatcccctccaacaaacaccttaataactgagcagagtacaggggaagactagacgtttccttttatcatcatttaaggagttttccttatctgggtgaataacccaatacagccagactttcaagtgtatagtctgtgtctatgacaagacaaaacaaaagaaaagaaaacactggattgtaaacagatcaatccaatgttttctgttaccttaactaccagatcagattgctcacaaagtcaatctgatcaaatgttaagctattttgaaaacccaaatcaaccaaaaggaagaaaaaaatggtagatttggtggccatatgtagaacatggctgtagcagttaacaaatatgtagatagataaatattttctttttcatgttggcaaagtgaagaatattgtttgcaaaaactgacagtcctgattattagttgttcagcagatgaggtggaattttctggggttactgtttacccatgtttttgccaatactcacttgtacctgtgtaggggaactgtatgtatcctggatttttgcaaatgatattccccgtgttgcgaaatcgcaaatctttgtgtaactcagtgttctctatttacttttgtgcatctttcaaaaaaaaatgtcatgatgtgggtgatgctgatgctgcatagtgtttttcgaccattctggaataatctgactgcaggagattgcaccctgaaccttgagcagttgtctttcacttgttgccttttggttccaaggagagaaaaagagcgaaaggctgttaatggttcattgtgaactcaatgtcactattctaagaaaactaactcagagcactccctgaagatgaaacttttcttggataggcccttcaattgagtcacaattctgagatgttttcaacaaagccatatttgtagatatagtttttagtatatatatatatatatattttttttttcttcagaaaagggcaaaaaggacttgtttggctttgtttgggctttctttgtgcagttgccagctttaattctcaaatgtggcttggtctcagtgtggaagcacattggttcttgtggaaaaaggtgtgtttgagggaatgtggatcatgcctctgagaaaacacaggacttatcaaacacaatatccacgtgaaaacacacattttttaaaatcttccctgagataataattttaatgtttttctttatttaaacatgtcccacttctttccctctcacattttctaactgactgggtgtgaaaattcaaaggacctgtttctccttcccaccttctttaacctgtgtttaactgcctttgttgttggtttcaccccatgatactgttttcatgctttgccaaaaaaccttgttttcacatgcatccttcaagtgatttgaaacaaaggttttattccttctttccttctggtgtcagtcgatttattatcaaattgtttgattttaaattcttttcttgtcgttttgcagaagccgaaagcggtatgcactcttcgttaacttttcttccaacctcaccctctatcttcactcctaaccacaggactaaccatttgccaaggaagtttcaagaagagagagattatatatatgtatatataatctcattcccttgtctggtgtatctatattatatatgtgtgtgggggccagtctaatatctaaactcaactttcttacctacaagcaggtggataatggtaacaataatctttagagaattaacgagagatgatgctatagaaggctcaatgcatgtgggctattgtgtcctttttttaattcttgcaaaaaaaaatccaaagtgtatttcattttcaacaaagttatcacagattttctctagctgaccccnnnnnnnnnnnnnnnnnnnngccacgtgacgggcgggccggcagcccgaagcgccgagagacgccgccaacggacacctgcctgaggcgcgcacgccgagagagcaggcatcgacagcgagccacagacgagcgcgagcagaagcgcaccgtgaacacccctctccaactagagtacataaattggaagtagcctatttctgttcctgtttgatttgttggttcttttggatgacgcactaacttctttgcaggaaacctaagaaaggaaaggcacactcctgttttcagtcatggcaccaataatgggaacaaatactattaaagttgaacaggaggatgcttctctccagccctttgtgtctgtttctgtattgtcctgacgtgtcttgatgtccattgcactctagtgccattttgtctacataccacttccacattcccagtgacctcctcctccctgtgtcgagtttcttgtctatagagcagaattcctgtccttttatccacaaaacagagaccaagcccttacacttctatttttccttacatttattttggtgataacattttgaatattttatttcttgggcagtgctcagtatagtcttagaacactgctattaaattgccagattatcacacttgatttacagagttagtactgtttattgagacagactcatggcttttttttcctagtgtgtttgggcatatttcttaatatgaagtttctcaattttcaccatgtgatttcaccctgttttgctgctgttttacattgcatgaagcatgactaaatcatcatcaatggcatttaaaaaaaaacttttgggttaatagttccaggatagcttttcaataatgtgttatctaagacaatattgttgaaaacatactgttgagatgcctacttgttcatcttttcaagttacttttctctgtgattgtaatcactgtcatgtgtttgtgtttgtaattgtgtgtgtgtgtgtgtctgtgcgtgtgtatttgtctgtatctttttccaaaatctgattcttctgttgtttttttgagtacatgtgtataaataaaggtggcttcctgtcagtttggtattattgatatgatccaactgcaagaagttactgcaacactttgcatcttaaaggtccacagtggttgcacctctgctgttggcttttggcctttgagtccttttatcttgtggtgaaggcatgttgtgatgtaggcatgacttgtcctaagtataccagaaaatgatttggcttgctcccagaaccaaatatccagcattatcctttctagatcacctctctgttccccatcccatatggctaatatttttttgtatgtgcgaaatatatttgaaaatgccatttctaaagttactgagatggatgcaggctgagtaagtcctcaccagtatctctggtggaccacagtggcagtcatttgagtctgaccaactgggagcaatctttatcatgctgtctgtgtgtaagtgaactgggcttaagtatattgacatatgaaatacacaactgtgtctccaatggtatcctaaagtaaaagtgtgtgtgtctagttgtgtgggactccagcagcagcatgtatttgaaagcccagaaaaaatgaaaagttccagaaaggtgataagatttgagatgtggggtttctctgaactgtgcctgcacatagcctgtaaactacaaatgcagtcatactctctgagaggggacacggattggttcaaacaaagttccaactgagagtcattgtatatgaacttgtgtgatcaaagaagcctcttctcaatggcatgattcatctgggcatagcatgaatggaaaccctaaatggttcttatttgcttgctttagttaatgaagtcccattagcttgctagacacaaatataattactacgttatcaagcacaaagtatgttctcatataagtcatgctattttttaaaaattgcctgaggaatggtacattacacctaccaaaaatgaaagggagaggagagaaatatatatgtatcatatttacccataatggatagaagtttccttaaacaatatctgtttcacttgaattacgaatcataggttgtcttcagaaacaggaaacaagtaaagtttacaatgattgaagacaaaactagatgtcccccagttatgcacaagtggtggagaaaggaatgcattactttcctccatcaagctgcagtcttccaacctgaccagtgtttagcgagagatacccagtgaaatgtgatacaacttgagacgcggtgctcctctcatggagggacctgatagaggcatttccctgcgggactgagccccgctagccaattgcacgtagatgtgttttatgtctaggaacccatatttctctttgaagttttgctttcaatgttgaaatcaattgccccaactttgcaagtggcaggctgtttacatattgggatatttacatattcatacttaacacatctgagagattgctagatcattggccaatcccctagccctagcagaggtgtggtcactcctttaatcggcctgactgatgagaattgtagcttgttctttgaaagaaaactgtgacctcctttccacttatttgtgaaaaaaaggaaaacttatggaactgaggctttaaaaacttattttttttattcattcaacaaatagttgaaatgtgcctgttgcgtgcaaggctctaagcctgctactccaggaaactcaaaggtaaatagaatgtgatcatgttttgtacccctctactcaactgtgggttccttacagaaaatacgtatttgctccatgtaggaggtgagtaaacaaagaataagtcgagacttaaaactagtctgagagcaaaagaaacagagacagcaagggaccacaccagccccgtgcttccagctgtcactggatgttttctgttgaaaccagtaaggtcaaagaagaaaggataatttatatgttccttgaaatgagggaaagtccacctctgccaacatgtccttgttggaattctgttaatggatatatgggctttttctcttagagattttcctgattcttcacatgacacatgttgaagtttatctctgataaactagtgaattatataaagttggagctagagaactgattcagagtggcgcacagagagagagacttttggcagtcagtagaacaaaacaaacttaacattggatactctcctaaagagatcagagatccttggaaaaatttatgtgttcctattagaaggtcaataacgaattctaaagatagtaggcaaaagggggagaaggttatcactatccagaatccttgtctttttatattttgaagaagatggggattagcattttatttaaactttctagatttggaatgtgtatagaagacttaatgtcgaaaatattaaaaacaaaaacaaaaaccagtaatgtagtttctggtgcttcagcgccaagagcatctttatgtatctagatttctttctttcattatttcaaggactggatccattctttagattcccacccagaaggctgccttagccttagcttagtatctgcaaatggttctgccttacaccccacatggggatgatttaaaccccctcacccctgttcacagggaataagagggcatcctggaatccacatgatctgtgaggtaattagagatgctttcgattccttacacaatcagccatagatttaaggaacacaggatacttcactgtgcagacaaaagtcagtctaaattagcccatcaccagatattgtgcagggataaaatgctttggatttccttgcagtcagtggaaaagtctttcaatgccaatagggcacctcctgggtcatttattagcagcagggacaaagtggagggtgatggtgctgtgaggatttttttacctctcagttttataatcacctagctcactgagagtagcaactaagaatttaagaccttctatgtgtcagtcatgtagcacatagtacatactttaactctcttagaggcattgtaagctagcgattattcacccattttacagatgagaagtgtgaggcttacctgcatttgcaaagccaggacccattttacagatgagaagtgtgaggcttacctgcatttgcaaagccagtgcatggaattttttgtgtatgtccttatacattattctgtagcgtacagttctttaccctataatttcatctcattaatgggcaaggtattttgataagaagactgtattatattccatggggtcagctagagaaaatctgtgataactttgttgaaaatgaaatacactttggatttttttttgcaagaattaaaaaaaggaacaataacccacatgcattgagccttctatacatcatctctcttaattctctaaagattattgttaccattatccacctcttgtaggtaagaaagttgagttctagggatatttagtaactggcccaaagtcaaacagctattaagtggtagtgttggaatttggacccaaattctgattgcagagccagggcatgtaaaaactgccttgcaggaaaggaggtaaaaaaaatgtgcaaaatttataatcctgcctttctaaaacatcatactgaattggctttgaaagataaattcatctaaactgtatgagctctaacacttcaccctcgtgattgcatgaagtcagagggcttgttatacccatgtgaagagttggcggaggggtcattaggaggtgcttatggagagccgctgctcagtgcaggccgtgctattagtgtggactgctgctgtctgatttgggaggaatctcactgctgcctgtggttgtagggcagaacagttaaatcttcatagccttttggtattattgagtgttaataatagtcatgacacaagtacagtttcctcctgtcaggtattgttataagtaatggtagatgttcttgtgaccacaaaaaattattttgcaataatgatctgctcggaggtctcccaaccaggtgaacaaaggttcacctgggtccttcctgtatgactacagacgtatcacttcatgaccacaacacttctctggaatggtttatcagtaggaaaaaagattatgtgttaattaccatcctctatattttgattgtttggggcagctgagaacttcctttagactgattccaaatatctattaccttattaagcaacatcttttcagaacaaggaatacctctgttgtatctgttgttttattcagaatccctgaattcagtatccattaagcctgaagtcttttctcagtctctgcatcagacaatcttgtattctgcttttgatctgcagaaaattaaacttgtttgtttcatccatttattagattaggatacatttatctcttctgtcagtccaaacacaacttggtccgctaatctatttatgccactttgaaataggacaatgtatatttaggttcccacttctctgcagggcaagtttttttaaggggaggtttgcatttgttttctcaatttgcctcaattaggacatgctagacacacatcttattcaaacaccctgtacgtttttataaacagcagactggaattgttaagtatatccaactgctgacttaaaaaaaaaaactgtttgggtaaatccaattcttcctataaaggctgtacatggaatcaatttccatgtccttatcaatgtcatgaagacgttcagcttgcttccgcattggttacgggtgtcttgtaccattccctgcggtaatatgtggtgtgtgtacatgatgtttatgtatatctataggggtcccattaatgctctgtcatttaatggaaaattgttgtagcaatagcttcatcaggccaataatgcttccgtgttgaccaccaatagcagtttcaaaaggaatttattctgatggactttgcttcaaatcatgtgcccatgatggcagctagactgctccattatataaacccaggccctaataccttgatttgctttgatttcctcaactgggagcatgccagcctgggaagtaagcagtagtgcttaatgatggcattatccaactaaatgtatggggcagtggacattggactctggacaaaatctttggggaaagctttagactagtgggccccctataaacacaacagtatggtgtagccttcaaggttttattcagaacatgacctcacaaatgtatcttctctgtttgtttttgttcactgagcagtatattaattaatcctggaaaccatcttaagatccaagaaggtactttaggatttttcatcgcaagtgatgccaaagaagttaaaaggtaagagtttattttcaactggctttctttctggcccggctgtagacaccttgacccacggaagtaggcaggcttccataaccccaaaactccttaacatgtctatggccatcaactggtgtaagaaaaacttccacggactccagttcatgtagtgaattccacatctttgaatgagaataataaaattttagaactaggaagcctagttacctgctcatttattttgtgagggagaaaatgggggctcagagagctgaatgactgctcgaggtcatcctgattcctgatgattcagaacaacataacaagacaactggctccttatctagtgctctttacttaatattatctgggaaatttacttgagaattatcagttttctactactctccctgccaaatagaatttcaaaaggttgggattaatttcagatggaatatgaaactggctctatttctatttgtggcctcctaggtaagtggctgaagttgtcagcttcaattgttaagccactgtaagtgcagcacaggatttcactggcctacatgtttcatgacatttttattcgtatccttaaacctgtttaagcagcctaggaattcacagggccctttgcagcacaacatggaatattattgtatttgattctatcttatgaacttggagaaatttactagcagaaaatgtgatgcaaatgttcagacaggtcattcagctcaacagtaatattgcataaaatattttaagtacattattaattgtgaaggtctatcattagttatataagcctattgtcttcattgaatgagttcctagtcaaagccaggcctgttctaggtgtgctacattctttattgctgctcttcaaaataaccctggaaggtaagtcttctcaaacactcagagctttggtttcctcatctgtaaaatcgagataagtgatttgtccaaggccatgaggcacataagtaagtggtggagcccagagtggaactggtctttccttttctaaaatccactctctttctaccaaatttaataatactaccacattcttacagaggagggtttattacaccccagcactattctaggtactaggttctctgtatctaaaacttgttaaactctcacagcaaccccatgagataggtagcattactctttcccactttacatatgaggaaactgaggcacaacttggctaactaacttgcccaaagccatactgctagtgaggaataaagccaggaagttggagcttgcactcttaattatttgcctaggttaagcctgatacgctgagcacagaacgatgacatgtgaccgtggatacttagggtcctcttcctccccatccactctagcaaactaagccatactggctacagaagcttttgggaaaaagaaaacatgggctgttggaaggaaaaagaattcttaaactgagcgctctaataacttaaatttatttctgcaaattggggaaagattgccatgattgagttgtgggggaaaaatacctccctactcagttcacagaatctcccggttgttcaagagtatcctgagaactgggtacacctgagaagggaaattaggattaatgggactgaaccttccctctccctgtgctccaatcaggtctcctggagaagaagcttgtgcccttgtccagactgtgagacacaaaagcttgaaacagcatctcagcaccaagtacaggaggctggggagcacaggagaaccatatatcacgtatacctcccagatagcaaatataacatgaaactcccatttgtgtaattctatttcctattgcatctctcactaatgaatgtcacaaatatcaggccgtccaaaaaacaaattacctcctatattagggagtgcaatatgtctcatttcagtgctttatggtattcacaaatacatgctgacacaatcagctacaacaccaggctgtaattttccatggcatgtgatgtgtcaaagcaaatgctgtcagttaggggatctcaaatagatgaagactgcaaaaaaccacagaaaggacattggagatttgaatgaaactaaacaagctttgtaaaaatggaaaagtagattatgatgatctcgtatcgagtttgcaccctccactgcaaaaaagcaacaaaagaagttaatgaattctagcttgtagaaaccttcagatgcagtgttttagtaaatgaggagtgaaaccatcccactgcagtcttaagaaggtcacttgaggatgggcatttgggtacttgctctttcctccttgccaccaaatattttccttttaaaataacgttggaacatagactttaatataggagtcacaaaacggtggctcagtgactcagtttggcttgcacatatgatccttttgagtcacaattttaaaatacaaatgagttgccaaggtgaaaaaagttacgagcttttatataaaaatccttattactcatttctcctgaaaaattggcagacccaacaataccgggaagcagtctcaaactcactcattcattcgcccatcaaatgtgtataagtcgtttacatttagaaggctctatacaaggcaccagggaaacagtggtgaaaaatgaacaatggggagaagtcccaactctcgtggggctcatattctaggcaggaaagaattacagttttttaaaaaataattagtggtaaaagaattaatgcaactgggtcactgatttgggttgggtataagtgaaagcttctcagaggggttggtatttgagcagagattgagatgaagggaaataatccatcaggcagggatcagataggaagaagagatgggctgggaagaagttcattgtggatagggaccccaagaaggaaagtgcggctagggaatagatttggggagagtggtatgagatgaggttagagagaggcagaggctggctcctaaagcactttatagaaaggttggatctgttataaaatggaagtcattgatggctttaagctgatctgatgtatattttgaaaaggtcattcttcctgcattgtagagaatgagaggaatggggcaggagaagaggtgagagactcagcgcctattgcatagtttaggtgagagatgatggcagcttggactgacccctgagtggaggtggagagaggtgggttcccattcagactgtatttgggagagtgtgcagaaccccccaatgaattgggcagaagtgaggaaaaaagaggaatgaaggatgaaggctagagtcagggcttagattgtgttgatcttaaccaagatgagggatactagagaaggagcaagttttgggtagtaggaagttaagcattctatctgggctatgttaggtaggagatgtgtactaaacatacacacagtgatatcataaggcggttggatcttagagtctggagttctggggataagtgtgaattggagatgaatatgtaaatgtgggtgctgtttcttgtcctggcaagaaacagatgacaaacttaaatgggaaaaaggaggagagttttatgaagagactgtaaagttatgggcaaatagtaaaggaaaaccaacaagggatggccaagcactgcagagctagcaagaaaggggaagccaccttcaccctagatctgtggggtcaaggggaaggagggctatcaggagctggagagagaggctgtcgtgtgccatttcatagacctgtacaggagggcacccggggggtcaaggtggtgacctcatcccccctcaccctagtctcctgctgactccttccactggacacgcaggccaggaaaccagaggacaaggagaccatacaggccagccttgcaggacacaaagctggtctgatgatgggtgaagcaagatcaccagctgaaggctgcttgtgggaggggtacggtgagctggagcaagtggagaggagaggagagagagctgttttggagtgtgagaaagcaagcaacaggagaatggggtagatcccaaagagtggaaaaggcccctgaaatccatggttgtgggtttaaagtgaggtcagcatgttttctttcccagcgaaactccgttgctcaggtgcaggtgtgcagtaagggaggggctttgcgaggtgagcatgacagaggcaaagatgggtggggaagagaatgattcttgcaaagaaatgccacttggcagaggtcagctgagcttagatactctgcctgctccagatcaccatggacacccccgacccttgcctcatttcacttattaaccttaattgcctagccttggaggacattatgcttagtgaaataagccaggcaaacatcgcatgttcttatttacatgtggaacctacaaaagttaaactcatagaagcagaaagtggaatggtggttaacaggggctggggttgggagggattggggagatgtccatctaaaacatgaaatttcagttagacaggtggaataagttcaagaaatctattgttcaatgtggtgactatagttaaaaatgaattatataccagaaaattgcaaagacagattttttttttttttttttgagacaatgtcttgctctattgcccaggctcccaggctggagtgcagtggcacaatctcggctcactgcaacctccacctcctggattcaagcgattctcctgcctcagcctcccaaggagctgggattacaggtgcatgccaccatgactggctaatttttttatttttagtagagacagggtttcaccatgttggccaggctggtctcaaactcctggcctcgtgatctatccacatcagcctcccaaagtgttggattacaggcgtcagccgccacacccagccaagacagtagattttaagtgttcgtaccacaaaaggtgtgcttcagtttctttatctgtataatgtatatgttaattagcttgattcaactattccacattgtatatgtatttcaatgtgttgcataccacacatataatacaattattatttgtcaattaaaaataaaaattaaattaaaaaagaatccaactttagttcatgaagtaatcaaactttatcttttcacaagtctattcaggcttattatcatgtcatcatctctttagtatagaccttgggctctggtgccaggctatgtgaattcaatctcagctttggtacttttagctgtgtggccttgggcaggtcacttaacttctctgtgcttcagtttccttatctgtaaaatagaaataataatcatacctccttcaaagggttgtttgaggatcaaatatgtttaatgcttataaaatacttagaaccacacctgacatgtagtctgttctctatagatgttagctatatgattgttaccgttattatcattatgtgttaagagcaacaaagggggagggaaaatggccaaaggaagtggacgcagagttactttccccaacttggatgctttctactttcctgttcttcctgtgccaaggcagattgattgggttcttagccacattgccactcagggtcaacagtcagctaggatttctttttattttttttttaatttttttgagacatagatgacagctggcatttaaagaaagagtggagaatttgctaggatagagcaagcattggacttggattcagaagtcctggggctggctgaatcccagcatggaatgactgggcagtccacgacaacctcctcagtttacagatgaggacactgagtcccagagatttaggctgcaggatctccaagacctcgtgtggatccaaaagtcttaacattggtttccaatgagtgccaattataaatcaagtcctgtgaaaacataaaaaggaacctaagaatcaaatggtcaagaattgtgtttatttctgcagccctggtcaagaaaaggccatgttcatagctggcattcagtttcctgttgggagtggtaaaggcaacaagccagggattttgttagttcttggatccagaaggttgtagggttgttccagtgaattttatcacctccccagtactgaaagggcacaggcctcttgtgctgttctaggcactgtgatttcaaatagtgcttgaatgatcttatttttcttatccagaatatctttgacacagctaatgcactgtggaatcacctatggacattcaagtcagattaggggattttctttttgagtgcttcatctcattctccttctacctacctattgcttcaataagctctactcacccccttccagtggtcagctgagctttgctccatagtgagaagaaaaccatcatttagtgcatgttctcagggctggatagcatgggaattggtccagtcagctttggagtaaaataagctgtgaaactccagagggggtttgacagaggaacccactgactcgtggctttcgtttttccctctctgcagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaacatttccgtctgcaaatgtctaaacctttcaaaagattaaaggaaattaatgctggcgtgtttcattaatttggcaccaccgtggaggaaatgtggtactcatttcatttgggtggattatgaaacgtgtcagtttttccattctctttctccagggcatttttttactgcaaggcctgtcatgatgacatcacagatcccaaaagaataaaaaaatgtggctgcaaacggcgtaagtagtgtttctctccctgtcccctccctttctcattcctattccccaaattccttttccttcccttttcttattagagaaacactaaacatcgagagttttcttgagtatgtttatgtttcacccagcagtttaaagaaatatgaaataaatacctgtccttgctttgttagagcagaggatgaaaaatcaccaccatcaacacctaggaatgaaacctgtgcctagtccctgcttctttactctagaggtgcctcagtagatgtgtccagtctaacagagacaagtatgatgtataataaggaggagaactaaagccacagagcacaaagtgtttttgtatcgtgatttccagtggattgggggtccctgagtatatagggttgagagagaaactaaatctgaggacttggtctccaaaatgggagttgactctttccatttggaattcctgctagttttaataccacaggccagagttggcaactgtgataccttcagactgcccccaagaaaagaactttccactgccaaagggcttcagttgccatcgtccaaaggtcgacctcaagcatcatcgctctttggggtagactagactgggctcagttgtttctggcatattctgtctcaagtcccttctaaagcagtttgccactggggcctcttgagaaagatatagtgagtccagaacgtggaattgtgagctcctgagataccatgacttaagtggtctttgctttgagaaggttgtgccttttgcagtaattatgctgtattgcctaatagaaattgttctcaacccttgaaaaacaaacaaaaaatgatgccatccttcctatggtgagttagtcttttaaaagctccttataatcattgctttgattctcaccctaaccccatgtaattggcaggggtgttattaatcccattttacaaaaagaggaaactaagcttccaagtttgagaggatgagattgctgacagtcacacagccaacatacagggatttgggcacacctgaaggcctctattgattctctgggtgctctaacatttttttgcagaagggaaaggcaatgtgggcagtcttgggtctgatgagtaagaacaattatgaaagagtaccccataaaatccttgttcacaagcagaagccagacagaagagcaccattcctaaagtatgccactgaaggaaggacctttttcattgtactcctagagtggggtacagaaaatgtagaaccagtcatctataaatatcactctgctggagggtaaagaagttcctcaacccatggggaaaattcccttggggtgcactcttggtctagagaagtttctgcagaaatcccctcagggtggggcagcttaggaccatgggtttcctccccctgtttccactgacttaatacagctggtccccttcccccagactcttatcgagatgagtatttattgatatctcaaaacaagagcctctaatttcttgggacaagaattccccgattctgacaacctaccgagaagagcatctaagagagaacaaggcctagaatgaacctcactccccattcaacccccacagaccccatgaatccaaagaccttcttcaccaggcagtccatcccagccatgcttagttggttgtggacacagcagcacggatgagttgaccagacatctcctgaatcatttcaatcagaaggagcacagcagtctgagggttgagggaaataagagagaacaacaaatacaagaggtgaacacttctgtaaagaaacgcttgtagtgaggggttgggaaagggaggaaaggtgaggccaataacccctgacaggatatttgccagaccctcatcccacagagtatcaaggaaatagcaagactgtgattcacatattgattagccgttcacatatttttgagtatcttctttggatgagctgctatttttggtttcagggatggagtggtcaacaaggtaaagtccctgccctcctgaatcctttactctggtgaatggagacaaaccatgatgatgtaaataaataaattcagagatagccagtgctaagaagagagaagagactgcctgagggttgaggaatcctgcagtggtgctactttatagcttggaaggtcaggaaggcctcagtcaggggtgatgttgaggccaagacccaatccagatagggagacgagcaaaggtcaaggtcaggaggcaggaataagtttgtggtgtttgaaggatggaagaaaggccagtggcactggggaaagggtagtatgagatgagattagagacggagacaggggacgtggtaagaagtgtgggttttagtcctatattaggaagcctttggaagattttaagtgaggaaatgtcatcattagttcttagtttaaaagatgtccctggtgtctggatggagagcattctcgggaggaaggagtggaagtggaaggatgaagtgagaacttctctgactcttgctctgacattggaatgtccctcataggacgccatagtggaacacagcagactaaattgtccctagaaataagaaataaggatttggcctctagggtatttttccaccttggttccagacaggtaaacagcagcaggctttagcttcatcctggagagagaggcccataattgtttgaaataattttcttctcttcatttcctttaaagttggtggagctagtgaggtatataatctcccattatgcactgcaccaattgctgcaaaaggcctgcctctacaaagccaagccagtgtaacaagggcctcgcttccttctctgtacatccctgtgcctcctcccccaacctcagcttcttcatctcacaaaggcctttggctatgtaacaatcagaattgtctgaatattgctcctactaattaaaaggccatagaacagagggcaggatgcagatgtgtgtgtgaggtgagggggtggttagaataaaatgaattattaaaaataaacctccccatgtaggtcaggcaagtgaggaaattggagaagatgttttagttgcaaagaaactttaattagaagaaactaggattattaataacacactggggggacccccatgccttcgaacagacattgcttggttccctctctaagttggagaagacagctgacccacatactcatctgtccaaacgtgttagtccaggtattaataattcaccctggaatggtagatcccatgagggcagagctcatgacagtcactggcccttacccatagcttcctaaccctccttccccaacccagccttcccctttcacttccacccctagctcctcattcactttcattcagtaaccttcaacatttcacgtcatctcatccggagaaatatcaggtgcggacattccatttctggaaatcctgtgatagtatagtttaacgtttgcatttctttccatttcttcatagctctctatcaaggaaaagagtcaaattcagctgtctggccgaggagcaagttctcagggtctactatttactcattttctttttctatataacaaaccttgtctaatgatttacatttcttcccccagactctaaaagtttgccaaagtgtggactcctagtggacaagtaatgtctagtttgatgtgtttgaaggaattttctttgacttcaaatcattgacatatctttgatttattttttttctctttgctgccttggaatacggcccctactctattttaactgcacactggtagtgatatattgtgagtaaaacgggttcccagcagcccggagtccagttccccctgtctttctctagaagagatactcttttaattttctgtacagttttagtttcccttttacttttggtatttatgttgcatgtagcagtgacatcatgccccaactccttcatcccccagagtagcctggagccagagagtccccagggagcctgctctccatccatccaccccagtccccgggctctggccagcttcgggcactgtcttatttttctatttgaaaataagaccttgacaacagtgtgtttctcttgaaggccttgtctcaggacttttaagggacactgattaggctgaagtaattaccactataactccagatgcttcatcagctggggtaattgtcatgcttgcctttgataaattatacttggtctcctttgttattgagcttggattcctctcctaaaggaaacacatatgccacatatatattcccatgttgtgatacatatatatatatatatatatatacacacacacaatatgtaccatgatgtatcagagtatatgtacattcttatatgtaaaaattcatatttttacatataagagtagagatattccatagagtgatgtatttattgcagtacatgcttctctgtatgagaagtgcttgctagataattaattggttactcaactttgggactgtaagtatctcaattgtcttactggagacaagtatttgcacagtggtaattattatctgcagtctatgaagttcccttgctttacaacaaagtttttcttttagtcagtactcagtaggacacacccagttgctttatgaatgttagtcagacatcttggaagatccctttacctgtttaaggcagaaaagctgactggaggagaacattccatttcagcaatgagcaatgtataagtctgaacaagtcaatacaagtgtctgaacctctaacttactcaaggaataggatgcccttttactcaacaagatgtggccattgaggaggagcttttaaggccagcattgagctttgggtctttattcatgtttgtaaggctctactgaaaaggagacccaatctgtggaacagttcagtccaatggctctggaatttggagaagatgtttcaaattcagtcccctcattcctttgcagcaaaagaggcaagttgatcatctgattttggttagtcatcagtgtttggagggtatagattgctcactttaaaaacaaaacacaatgatgaccttcttcaattcaatgcacagtcttgccaaaatcgactctgtggctttcttcatcgacagaaccctttaaacatggcttgagggcatggcccactttcatacctgcagagctgcatactaaattgaatggtccttcagaattggagagaaaatgtggtgtcaatcaaccaacaactctagtgccaaatacttctgccttcctcagccacaatacagtcgttaggggcagaatcaactagctcagtgtgctctgtgctgctgacattaactagctttttctttctcctctgtttttggaaaaccacctggaagacctttcttcttactccagaaggtaatgggaggaattttgctaagtgaagacatcatttctcatttataggacttgaaagaatattctctgattcccagtgccacatcaaaggcctcaccttaaatcctggtggactttttcttccgtggatatttttattagtaacgttagttgctgcagagcccatgaagagtagctccatgtttcttgcttggaaataatccctccttcatttgactgattttaaaagtgaggctgtgacctgaaaagtatctattgattgaatggcagatgttttttttcttccatcccagtcttcccttgaatttgctccatttgaaatctaaaacattttccccagcagttggaaaactccacctgggcccctcagtccagtactgctttttcctgcctcttccaatccaccctggaaattaagattctgcattggaaattggctgacaatttggttgctgatgcaggtggcagatggtgctgaggataggatggaatccaattcttccttccattccaggcttggctcagaaaggccagccagcagagaacctgagtttgacagctgattatccatttgactcaaggaaagagcagtaactgagctgcatcttcaccagccactttccaacaggtttctggtctcatgatcatggcctttgagaatagaggaaaagttgtccaagaacacttctgagaagcctttttgttttaaacactcaagagtaaacaaatagttttgatgatgtccattagggaaatacttctattttgtctctgtaaatagtactatgaagttatgatggaaatgttggttgaatatccacttcactgtggtgaagaaaagcacataaaagctttttctcaaattgtgaaactgccaggacctaggtcttcggaggaaggtgagactcagggtcaaattcttagcaaccacataacctcatagaatccatggccctggtccaataacaagaaccttatgatgtgaaccagagggtaaactgagtccctagagccttgtatttctgctttcctagagttaagttggcctatcggggcagttaattgagcatgaagtttcaagagccctaagatggaatgacaagtagctttggtgttcacacttgccagagacacactcttgtctgctcccagtctcaggaagctgcagcagggctttaaaaaggagacgcagtcagctgccactgaaatagtcctcctgtgccagctgtggctgcagaccctaggctcatctcctaggacctctcaccctttcactgcccctacccctaatcatctgctgtggatcatgagaagccattgaattgaaatgacactgcatatatttcaattctcagagacagcagggtcctctttctgctccttttggagaaaggctagttccaactgcccatgaactagctgctcttccacattgatccactagatgtcctcatagatctactttgtattaccattgacatcctggggaaaaccttgtctgagaattgggatttgggaagggaacaatgggtgactacgtaagaaagaaaattagcaaacaccaaaggagagaggatgctttgtgtggccagggagtagataagaaacttacttctgtttgaaataaatcctgaaattttcaaagttgcactttgagacctaaccttgggaatttaaagtggaactcttcatatctaaaattaaccttctaacctaaatcagctctagaaaaggaaacagtcactgagaaatggaaacaaaacaccagtggttctgaatatccatgattcactgtaacaaaattgaagggttaggaagccagagagagttgagagagatgaggggtggtaatttccaaattaggaggtccatgacttaactttgatataatttaattttacaacttaagagtataattttacacagagagtgttcaattcttctggaacatctaccaccagggagacaactcctcatcagcttttagttaaagagtttgttcatgatttgtataatggcccagaggagagctcttcctggccagtactcatatccttcaagcctgatgaatcgctccaccagatgggaggtcttaccttttaagaaagtggacccagaagtctctaggtgaagatacctgacagggagtcaatggaaatggactatgccagcagtagcgaaaaagagccaccttcccagttggtggcaccttgatctagacattctgattcatgaaggtttgtcaacatgtggggctcaatagtttttaactgtttctgtcttgtctttgagcctctcattgatcgttcttgctgattttgtgtgtgtgtgtgtgtgtgtgtgtgtgtgtgtgtgtggtggcacttgtttgtcttttgagatttctattttgcatttggtgtgagtgtaaaaatgattgggaaggaatgacaagtaatagcatgttttcttttttatgcatatgctgctttggaatgtgactgcttataattaacagttaatcttcttatagcacatggttttttgctgcttcgattaccagtttcagcctgttcctgcatgctaacaataagaaattttagaacaatgcatggtcgccagaacggctaacaataacagttgcaaacagtccctgagagccactggtttgtcactgtgtttcctcctgaactcatatcaaggaggaggtttacatcacccattctgatctgtttgcctctgaacaaatagtttcaaaagttatttcatccccatcatccctccccttatccttaaagacggtatatttataagaactttctttctccacaaatgtgtcagattctattattgtacataaacccaaaatggcagtatggaaatgaaaaccagggaccgttgctaatgagaagcatagcattccagagtttgatgggcttctcttctgctacagcatttgattaaaaaaattgtttttcaaaatgatttatctacggtgaagcaaaaaaatcatccttgtttccctcttctgtgtaaataacaaatcaatatttccagtaaaagaaataagaaagagaaaacaagggaatgtctgcagattgtatgccagatccggatgcatttaagataaatttatgttcatgtctttaattgaagacttttttccctttcttgacttcagccgttgctgtttgtttgggatgtctgggcattcacaccatgccttctaaattcctctgattcaaatgctatagtggaacttttttattttttatttttttttggtaaaagctaaagctcaaaggaatgatataccaccattgaacagggctggggctgcatgatgatctgaacaacagactagctaggacactaaaagaacatgtcactaaaaatgtgagccaagtttacaagaatggagttgctgctgaagagatctctcattcatctcccccagtgcctgttcttcacaatcataacgttacccttgcttgacaaatatactgtatggcaagtcataaaggtcttagaacaggacttgacccatttgagagatttaaacccctcttcctggtgactgtaacattcaaagagggcaaaaccacaagccatattttaaaataagagtgcaaccattctctacaaagaaaaagaaagagtgggggaaatgactttcaaaatggaaggtgtgggtgcagggaataacacctcctcagtttaggtttaccatttggcagtaatgcttagaataaatgtgaattcttctcccacctcgtgagagaagcaggccagttcatgataagtgataagcaaacatgtttgcctgttgtagcatcaaaatgaggtacaaaaaccttctcttgtactgaaatataaattggcttgaaaggcaaaggtgaagggcattggaaactacgatgctgacttccaacaacttttataggttaccactcagtttggatccccaggcagtgcagaacctaccataccagctttagaagagctatcaatgctgcatgcaaattgcattaagatatttcacgtggaacctattcttctatttcatgttttgtcagttttaatcgattttggcgaatattttctgtataaggaaaaaagaaataatatgattaaccaatagcctgattgcttcctgaatttctatttggtggggagagaaaggcagatgcgattttcagatcctctcagctttaagcagaaaatacacccatgagtagctaaatgcattccaatagagcaacatctcatatgcttttggtgatttcttatttgtgaactgcctttaatgtcaaatctgcagcgttagtcttgagtagctgcatttcttatatggacagatttggatatttgttctgtcaagagtaaatttaaattcctgtagccatcatataaactcactctcgggaagttcagcaaaggcatccttagatactgtattaacacgtaatcgtttcacatctaatttgatgaaagcttgtcccagcctctgcctaatgcccagaaatggatggaaattagaaagcctacatattagatatttttgcatcttgcaaaaaccatttattataccaaataagcagctaatttcattgattggcagtgtgtatattttgtcctcctgtattaatcatatcaggggaaaagtgttggttacgttttttgctgtcgataatttgctcttcttcccatttgagaacccgagtgtattcagccatgcccttttcctgtggtcaccgctttacctaggggagaaaaatcatgtgcaacagccttgggagacgataaaggcaatttatattttcgctgcttttttgatgtacaaccaaactgttaccaacaatcactctgcatttttttctgggtcaagactgttaaagtgaactaagacctgtgttaaatcccttcagctcccttccagctgccttgctgtgtgtgaccttgccattaattgccgctcttcctctcctcccatccaaccacacggttatagccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctgtaagtttaacctcaacacacgtagttccatgtttgtgctgtctgtggtatcatccctgtcttgtgctgtgccctgtggttctgagtcagtcgggctgatgtcttcttcccagtgtgaactcctgtgtgctgacatgttgccccagctgcctatgtctctgtgtacgtgcctaggaaggcctcccttctgattttcttaacttacgcttctcgtaacagcatgcaggactgtgatattacagtctggtgatatctttcctctctctcctttaaataaatataaatggaaattaaagtgacagcatatcacctactgtattaatacagagatatgcagaagtgtacatgttaatatttttgaaatggctgtaaattgaattgtatcaaagggaggaaggaaagggtgtagcgagaacaagccagctctagcattgaattgcttttagtgagcttagatagtttcttagatagtttccaaaatacaacagagttttgatgcagatggatatatatatatatattttttttttttttctttttactatgtctctctaacctgtgcctcattcctccagtgccagattttgtcttttgttctggaaacgagttttctatgtctgtcagcctgcactgggctagtggattacagagctttttctcagaatgatgactattttgaaggactgttccattaatatcttttatttttccaatagtatagcccctgtttaactaaggtatcttgcagcaattgtgattccaaatgccaacaaaaaatttaagtcagaaacctctgtgatatccctgagtccatagcacaggcctctgatgtcagtcttctttgtcatccacaagctcagagatgttaaagaacctgtcaaggctatgcagctggtagctggcaaggctgagatgtgccagtttcctgagacctcccttatccttgcttccccatggactttgctgttttcctgatacggttcataagtgaagttcctgaaagctccagtttgagaccctgggactgtgggtcttggtccaagtgcagaaaaggctgtggttccactggaggactttacttgaagtataactataactttgttttcatgttttggtagcatagaaggtaggagatggttctcgtttctgcacttcctcccttcctctttaaagcagccaacacatatattgctaacctcttgctccctgtcctctcaccttccaagtgctcagagctggttgagctacactttcctagcaggggtaggtgtacactgacgacaggaggaagaagatcactgagctcttaagcatttattcccatggaaaatgaactggcttgactcccctgtgctggtgttgaggctggtcccagcagagtgcggctgtgtagccgggatccatgaggcctctagggctcagggaaccgggacttcactgtgtgccatgccaggtgcttatgtttgggcccaaagttcaagtgcaaagcatgatttgtgcatcgagccatattagaggcatttggaaaactttgatctaggaccagagagtcattctctctgattcacgatttcctgctgctccagagcagtgccaagggacaggattcacttcaaagtaatacctaatggaggttgcattgagagggagtgtggactgccatatgggcctaaaatcttggaaagatttctgttacaatccttagatgctaccatatgaatccttatcactttattttcccctgaagagttatctgtagtttgcatgccattacagagataagctagggcacagctgcacagagaacttgtctgtctacgatgtgcagcaagacaccaagttcaaagataggtgctggggaggaagagcagaggagggcctgaggtggcatgaattggtcacatctctttgactgatggtggtgaaagtaaccacaagcccccgggttactcttctgcctaatgcacaacttctgttctcaaataatcatgaggctctaaaaccttagcctagactcagtggagaaaagaaaggagccactctggctctgagctagggccccttggtcatgtcttggcactggccaacaataccaatcacagcacactctgtgtcccccatgtagaccccatggtgcccagtgtgtgtaatttccattatatccaagagaaatcttaattagagggatttctcagctgtgcaatttaatccaaccattgatggagaccagggagaagaaaaccttggggtgggattgtcccattctctaagaaacattctgtgagtggcatgttgtccctcccttgcctccaaaatcagcccccaccagggaacacgtggagctttgggctgcgtgttgaagccttaactggtattgacagctcagggggcgatttgccttctccgtttcatcagtcgtcctgccgtcatcactccatcaaacaaaagcagatttcatccatccctgtgtgagaccactcacctttgaccattaataataagttagaaaaatccattccaatttgagcccctttttgggcctgcataagcccttcttctccaattataaaaatgtctgtctctatgtgaaattccactggcagtgctccaatagcaatccccaggcatccctcgctggtggtggagttgggtggtgcccatttgacagagcaagttgactcaagagcagtggtgagagtgggcttttcattaaatatgaacagatgtgaaatgtagagggtttgacaattagaaatggcaggagaagggcccttgaatcaaagtgaggtcagatgggcggatcagattacttctcttacattctttagttgttctgaaaatcattttgaattagtgtcagcagagccatgatgagttttgccctttgtcttttatgctagggctgtattgtttcccaagacactcattaaaggtcattatactattatggagcttgctttggtcgcagtttcccagttgagccagtgtgctttggagactgcctaattcatttctctctttcctttcgtttccctctttactctattttttttcttataaggggaaaaatttccgttttcaagggatgttaaattgaaacacaaagtcccattatgtgttttgtgaagtgggaagagaagtagctggttcccagaggaatggtaatatattaaaagtgctcacacagttctgaaaacctgccttctaacaacaggggctgcctgctcggtgcacccctctatggaggtgtggcccattactgtggatcggttgagtcatgtgctattatgatagttgtcttctgttgaactcaggaggagatggaaggccagactgtgttgaccaaaagaacttcagaggggaaggactagtttaggaaagacaaaaatcaaaataaaaggtgtcagaaaagtaaggcaaattgtgaccgataaggattcatcacaaaaggattttatttctggcaagactgaaatgttcaatatggtaggctagaatcagtgcatagagtgtcattttatgatcatcttggttttgtttccacttcagatggtcctgggcaagagtcccagctctctcaaaagacatcaggatggtatgggcctcggctttttcacaagtagctgtgttctagtactattaaatgtaaaaaatgaatgtctagcaacatacacatgcacataaatatagaagtagattccaatcagtacgatttcttcccactataattttgtaaaatggacctttctctctctttagaagtttattcttgttatttcagtcttgcctgctatctgattgctaaatgtaatagaaagggacaattaaaattatgatgcagtggcaacgtagggccatactgattcagacctgctgagacctgcctgacatgattctagtcacaaagcatcagtaactctggcacaaacaaattaatcctgtggtagaagagaagcagacctttagacttgcacttggaaccagctttagctaaagtacatgtgtgattgctcacaccaacctttcaatttactaattgtttaaacctgcacaattacatgcagccttttgcaaactactgtagctaattttaaattacacatgacttttatttcgggtataaatataatacaagaaggcattcaactccgatggttaagctgagagaagtccaatatgattaggttgaagggagacgtaccaaaatcagtttagtgtaatatcgagtcttgtcagataataaacaaaaatcagcttatcctgagtagcctttggtttgtgcagacagagaattaacattgtcaatagaactaaagtcacttaagtgaactaatggcattttgaagtacataaaatcagatacaagggcagggggtggaaacagctctaggaaaatgtctataataggacacaccctatcctgacagtctccaacgcctgttaaaggagagttaatttaataagctacatttaaaaatcaacagcctataattatctcattccttttatgtgcagttttaggtgacttcctcaaattccccaaacctaaattctatttgcttattttacttctgggccctaaaatcaattactcccctctttccaccaccactaccagtgagaaaaagacagaaaaaggagagccaaggataataagcacgaatcgatgtgatcatagtttttcatgtattagttttaaagcctgttcgtctgagtctccattttctcccatcttcccatgcttgccgtgctgatgtgagtgcgctctctctctctctctgtgtcaatatccatcacacatgtgcacaccaaacactaccagagcctttgggttgtcccctggctctttagttaccctggcccatgcgtcttgatttgaccctttgtacttcattgcaggaagtaaaaacagagtggcagatcggcctaggcagccactgggtcatcccctgtgactaagacctagtgatgggcctggaaggggcttcttaagacactcttattggtagcaggtgaggctacagaagccactgcctcttgcttgattttgtgatagccacgctgagccataggttgactggaaatatgccttactgtgggccttagctcactctgtgcagtgggcagcttcttaaatcagcattgtaaggcagaaatcatgcttgggcaaaattgcctttgagaaggatcctttacatcgctcatctgtcaagagctcccaacacactgggttcttctccagaataaatagctggttgtttcagttgagtgtcaggtaaagtcactggcttgtatttggggaccttgttgtgctttcaccaccttccaaaaaaagagtatggttgaattcctgaagatgaatacactatgaagatgtactgcaggtagatgaaaggagacgggaacagtaggcaaaaggcagccaacttctcaaaagaaattctttgaaacaggattgggaaacaagaaggagaaaggtcagaatgagggaagctgacagggtcctttgtgtataccccatcatgggacacctttcttcccagggacaccatgctgtaataaatgactcggctctttaaggacaaactagaaaagatgttggcatgcctcatgtaagcccagaagaggcccttatgcaaggtgacatagaaattatgtttgcttttttatttcaggacagtggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaacacaatgtaaatgcctcctatgaatctacattgtattcattatcatttaaaacgttaattaagtcgaagttgcatttaatttctctctaaatgggcctctgggaagacgcttttagaaacatctgtgggagcgtgcggctcacggagctggagaatcccccagcccgcattcaggatcgccccctgagttgattgctatcacgtgtctgtggctaatttgttgtgatgtgattgggtattgtctcaaattagtatcagaccaataatggtgtgaagtcactcgagagaggcttgtggggcagtggcacaggcttcactgcatcctgccttccttccccatccagacagaaacggacagtgggtctgcagcacctgtggtttccatcatgccttgggattctccttctcatatggtgcccatcatttcagttggatacttccttcatcggagatggatgcttgtcatctggcccagcacatttaggacatttgccagcatgctcttcaaaacgatcttaacatttgggatctttgactcccagtgaagcctagaagctgcaagcacagagcagccaaaaatggaaaccagaatggagtggacctagtaatcataagcaggtcatgctcattggtgaggagagacagagggaggcatactaccaacatttgctgaaaaattatgtttctcttttgaggctagcatcatgttttagtcttatctgagcatggggtcactccccaaagagatctatattctgtgtatactgcatcaccaagggagtgagacttgttgacacagcattactaagaaatggctagttggttaacttggattcatgttacgactagaattagtgtagtctctactcttactgtgtgcaagcaactctgagtacacagggaggatgtgtgtatgtgttgttgctgttgttaaatttaacacttatatagcatttgctgcattacaggcactactccccctattaccacaaatattaattaatttaacccttattatgtggtaactgctgtttgcagttgaggcaactataacctgagacatctgcaatgtgccccatttacagataaggcaactaaggcacaagggtctcatagccagtgagtctggccaagggtctcatagcctcatgtcacagtctcatgacttgccaagggtctcatagccagtgactggtggagctgggatttcaacacaggccgtgtggctccacagagtgtggagtcggttgagttgctcagttactcttgcagttgaatatgatggataagtcacttaatctccaagggaggagaaaaaagtgaggattctggtaatgaaacctcgagataatgtagagagtcctgggggggcctcctgcacagcagctggccacccaatttggctagagtttaagacttacttagcatgcagggaattgacccccctgaagggtaaaatggggccccattcctggcaggggccaggccaagggttttgttcttagtctgtaatatgatagaaagtctttagacagtgcgacactatcatattggtgtttgatcagggaagtgacctaacagaggctttgttttgggagggctgctgtggctgcaggggaggaagggactgactagaggggagctggaagcccccctctcggggaggagacaaacagaggggagcctgttgtgggcgggccccagctgttctgagaagccttcagaaggaagacttgatctatagtctgcaggaccctgcaggtgaagcacattgcccagatgcaaatccaagaagttacagtctttaaaagacagtttaattagtggctctggagcagctgaattccatgagcctaattctccccagctgacctggcagccattgtgattcctagctgggtttgctagagtttccttcttattggaggaagatttcctgacccctgacccaggactaggagacccactcggctgcatccactaccactggccttggggatctactgcttctgtttccttttcctaaccattatttcttccttattcctcatcatcttccccagttcaaatatatcttacatcttgagtgtgttgaaggtgacaggcaggcagctctcacctgctggtgtgaagtattggctcaggctgagcagcagacacaaagcaagtgggagccaccagtggggacagctggccagcgctgaggctcttgcttccagctgcaggtggtagcttcagttagagctcatgggaattattctttaaatccctgtatatggcaaggagacttttctcctcctttctcaggaagtcagcatgtctccttacatcgatggggggaaaataataaagtgcttcacatcccattcactgaaaatccactgtagttttcaaccacttaaccttctcgagtggaaatacaaaacacatttcctgtgaagtactgccacacagagtcctaaagaagtcatgtggcatttctaagtatcatgcacaattttcttttcggttttactgctttgtgcataagacctttgtctgtgtccttacttatgtcagcatccgtgattgtggcatttgtgtacaccattgacctcagggggtcattaaaactgcatggaaaagcacttgagtcctgggttccctcatggtggtaggctgtgcatgctgagaatgccaacttctggaagtgcaatgtggcaaaatgcaccaagccaaccagctgtgtgttgtccttctctctctggggctttctccaaaaccagcttgttgaattacctggatagtcaggggaccctccatcgccacatctgcttacaggggttctgcttccccagctgacctttttcccaaagggaatctaaatggacagagctaaatccagcattgtcagacccttgcatttgaaatctcagagggaattgcaaaggcctttctgtaaatagctagatagtgcctgctttggagggagattgctacacatgcccacagatttttattctgaggagacattcttttgatgtccagctcagatgagcaggactaacaaaagtggcctttcttctcagaccatctcatttggtcatcctcagggggagctaatctctcatattcaagggaaacagcaagaaaaaactcccccagccttttctagtaaatctgaaagttttcattctagccccttcaataccgcaagatgagtcccaccaaatgttcctagagctgcagagaaaaccctatgcaaatagaaaatggaatcttttgaggcagatctgcattagggatgatcaactgcactgagagacttataaatgaagtgagaaagactccagccctagagctggcactgcaccagctgtatcgacagtgcatagatgggcatctgcacaccatagagcatgggctatcttctgggaagggagctgactgcttgcattaaaatgatcttcattttggccaatgtcagctttctgggctggagcctgttggatcacactcagtcaagaaaggacccaggggctgccttccctccctccaaggtcaaaaatgtagcatgctgacatccttggctgggcttcctatattggcaagaatacttgaataggaaatggcctgaaggattccagttcagtaaatatttcatgagtaaaagaatgaataaatgaagggcttcccaacccttaaaggaattggtgatgtgctagaagccagatcgccctagatccatgaagcttcccaaaactttctaagcagcaacttactatatagtatatatatgtaaacataaaaaactgggatgtacaagaagagtaagagggaaaaatgtagtaagaaagaacaaggacatgactgaaggaactagaaaatgatcaaatggcaggtgcaattgatattctttgtgaaggataaattatgggaaagaagatctggaaacaaagtaccagaaaaaaccacataggcaaaaatccaccaatgcttccaatgaggagtggcagggttactaccacatatagagcatttgctctggaaaatcaaggacttgtgacattcacattcagttttattaatttcagcaaacctgattattttggtgtgagtcagggcagcataaaaccaatgcattgggcagggctcatgtgaggaaaggagtctgttgtagctagagaggtgtcagcatctgcaggtgggcacatcaacctgcccaaatgtagagcaacattcgaggccttttatggcggtcagggtaatttgactctgactcgaggtaggcagcttgaatgcaacagcagcacccaaatgattcctcccgcgtggaggtatccaaaagctgaatgtctcatagctattacctattaggagccattattctgtttgttctgctcaagccaaggaagagttttcctgattgttctcaaagctctctcaggctgcaccaagcattcccttacctttgaatggttctgaaatgctctctgcattttgtcaaggctgatctggccatttcttcagtgcagatgagtaaatttccacatatggcctgtaacgtatccaactgagagaacatatccagcagggatgcttcaaaaccaaagccctaaacagatgttactgagaagggatgcacaatgacctgcagagaagagagatgctaggtgaaaataaaagctgcaactatgctaggaatgaagacagggaggaaggggctcaggtcatgtcacagggtctggaagttagggcatgaatgtgaaatttgcaaggggctggttgctggaaacactgctccttcacaaacatcttctattaagatgaagatgggaaacaggcagacatctcctgtatttcctcctctctatgttaggggattctgatgccattcccctcactgtgcagtgaactgagagatcttgttggcaattacagcctgaaattctaggaaacgtcagagcaggcagatacaagggtgagatctgtgcattttctggaaactttggaagtaagtcctggtgaagtcatgctttgacatgttcaccaagtagatgctcatggctataataagagtaatgtcttatgtgtgtttgagtctttgtgcttctcaaggcaccaacatcatctcatttcatctaggcatccccagcatagacatcatgtcctactaccatgtgactttgagtaagttccagaacttcactattttttagcttcctcatctataaactggagataataaggacctatctcacagagtggttgcacgaattcagtgagtgaatatatataaagattgcctggtatatgttgaattattatttttatcatccttcattaacatatgaaattaacaaagaaacagagatgaacttgaccaagatcacatagcggatgagtggactgctagatcagaagcttgccatctcccatagtattgatggaaataataatgataagccactttaaccataactagtgctttttttttttttcaaatgactgactgtcatcaagctagccttataagaggtcatatcagctacaggcagagaagcccacagatagtggctgagagttgaacagcttagtataacagactataaaagttaaatggagtcaatttgtttaatttctaggtcatggaataattgtcccaacagaaataagccaacaaaaataccaagagacagctatatctccccagaacattgatttccatcttgactatccagtaggccttgcaaaatttgtgtgtaaaatgaggaaattggaaggtcatatttctaagtttcctttaaactctgagactctgattatcttccttcttctgattgagaaaggctaaaagtcctttttgcttcaacccttactgttataaatccttctaaaatgctgatgtctattacccaacatcgtggtaggtcctgtgaggaacaattatgtgtgtagaaacctcgtagtatatcagtgttagtcttctgtctgtgagttcgcagcttctagggcaggaactgggcgcacagggacacaccgaaagagcccagaagattcttacaggtttctactttattgtcagcttgttttcttccaaggtgtcttttattttcctcaaggaaagcacagaaaaaggccctctccctaacccggggtcctggtattatctatgctccagtgatttgggggttattagtaatcagaacattgtcagctactgaagctatcccagaccagttcatatgcagtgtctctacaaatggccctgccctcccacaatgaatgctaactgttgacctccccaaagagcctcctcatcatatttgttacaccttgttttgttattgccaggtctccaggaatgaaatcgtgtagcaggaagcatatagggccaaacggggacaccatctccaggcaaaagaggcttcctagttggaatagtacagatttgatggatgaaaataaatgtgtgtcttagattttagcccagctgttagaatccttaggtcctgggatcattagaaaactgtgacttcaggtctcatcattcctcatccccctgaaaccccttctttatggcttgtccatccctaaaataggtctggagatcgtcagcaaattcaaagtgtttttgggagagggagggaaagttggaacacaaaaagaggagaacagatggggaaagaagacattcctgtcctttcaaattccatcaaaatttcttttttgatgatggtcttgatctcaactcatctttttctgttgttattgttgttttttgagatgggacctccttctgtcacccaggctggagtgcagtggtgtgatcatagttcactgcagccttgaacttttaggttcaagcaatcctctcacctcagcctcccaagtagccaagactacaggcgtgcaccaccatgtctggccatatctttgaggtccagttggtgttgagacttcacatcatcacctttcctaccttgctttatgagtagctgggctctgtttcttgttgattttgtaattaattagatgagtgcttggagcaaggccaagactgggcccaagtttttcacccatgccttaccactatccctttctttcagcagacctgatgtgtggataggtctagggatgagtggaatgagtatcaatatgcacatttgaaattctgagttttaccctgtaacactctctctttcctcctaccgatggccaagtcctctgatttggcctccagattacatttcgaaccttttctcaccattgccagtggcactgccaagctcacatgctcatttcttcttcagctagtctgccattgttgcccttcaacctttcaattagttcctcttgccaccaaaccaccaccaactttagtattctaaagcacagactttgtcatgttatcccattttaaagagagagaccttttgatggttccttgttttttaagaggataatttccaactttctgctattaaaatggcattcaaagccctttgcagtttggcctcaaccagtttccctagttccgttctccacataagcatccatcatctaacaattctctagaagcgtcttattctcattactttacacatttctggaaccttttcctgagactgtgattcttttcctctctgcttctagcagattaaaacttacccatccttcagagcaggggtcagcacactgtcccatgggcccagtctggcctgccatccattgtagtaagtaaagtttccttgtaacatagtcactcccattcatttgctcagtgtccatggctgctttcaggctacaactgcaaagctgagtaattgtaacaaaaagggtatggcccagaaagctcaaaatatttactatctggccttttagggaaaaagttggccaacctctgctgtgaaggtacagctcaagtactgccatctctgtgaagccttcttaactagcccacccagaaaccaaattagaaaaagtgaatctcttttctgtaagcctgtaacatttcatgtaaaccccattagacagtttttatgttgaggtttttgtagaagtcaaaattggtctttgaattcttagcatattgcacacagtaaccaagacacacagtgtgaattcaataaatggctgattaacatgtaaactctgttgagaatatgtttccatagtttattaagcatgtatctcaaggaaaaaggtctttcatgagaagctgaaccagaggcaaaaaaaaaaaaaaaagtctcaaggctagagatcttcctttcttccttcttgttcctttataccttcttgaacagaacctttgtttctgaacagccaacagccaattcctttgactgctggacaactcttgaatagattgatctcaaattgatcactgcttcttctgaaggtaacacatttgttccgttgtttctgctgacagcacatggtgggctctgtagtggatctgggggtgctgatgttttctccttccatatgtcattgggtatttgagtcggggtaggaagccatggcaaacccattgcttctgttcatccacctatgtttccttattgatttgaatttatcccaaataaatttggatatttaaggcagggtgtgcacctttaattgttcagaccctagccaatggcctagaccttatctcactggactaatacacaagctaacactaggagttatatctaggcagggtaagcccccaactcgaatcttgacagccctgaaccccaccagattccccttcaccctttgcatctgtccagaattgctcctggaaaccctgtctctccagagtgagtggtagccagctgagatgggagatgggatgcccatggcctatgcctgagaccctcctagtcaagctccctgtctggataactggagacacttcgttctcaaagcaagcattgtgacatttggttctcttcacacatgtgccttacccagcttagacagatggaagaattgaatgtaaagagattctacagaatgtattggaaataacaaaattgtgtatgtgtgtttttaaaggatacccttttggttgccgcatgagttattttgttgttgttgttgttgttagagattaaatctcaataactttttggaattagaatgggcttcccatcagctgaatgggctacacactcgcctccttttcatagcaatccaagaactccactgccttcctcacatcccctgctatgttatcagcatggtagttttgcttgagatcaaatcagggcaacataggaactgtcatttttcatttaccggggccctttgatcccatttgaggtttatttgtttcaagtgagaaacacaatccctattgcatacatctattctttagagtacttttttattttatttttttatgttagagatcaaatcagagttgtaagtagtatggtcattagttatcaccactagatttcacaggctacactttatttctgttcttacaaaatcaccaaccttctctgttgcataatgatcacttccagtgaagccacaatgtgcctttcttgggtacttgggtgttaatttatttcacagtttcctttgcagatgcaatcagagtcacctatcacattcctgtttctgctttttattgtgttcctttgctatcgcgtttgtgtgatcttttcctgaaaaatgacaggtagtgtttctctgctcactgtatcagtgacatattttccacgacttctctattgctattttaaaaatataacattttatagatgtaatcttagttgtttgtaactaggttttgttataggagcaaatttcctaaatggcatgttggtttaggtacattttttaaagaaagggaaaaatattttctgcaaaatagtttcctctaaattgtaagtgaaggaaaagctctgttagtaagattataatgcattttcctgatttcttagtacatcgaaattcatgaacattatttttatgtaagtgattaagttgtggcttttaataacacgttgttagagcaaaaagagctatcccttttgatttacttgtgtatttactgggtgacttacagtgctttacatattagaattggtttgtcaacaattaacattctaggtttttatataacccatacttcaggtaatataggattattaaactacaaccagtgtgttagaaatctgcctactggtaatacaattcttacgtataacagcagctgagaaatactgctgtgtatttatgcatagattgcaagacagatggcctgcaagccgcagaagggcctgacatgcaggtccaccagcaggtggcgctgcttttctagaaataaaccctctacctggattctaggtactctcctcctcctcactttctgccttttctcttgcagattgtctcctttatttctctaaaataaatatctaaaactgttgttgctgttgtttgaagagatatacttccagtacgacaatgcccctcaattgctaaggtttatttgaaatccaacttgcctgatgcagtgcttacttgaagcaagtccaagttaaatacatgttactgtttttaaaaggtaactacacacacaatactggattcagcactgagattggattgcctatgctatctgattattgttatgtggcaagttcccattttaatctaatatctatttacacaaattaatcccataggcttctattcacctcaggataatgaggggcatttttattaaagtgactgattgatatactgaattaatgttttatataaaaatcaccttagtatgatgttctttcatcaagagttactctagaatccaggctgggtgcagtggctcacgtctgtaaccccagaactttgggaggctgaggcgggcagatcacttgaggttaggagtttgagaccagcctggccaacacggtgaaaccccgtctctactaaaaatacaaacattagtcaggtgcctataatctcagctactttggaggctgagacactagagttgcttgaactgggaggtagaggttgcagtgagccaagattgcaccactgcattccagcctgggagcctgggtgacagagcgagactccgtctcaaaaaaaaaaaagtaaataataatactaataaaagagttgctttagaatccaagtcatccaaagaatattgcctttctctcggggccagaactacattttgacaaacaggatcagagtttctgttaagttttgttctgttttttaggaagacttttcacagaaaagttgatcagctcatcaactagggcatcataaatgaagagagaaatcaaatgtgcaagcaaaactatttttaaaaattattttgtccacacatacccaatttttcaaccgttttttaaaaaagacacagctatatctttttactgttttttttatggtctgcggtattcctttgtacagaatatttagtgcaaacattagcttatgtgggagaaaatgaatttattgaggttacagaaggggagaattgaaatatgtctcaggatgactcacttatttgtttatgtttttcattattaaattttcttcctttttttttttttttaaacagtgtctcactgtgtcatccaggctggagtgcagttgtgcgatcttagctcactgcaacctctgcctcccaggttcaagtgattctcctgcctcagcctaccaagtagctgggactacaggcatatgccaccatgcccagctaatttttgtatttttagagacggggttttgccatattggccaggctgatcttgaactgacctcaagatatccacctgcctcagcctcccaaagtgctgggattacaaatgtgagccaccattcccagcccttcattattaaatttctacctatcaggccgtaaagaactttggaagcataggcagtattttactctttgaataggatttctctcttttgagtttttaaacttttctcaggcatactgcgctaagggctgcaagttgaggatctagataatgtaatgtatgttcttatttaactcacccatgtgattttcacagagaacatcttgaaatgttattgattcaacaaaatcaaggaggagaggattggggaaacattttcttctcagtgaatctattttaaagcactggttttgttgaaaatgattttttgaaaatatggattgcagtcagttttcatgtaaaagtcaaaccctgacgggtttccttccagttctctgtagaggggatgggatcagctggagtagttgaagacaagaaatagccatcctgaaatcagggtaaatttacctggctgggctgtgaggaataggccttgtgagtttcacgggacccctttctgaggcattagataactttattttcctgttgaataagctctccagaaaaaaaagaaaaatgagaacttcaatggaactggacagttgccaagggcctccctgctttatttccatgcatgaatgtgtgtttcttaccttggaaaggaaagtgggctgagcgagctaggcagtttctgatagacttttccaagatgcaaagcccacccactatcctctttgaacttcagtatttaaatcagaagaaaaatagctttcccagaggcttcagattattactaaatattgtgcaaattctatcatttggaatgtaaacgcttacactctctgccctttatacctccaactgtgccctcaaacacattttcctgctctagccaaattgactttcttacagtttatacagtttagtattttccaaccaccttgccttggttcaaactgtgtcctccacctggcatgcccttcccaccctctactgccactccttagtctgttcagcatcatgggtcaagtgccccctgagtgccaggccctgtgctccatctggggatatacgggacctctctattcatcctattcttgtttcaagtcgtcttctttttcttcctttcttttttttttttcctgaacaattctctctctaggacttaacttattgtctaagacatttcatgtagccctcccttgacattctcatgcaacatcttttgtactgttgcatttatgtaacttatgagttcgtatattcgtatttaatgcaattatctaatttctctggctaggcttgtggttctctcttattgtgcatctttaaaaagattttaaagaaaagaacaagaaaaaggtatgcccgacattaaactcagagtcattacaaatcagagccagaagggtctcatacttaactaatgctcatccccccaggaaagggaagtgtcttgccaaggccacacagttgatccaaggcaggcctagaaccccggggctcctgatcactaagctgtgcttctcccctttgcaacatcgcctctgtagctgctcggagctatttattgggaacttttcagggcccagcattgtgagagactcagtgatatgtgaactccaacagaggagcttataagcctagctgggggagtagaacacattagaattgaacacaaattataataatgcaaggcatgagatcagaagtgccaggggattttttaaagaaaggagagaattgatcttgtcataatcatctgggaaggccccctggaggaggcagcctaggctgtcccttcaagggtggtcaagtagtcaggtgaaaggaagacatggtgggagagcctggtgaaggagtcactgcctctctaccccgccatgcctctgccccttcttctgtctcccatgtgtctgcatacgccgatcaatcccatgacctcccagcagaaattcaagggaaagaaaagaggccctcacaatcagacggcgtgaatttcctgtaatttagaggaaacagtggggttcctctgtccccatctgtctttcatttgttcttgccctgaatggttccagccttctccaattgaggtccgtttaaacgttttctggcttttcttgtttttatgacatttggcaaaacctaattatttgacttgagcacttcattggggccatatgaaacaagggacaaaggtgacagttgaatgagatgcaaggctaggggtcaggtgggggtgggaatgctcaccccattctaagtgttggttagcggctcaattgcttggggaaggagagagagtatggacccatgtgaattacaccatgtccaaatgtggcagactggtgtggagaaggacccagcagcagagaactctcattgctctgactcttcaaagccaaggcaataatcatgggtagcatttagaaagagctcaccaggaattcttttaagtgcttttcacattttcagtcaattctcacaacaacctattagataggtactctaattctcattttattggtgagaaaactgaagttagataatttgccaaatacctaggttcagacccaacaatgtggctttaagacctgtgtggttaactcttaacctctctacccactcaatgtgagtaggcatttgtggagggatatcccatgccttaaaatctttatttcggggatggtacacttgagtgtcactggttccagggccagaaatgcaaacatggggtgtctgccctatatatgggggtacagtaggcagcagtggggcatttgagcagctgataagctcctgccccaggagaatggcacccttttggaatgaagactcagtcctctacaagatttttaattagaagttagaaatccatatttgtatggacaatcttcagacttaaagattgtcccacatgtgaaatcctgtgtatcagcaggttggtgccaagctcagcacactggggacagtagttggtcctcaggctgtcagcctgcagccccctggttatgtcacataatcccaaagcatctccgaaatttggtgtccttggtccagtagggatcacagtagatcgtaggacattgaggtatggagtaactggtctgagatcagagctctaaagagggtcagagctgggacttgggcaggtggactgactcaagaagctcatatcctcatgctgttctcactcacaggcagaattctggcagcaaatgatctgaattagaagtcagccgacctgggtcctgggtcagggtctgcgtatgagtgcagctatgacgcaaaagagggtgaggccagagcatccccaagccgcttccagcccttctgttgcactccacaccttgttctccaatgcattgaccagaaaggctcaccatacactagcattataaaatattgcacaggatgtgtccgaggataaattatgatagcatacagataaagattttatagttcaagaacatctatagaaggtgattatgcccttaagaaatatactaaatgctgtgtttagtgtaaagtcataatccacactggtccttacctcccaaggttaaaagcatactgtatttctaaagtgttctggcagaatattcttcgtcgggcacctggcttgcactaaaaacccatgcattttacctttatctgagtttgaaagaaattatcagtgcacccatctggaatatatattagaattctagggggctcttgacaccattggctcaatggaagatatggtatttccggatgagccaatagtaataatgttaataataatagtggtttgtatttatataacatcttatggtttagaaaacagtttcacatatacacaattagattctaggctggtctttaaatatcacaatcattggggcaagcattaatttaaagaatgtaaacagcaaagtgaaaatggaaatgaaatgtgattgacatcttctgccagtcatggctatttgaacctgtttgggggtggggggaaagaaaaagaaagtaacattggtgtcaaaatatgtaagcaaataaaaactttcaccccaaagtggaaatgtaaatcaacattgtgttaaccaggaggatttgatgtgggatgtgaaataaagtccacgagagacctgaccccagctctcttttctgtttctcactctgggcaggtggcaaatctcagattcctgaggcagcatgatcttttctccactccttgggatgcctgacaatttgtaaatccacgaggaagtgtttgttgcaagggccttccttaacaatctcatgcaaacagcatgaagtgatcaaaagaaataagtcttgtgttagatttgccttgtccagttctgtggggtggcagaaccagtacctcaaacacctttgagaaatggtgttcagggctggaaattgggcgaggtgagagaagcttttgccctgggcaccaaatttaagaggagacccaaaacctcaggaatcaagataaatgatagtttcatgcaatattttcaaactatcaaaataaaatattttcaaaataatcaaaatttaaaaaatccaggatgaacagaatgtcataattttaagtgaagacagtataaatattgatttcaaagctgacatttaagtactgaattcactaggggtggaaacaatgaggacaccaggaaactagcagctgtagccatgggtgtgagcccttccagggtgccaggagcagtgtttggtatcttacaggcatttttttcttgatacacatcgggggacctgatttgacctacagtaaatccaaatctatttgattataaaccgtcttagaaaaagagttcctttacaggctccataaattccattacagtccactttgtctttgttaaatgtatgggttggaaattacaattcttttattcacaatgatgattttagacacacagctcagaaagatcagcattcacttaaaaaatatattagcatgcttgtatctattaagcactattgctttgtaagctccagctgatgattttattaagtagactgcaaaaggggaagaaaaatcaaggataattataaattcataaatacataattcattggcataaaatgatttaatggaatggatgtggaattatctatttcctcaagaaaataacagagatattctgattaagcctataatcttgtgtatgtgaaattctagccaaactgatggggcacattttcttttctgaaactacctttgataagaaatgcattacaaactcatcagtttggcttcctgttaacaaagagacagcagccgtctggatcattctggattcacagtgaaactgccacaccatgtatcctccaactaaagctgtgcaagtttgacaaggggcagatgaatccaggagttattgtgcagaggtttaaatctatgcggcagctgacggttgaaataatcatctatatatcgctctgagctagctggggaaaggttgaagctgtatattttcaacatatctagtctaatggttaatctgttgtcttgtacggggctctcgcagggtggactggcagcacacgctgacagcttcgaggaattgctcacggtagatgtggttcgccttgctttccaaagtactgggtggatgaatctaacttagcttgagttggaaaatgtgaaactcacctgactcatgacctcaaacacgagcggaccagcagggctaatagcaggttgggtggtagggacagtagagtcactaagctacctctgttcctcccaatgtccccagatctgtgcacttcaggtgggctccacgggtatttcttttgttatttggctgtcttggcaggttgggaagaacattgttctttgtggagactggaaagcaagggaaatgtgagaagattaaactactgcaggggtcagcaaactttctctgtcaaaggtcagcgagttaatatcttagtctttgcaacccatatggtctctatggcaagtcctcaactttgtcgttagagatggaagcagccagggatggctggtaaaccaacaactgtggctatggtctgataaaattttatttatagccaccaaatttcatatctttttagtgggttaccaaatattattattcttagattttgtttccccaatgacttaaaaatgtaaacacactcttagctcatgtgatgtacaaaaacaggtggcaggctacagtttgctgacccctgaacttgagaaagatgagaaagaagcagctgttggtgcccaggatgtggcaggtttcatccctactctaaaagttgtccctcacaaacgcggactgcaagtgctagggcaacctaaaggagtcaggtttaacttttgccacaaagccgaaagttggcttttggtgtcaggagtagggagtagggagagaaggaaaggaaagttgggaggggctgtttgtattggacttctatacattccccagccctcccagttggatgtaaagtaaaaattatctcccatctcctagtaccttcccattctccaaaccccatagcaaaaattcagggaagttctcgaatttttcttttcaattgtgcatttcctcttagaattccatcgttcatctctgtgtctcatctctaagaaactaatacctagtgatctttgcttgagacttttctttgcccttgaggtaatagagagtctattccagggaaaaagaaaagggctaaaggcaaccagaaaattccaaaaggattttctactgaatactgaacagggcggagtgttgggcaatgattctaacaggtcaagtctacagcgaagatatatgagctgcgattctagatatggggggctttggtacatgctgagttcctctcaggatgcatacagaacatagtttgagattggggttgagggcctatggcatgggtagcatgggcacatctaatttacccaattggattctagaggatccattaggcccgcagtattttgtagagaacactgcattccatgtcatgtggattctgttcatatatttatatagtattttttttctctctcctatggaggagctgaattctttcattactctgtgttgatggactcaaacttacacaattcaggtttcctaggcagtgaatagagccagaaatacaccctgtgattaacttctacataacctattgttccttaaagtctccctccccattttcctattagctccacaaaagccagaaatgcaaaagctccaacaagcctcccttccctgccctggcagcctaccatggggtgggcactccctatgcctgtcctagggcagtacaggtcacttagacattttttgaaattcttattctgcataacgatagattttttaaaaactgatacccattaggttttccaagtaaatgtgtttcctatttcctagctagaagttgtgaaattatcctgccagaataatgtatatgataatgtggttgtttgattttagagaggtgtatatgtttgagatattatgatcgttggggttgcttttaaggggcagcatctttcttcttttcctaatctgtggattaatgttagccgtgatgtcagaggttgcagtgaactaagataacaccactgcacaccagcctgggcaacaaagaccccttgtctcagaaaaagaaaatattagccacgatctttcaaaaaatagatttatagttgatttttatgaagaatactgcagtgcttatcaaacttcttagtgatatgtgctattcaaggttgtcaggcaagaaactctcattccaaggacatcacccactttaactcccctgcaccctgatactgcccactactctctgggcgtagaacttggctccattgcctggcttgcctgatcctagctgtgcttaatagctcagcctcgtcgatggacacatggcattccccaccacgggatccatcccgaaacagcagtcaagtgctcctttacaggaatcatactaccaaattcacagtatgggttgttcagctggcatgtattattatttttgtggttgttttcccatcatcgcttaaggaaacaaccacaccctcttacccgtctggttcgtgtgagaaacagccaggcaccattccatcctccaatccagagactgcgctcttgtggccatgccgtaagactttgagagttaacttgcacaaactttctggtgaaagtcttaaacagtcatatcagagagagcttaggtcagcttgggagttttgttcatggtgaattacattttgcaacacgactgttgtaaaattccaggaattttaccatcactccatacccttcattttagtaaaacaacatttgaaacacccacttttcactggtgtcgctgacggccgaaggaaatgccgtggatctgtctttctgaggagtggcaaactcacggcatttaatgttaggcactgataccacaactaagggggctgaccaagccggcagttcgagacagacagcaaaagtttatcaccaaggattgatgactcggaatataatgattattcagtagaatttgttttagcagacttcaggaaagaatgggtctgatcctgctgctaaactgagttttcggtgtctgtacatgttgtggggtgacggggaactcagtatatttttggaaattataccaagaagattgtcttctgaatttccagaagtattatccctactgatacagatgacaataagacggcaaaaagaattgcaggaagtcatcagggtaaaagaaagggaaaaaaatggcaattcagctgtgagggagaaacttccagtttgattcaaagctattcaatgttaaaattgtttggaacttttctaaaagaaatttcactatggattaatttccattttcttttctccttattgtttggcagtcaaggttgcagctagatcacgctattccaaagatccatttgagttcaagaaggagactcccaattctcggcttgtgaccgagccaggtgaaggaagactgggacccattcccatttttaataactaccctgcagccctcaacattctactttaccatgctgagctcagttgaagaagagcgatgcactactgtggatttcagcttgcacttagcttgttgggcagcaaaataccaaaagggaaaaccgtaaaaaacgattaataataattaaaacgacctcacccccaaactggcagcttgtgcaagacttcagtcggaagccctgttagctagatgcctttgtgttcaaaccactttgcatgactcttattctgagtgactccagtgtgaatatgacattactaatgacctgctaagtgtgtacagatgtgggtttctccagatgtggtgattaataacataatggagatagcggttgactcatgtttatgagttgtttgccttttattacgtttctgagtttatttgctttgaactgttttttaactccagccaataaactcacctttaaatcttaaagggcatcatccccttaaatctcactggggaaacagggcagagggaatgtgccccaggctagagctgagcatcaggtccatctaatgcaggcattagactgaattagggaaggctgggagttgcaatcattgccccatttcactccaaggaccataaagaggcttggtaaaccctgacacagtgtttgcagtctggcgcggctgataaaggaagatatttctttttttaaaaatctagtgaaatatgtaatcattttgaagtaagcccagagttctggccagtgtttctggaagacgttgcttttgcttgaaaacagaatgctgatgaaaagtcgagtaaaatgttgttacagatgttcaactctgcattaaggctgttggaattaccaccacatcttaaatcaattctcagaacattgtctggaggttatgtcattgaaataacgaatcctctttagtcaagtataagcaaacatgttaaaacatcattgtaactttaaattaaactctagcgcaaaccaggggatctgaagcctcattagacttgcctgacatttttctagcactgagtcttcccaaactgtaaaactgttagattcagtgcctattagacaagggagcgctgggaagttacaacagcacattaagtgttatacttagggatgtgcaaaaacaagcccttgaattttatgagtacttggagactggatggagttcagctcctataaaattccacgttagattcctgaacttgtttgtgttctaaagaagtcaggtttctttaaaggatcatatcttcatgtggcttccgcagcatgaaggcaagtgaaaatgccatagatggaggtgtattgtaattagccaaaatgtaggttaaataagagcttgtaaatttgcatcgtcatgaggtagtggcccactacttcaacacgtttgtctttcatgaaagtgagtaaatttaagtctcccttttaattccatttttattcctctcatgtagtcacagaagccatgaaatgaaaattatattttatagcttaactaaaagttttcctagatctgctttctttatgcagaaattgataggatccatataaaggctgataattaaatatggtttatatcctacttatgagaaagaagttatcactgcttctcttgagggacctaagccatatgtaatggtctccattacacagcgttcatatatttaagctggagacattttcccccatctcttcagggaacagatctgcatttttaggctgtgagtgcaggaggaaacctttaaacacaagtttcattttggagaacaaatcccactttaaatgcagtatgattacgatggatgatctttctgagttgcaatgaaaataaatagtttctttgcatagaagaggcataactttactaccagaatgaggtgtctcccttgagctggctaacaggtattaacttgcaactctcccatctgaagatcagtgtagcaacaaggtgtaaagataatggccacttaaccaaagaggattatttgttataggcccaatgcaaaaagggaagccaatgctcagcaaaataatcccacaggcatgctagggaggatgacttctgttcaggtcttaactcatctagattcattgtgtaactggacacaaccatggtagcatctggtgaccttgaaaaatgctagccgtggtagactaggttagataaaaacctttggatgtgggattataaccttaagaagtctaactgaattataaccttaagatgagaaaaacagaacttgcaccccgactagagtgactcacatgcactcacacaaacacacacgtgttatttgctccagcatgctacacaaccagtctaggtcaccctgaacacaatacaccaattgcaagtggcccatattaaaagatgaccttgtcttatacgtctagttagtgcaagactttctacttcattctaagatggggaaagtgcgaaagcatacctacacacacacacacacacacacacccacacaccctcgctgcctttctaccccattattgcctcagatgcctggtcccctatcctgtgaaaggaagatgaattcaggtcaagctcagagtgcctgtttgcttgccgagagatgcatatcaactctaagtgattttttcaataccatttatgtggcttgtatttatttcctttaatcttttaagtgctgtttagtctctgtgtgatttgctttggatactcatttctgataagatgcgatatcatcccagccacatagtctctgcctggagctctaaatgactgatacagtctcggcctgagcttgggccctggtgggtgtcagaggaagcaggtggtacagggggtcggctgtgggtgtttgcaggtgctttcttgccttcatctcttctggtctcactctcaccttacaccacagtcattcccttttcctgcatcagccagggtttagacaagcccaaactgacagcagaataggagagtgtaaaatgtgtaatactttgaagcaggtttggagggtagttggattattaaaatagctttggaagcatgtatcataacctactaaatttatttagcgttttcagggaagtaccatataatgcatgctctaatatgggtcttcctggataataccaagtagctgacatggcactttctcccccatctaagactcctacaccattaacatatatcaagtctcttttgatgtcatcactgctaatatttctcttcttagctttaaggtaactgctgtgcattctgagtttcagggtgctttcctcctagtctgtgttgcagtcaactataagaatccaaagatcttatttttccttcttgatattacagctttagcctgaattgtgggggtggggagaggaggactagaattttgccgctgatgcccctgggtgacaggctgggtttgcatctgctaattatcaagcagttctcttaaaaagaagcatgatgcaggctaatacatctgcaaagcttattagtgggtgtctttgggcaagagcagtagagtgtgctgtggtgtttctaagtgaagcttcacattgcttagcaatctgtgtggtttagacatttggaaaacagcttttggtttccaatcccctgtgctgccctccatccctgccccgctgctgcatcatcagagatttcattcaatggcaacctcctccttcattccggggctctcctccaacctcaccagccccggtgctcctgtcttcatgggttgaaaaaggaccccgttggcacagccccacaagccctccctcctggcagttggagggataagagctgagttgggctggggattattgagccagcatgcaccaatgtgccccgatctgattgaaacattggctgtcaaggccttgaatccttgcctcttttcaacgctctttctctggtatgcaggggttaggaaccagctaagttggttcatctggagaagcagcaggctggcagttatgctgacatttcaaatacaactttatttctgattttggttacaacaaaacgcagtctattactgggcaaagcaaagtaaccaaaattaactctaagaataatgataagtattttttttggtatacagataaatcatgatttcttttttttttttttttttcttatggcagggtgtttacaaactgttttagtctgtttaaagtgtatgttcaaaggctggagtgtaaagaggtgttgccttcaccttctctaagccggcctctttgactaacacatttggtctttgtcattgggtcctaaaagacagccatgaattcctagtgagtgactgagccttgagtgtgtgtcctttgatattttgcctgtattgcacagtctgccctcaaactgttcataatctcatgagctgcctgtatttccagttgaagatgagcagccgtcaacactatcaccaaaaaaaaagcaacggaatggaggcatgcggaactcacccaacacctcgcctaagctgatgaggtaaggagaggggctggttgcccacggtttccctcttagcccttctcttcctcccctcgccctctcctcaccctgccaggcccagagtctcccctccccagcaagcccggggtgggggaggggagcgagatcgttagatggcttcttaaaggctggagtatttattctgtcagcttgtcagcagttaatgatagagctgaaaaaattctgtcatgaaaaacagtttgaaaagctgtttgaaaaatacataggctttaaagtcttagctgtcaccatgtcctgtctgtgtgtagttcctaaacagcagtggcactaatgatggcggtaaccaatcagagaaactcgtgtggttagtttgcctgcggcagtctctttctgctggagtccctccgaggactgttttctgtacttaaggccatatgtgagatgtatcatcacaatcaaaaatgaacctgaagattaccttccttttatcctgtcgattgaaatcaaatttctgttaattgattttgactgataagaaaaagtctaataatctgtggacttgccaaagcaaagttcaaaagtaatccagttctgctcaggctaaaagcaatattaattatgaaatacagcatgcatgtacatgttccctcctttcctcccttccttcctttccttacttccttccttccctccttccttccttcccttcttccccctccctccctcccttcctccttctctctctttctccctcacttctttcttgactatggcttcctctggtaaatagcaagtgaagtcaaatttcaacagcgttctgcagtttcttcttcttggcctatctgtcttttatctcccctttttgtcttcaattcatctgccaatcccagcatttttttcctccgacatcctgactctctaccacccaaatgaaacaggagtgatttcagatttgcactgctcaccctatgtggtttctgctctggaaatgcctgccatcttgacattagttttgtcttttcatggccaccggctttgatttttgaaatagaatagtggtgatttccactccccatattcaataacatttgcatgttcctggccctccacatccacctttctggaaaataggcaagggcagtctttcttcatgtggttgaggacacaggttttccgtggaagactcaccctgcccaactccttttccatatcaccatctattcctgttaaatgtttccttaaaagttctctgccttccgcttcacccagccttccttgggtttggctgatttgcatgcttgtttacagtttatgaggaggaataaaatgtgccaactgccaagcttttcgtttttatgatgccagtgtcatgctagcattcatttcctatttactcacctttaggtaatcaccttatctaattctaatagttattcccatttaaagtagagaaaagcccagccactttccttcacctaaatttagagaagcaaataaataaataaagagaagtctgaaaaatctgaaacctttggagccaaattccctgtccctgtttgctatgtaaagtatggctcatttctttgatcttgagtaataataattctgaggagttatactgttttcatatgcttcaaagctgtgtcaaagttttgctgcttaagggtacttctttattctgttggctcttgggtaccaagatgacaggtcttctgtatgaggtggaggcttttttaagtcgtagccttcagcaaaacatcaaattaccaaatccagggtagcatacttctacacaaatgcctttcctgtagatatattataccatatatattaaatactttagtgttacacgctacattttatgtgcaatagaaagtgatggtttgaggtagccttggggggactttttttccacaagcagaaaaagctagtgtatatcgtatcaagtatggtttttacaggactttctgcccgaaggcctttgtaaataagtaatgatcaacagattggctgtgggtttttgaaaagcatgcctgtgtcagtttgcatgatgggggagaattttcaaagtggatcttgctttcattcgttgctggagaggggctgagggaggcagtcatcctgggctggagctgtctgtttcatggtacatcaaaattgctaaacgtgggtcaggtggtgagtggaaacttgccaagctacagaactcgggcttctcatgttggttgcctttgggctgctgctaaggcctcagttcctgtcgctgggatgtcttatcccaccagcccaccatggtctcccttcgcagcccagctggaatgggccatcccatgacaagtgagaaagtcttagacactcctcccttaccacgtctttctatgtcccaggtgctccacattctccatctgacctgggagcaaagatggacccctcctgagccctctctccatatcccttgacttccagtttacagaaagacctcagggccctttgttttacatttgaatatctggcactggcaatgaagtcatgggtccatttttgctaaaccccctttgttgattggcagaaaacaagggctctcccagctccctgtggcttttccagttgcccccgcctcttccgacacctgctttctactctccagtaaatgggactttcaggtcctattcctcatgacctgaaaaatccataaaggaagctaatgacttatttgaagtggatttttcgacatgagtttgtgacttgcagtttgagcagaatcaatcattctgaatgcgggcaggttttagtggcctatgggcagtgacaggaatagctccaagaggaactggagaacccagaatgggctaggatgggctgtaatttaccactgtggcttctgcaaataaaacagactcctgcgtgaaggctccttccaaatcatctgccagcaggagatgcaacggggactctgcactaatggtcttttccttccctttgttcttgtatcaggcttaccctagtgtttaagtgtcacttaactctgcacgatcattaggtgaacagccttgttttgtatatctggatcctgaggtagtatgtttttgagtcacctcaacagaaaacaaccctcatgtccagatagagctgaatggcgagtgtctgggccccaggctgaggacacacgtgtaatgatggataaatttggctccacacccgcagaggaggtgtgagccatggaggcttccaagtccccggctctctctgcctgttatttcccttccttcccggtctcttactgtggaattattgaaggagcctcccgtagttttcctctaaaattaccaagcacccgttgcccaattctccctacttagtggggtggtgccttgtaaggatagccacgtctttcctcatttgtaaagtcctaggggggcacaaagtttgtctctaaatagctaagtcaagagttcttaatttgggggccttaccaaccctatgaaccttcaatgaaaactctctaggaagtctttctaggaaaaaataaaaagtacacttgatccccttttaccacagttgaagcaggttaatggattcctgaaatctcctttcaggatccctggttacaatcacattcagtttattccagagccacctccacatagttgcacgtacaaatgctttttggttgatgagatttctccaatgggtaggtggtatggagtaaacacctgggttctcacactgaatcctcacatggaatccaaaaagtctgtgcacttcggctgcctgcttttaatctttttctcagattagctcccatccagcaaatatttagcgagagcctactgtgtgcaagttgtcatggaagttctttaaggaatctaaagtctagcacccaaatgactttagatcccttaaagaacttccacacagtctaatagattagattagatccctgccttcaaaatgcttatagtttagcagaggagaagacaagcacataaaaacacagaattgggtaagaacaagctgggggttccactagcatgggctgtgagaatagaaagagctgtcattacctctggtttgggaggctgagcctggtttaggaggaggtcttattgaacctagttccataccatgaggagaatgctcaactaataatattacttgtctaggtttaccgagactggatgcctgtaactcactgagtcctaactacaactctataagtagttattactcttgcccccattttacaggtgagtatgttgaggtacagaaatgtaaagtctggtaaatctaggtaagttttccctaattaggatgatggaagacatagggacagtgctcagaccacagtaaatgcctgggtgtggctatagccaggggtctttggagtggcctagatggagtggagaatgtaagagtattctggcacccagtcatgaaggttttgcttgtcataggcattagggaacccctgaaggttttcgaggaggcggtaacctaacttgtgttttgggggaatcactggtggcagcagagagaagggttgggagtcctccatcaggagatttctgagacacacactacataagcacagaggtgtgaaatagaaggcccactcaaccccagcctctgccaaggccgtttgtgtgctaagccattcagggtctgctgtagaatagtagaccaggactgggatacatagttttcccaaggacacacgtaattcctgacatcagtcctgagacctagagttttcctctaaaatcatcctagttttcctctaaaatcatcaagcacccgtggcccaattctccctacttagtggggtggtgccttgtaaggatagctacatctttcctcatttgtaaagtcctggggagcacagactttgtctctaaatagctaggtcaagagttcttaatttgggggccttaccaaccctataaactttcaatgaaaacttcagtgaaagttaggatttacataggatgtatcaggtggacagtttacacagatagcacccagctgggctggcaaggataattgacaacacccagaaaaaagaaattgaacattttgaggagagtttcatgtcaggagacccagaaaatattagacattagtttcctgaatgggaggcaaaatatgatttgaggaaaacagattatcctcttgggcatctcctggtcattaagtgaaataaactcatctacttgttaagtctcatcacctctcttttgactcaaacctttcgtggggtcattttgttaggacttctcacatcagagcctgctagcatgaaagattttagtaatagaaaatggcaaaatggactgagccaagtcaccctcacaattccttccactgggcaaaagaaagaaggaaggcagggacagcttagctaagtaaattcatctcttaatgcacaaactgatagcatatgacaggcctcccccaggactggagaagaaaaaagtagttggtgtcatggtactgaggcttgggtggaccacacaggtccctggacaagttcatgctcagcagatggtcatgaccttgccctcttgtgtcaagagcatcttgtacaacctcctgtaggactgatgaacgtgttggttctcccaggctgtctcccaaacataaaggcaaccatttccttcttctgagaatgctggctgcctaacactagataacatcttaggtggcagcagggaaaataatgcaagtagatagatgcagagaaattgaaaaggaccctagttctgccagggtggctacagcctggcctgagagttttgtcagtgtggctccagggatggccgtcaagtgggagatggggagagggtggtgggcagtggtgtctcgggggtgatgatcattatcagaagagtggaagccctgttgaaggatgtgttaaggcaggagccaggatttgctctgcaaagcctcaggaagtatcaggaaatagtaatcacccaggagccaaggcacccaagaatgaggcagatccagttggaaccatttatggtgctgaacacccaactatgattccttttgaggagaccacctaaggcctaatccagccttctgtgtctgatacaggctcagacagacccgtgtggcctgatattcttgaacattgtgctcaaggtcttagtgactagataccatgttgttaaagaagggtagaacactgaattgtaagtattgcactttgcgaggactagtatttaatttgcttgtttaaatttatttgctgattagctcatgggaagagaagtcagcaagagagagtcattagtgcagcatctagtcagtaaatccccatcaagaatcaagtgttgacacaatgcctcgagttccacagagtcacagagaatcagagtaggcacccagaatgtgaggcgcctccttcaattttgcaccctaggcaccctcttgtctagctgtagtcctggctttgctgaatagaactacagccttataatctgtgtgttgttgacaattgctaacttgggtaggatttactgaagccatatagattctccatctgggcaaaactttatagtggtggttcttatactttagcaggtgtcggaatcacctggagggctttgttaagatatagcttgctggtccacagccctacacagtctaattcagcagatctggcctggggattggaaatttgcatttctgttaaacttccaggtgatgctgatgcggctggtctgggccacagtttgagaaccactcttttgaagaatcagaacagtgagaggagcttgaagtgatgggggcccatctctaagaagtgttcagactttgcactggagaaccaaatagttgcttaattaagaacatctgtctgaccactgacatgagtcctccctgctgattagttacagcagctggctccaggcgaacttcaggcagccttgactggttagagacataatttagggttgtccttcacatcacaatgccctttttatagcaaatgctctgtgtcctaattcatacgcagtccctgtaaatgaaaaatgatgcaagaaccctgattgttcaaaaacaaattgttgcaagatatcagaggtaaatgggttctcactgcacacgttttggatctccacgaaaggtttgctgagtctctgttgactgcttgaagagtgtttggggactagagatgattcatcagttcctttagttagtttgattgcatcctctgctggattctggaaatacatggaagagcaaaatagatccctgcccctaaatagttcaccatctaatggataaaacagacatggaaattattattgccgaaggagcatctctagaagttcccaggaagggaaaataacttcagtctctctggctgttcaggatgatggctttatgaggaacacttgagccaaactgtgaagtctgagaaatgtcttgttagccccatcatggtgccttacataatagatgctcaataaagtcagtatttgcagctcggataaaaggtctgtggagggatgagaaattcacctccttttaatcaagcctctcatctcccagggagaccactgtaggatgcccttaatttggatgggatgctcataatgacagaaaaggccttatcgtgtgataagacatgaggtctcgaaaatcaagcagagaaaagaatgcaattttctagccattttgtaactttcctttttcataacatttttgtgtgtttggctggttttttgtactttcatgtaaatttctgaagtccagcgttgaacccagtgccaccgaaggaactgggatttgctgtctttgcctgtaagggaaattgtgcactttaaaatatgatatcagcttcctcacagcaggtttgctagaaaagggatttgtggttttgctttaggctgttgtcttcaaggcgagctttttctgttcctgttgtagcagggcatttagttcacttcctgagattaattgatgccaagtggcatttcttgctctgcgaatcctcaaaacaaagatcttttgcaggcacacctcagagatattgcaggctcagttccagaccaccacaacaaagtgaatatcgcaataaagcaagtaacacacattttttttctagtgcatataaaagttaggtttacactcttctgtagtctattaagtgtgtacataccttcattaaaataatttactcctaaaaatgctagtaatcatctgagtcatcagtgagttttaatcttctttctggtagagggtcttgcctcagtgttggtggctgctgtctgatcggggggtggtagctgaagattgtggtggctgcgacaatttcttaaaataagacaacaatgaagattgctgcatcgactgactcttcctttgacaaaagatttctctgtagcatgtgatgctgttggatagcattttacccagagtagaacttctttcaaaattggagtcaatcctttcatactctgctgctgcttcatcaactaagtttatgtactattctaaatcctttgttgtcatttcaacaatgctcacagaatcttcactaggagtagcttccatctcaagagaccactttctttgctaacccgtaagaagcaactcctcatatgttcaagtttgatcatgagtttgcagcaattcagtcacatgttcaggctccacttctaattctatttctcttactttttccaccacatctgctgttacttcctccactgaagtcttaaagccctcaaagtcatccatgagggttggaattcacttcttccaaactcctgttgatattttcacctcctcccatgaatcacgaatgttcttattagcatctagaatggcgattctttttcagaagtttttcaatttattttgcccagattcatcaaaggaatcactatggcagtgatagcttattaaatatatttcttaagtaataagtcttgaaagtcaaaattaccccttgatccatgggctacagaatggtagttgttctagcaggtatggaaacaacattcatcttatacatctccatcagagctcttgaataattgggtgcgttatcagtgagcagtaacatcttgaaagaaatctttttctctgagcagtaggtctcaacagcaggattaaaatattcagtagatcatgctgtaaacagatgtaaatgcctgacttcaaagcttcaaaggacaggctgattcttgttggaactaatgcagctggtgactttaagttgaagtcaaagctcatttaacattctgaaaatcccataggcattaagaattatgtgaaatctactctgcctgtgctctagcaatggaaaaataaaccttcaatttgtaaaaaaaaaaaaaaaaaaaaaaaaaaaacaaaaccataatatctgcaaagtgcaatacagcaaagttgaataacatgaggtatgcctatgttcttcttcttttttttttagacagggtctggccctgttgctgggctggagtgcagtagtgtgatctcggctcactggcagcctcaacctcctgggttcaagtaattctcgtgcctcagcctcctgagtacctgggactgcaggcgtgcaccatctgcctggctaatttttatattttttgtagagatggggttttaccatgttgcctaggccggtctcaaactcctgagctcaggtgatctgcccacctcagccctccaaaatgctgagattacaggcatgagccaccatacttggccatgcctgtgttccttattagactttaggcacactgaatttctagctgtggacactggagggtgagctgagatgcaagggttatggggtgaatttctgctaatcattcacataagtggtgcattttgtaaatgcctgcgatgctggtttccctttcttggctgcttagaacactgcaacttggggtgttttgatggagaatgaacaagatatggctgcctccttaaagtgggagggtatgaggtgggcaccctgcagcactggccttcagccaagtagacctttttgttaaggctttgcctctcctctcactggctgtgccacctgagcatgttacttatctattttgtttcccatgtatacacagagcccgataataacagaaattacctacaggtgttcttgtgagtagcaaatcataaaatgtaggtaaaagttttagtgcaccaacatttggaagtgttggactcatggcagctattcatcatagtaacaacaatggtaatagcactagtagcagcaatagtagtagtattaatagtagcagtagtagaaataatagcagtagctctatatctttattattgaactgctctccctttcctgcctcctttcaccataatcagagctagtaatacatgagtgggtcctaagcaaagtataaaggatgataaccataagactagttaacacttcttgaggacatgctctaggtcagatgctgtattcagggcatgaaatatctttactcatgtaatcctcaaatggaatccattgaataatgctaatgattaacattcccattttacagatgaagaaactaaggcaatgtacaacttagcaagtaataggtgagccaagccttgaagacagacattttggctctggagccagggcgcttaaccactatggtatactgtcactaaggaaataggtggtttcctgcccttagtggtatcaacccctgaacactccatttggagatggactctataagtcagactgctcaaattagctggctagtgttcaggcttcctctttgctttaagctgggctttcattggcattgatcctcaaatgcatgtctaagttaaagacggagagaagttaccactctggcagagcagatctaacatgcctgtatgttggtggtggggtagagaaggtggttggagaggggagggatattggccgaaaacctttagaggagatactgggtattacatatatatgtctatgtattcctgaaataatggcgggatgcttttttcccccccttaaatggacaagaaaaacttaagattcaagaagggcagccgggggccttcagctaagggatatctgatatattgtgcctgtttttcttcaaggtgggctattgtgttaattttctaggaatgctgtaatcaagtatcacagacccagtgtcttaaacaacagagcttctcacagttctggtggctagaagtctgagatgaaagtctgggagggttggttcctcccaagggtactgagggaaggatctgtttcaggcctctcttcttggcttgcagatctctgtcttttccctctgtcttcacatgattttccctcctgtggaaaagttggcccaaatttcctcttcttgtaaggacaccagtcctattggatcagaactcaccccaatgacctaattttaacttaattacttctttaaagaccatatttcaaaatacagtcacattctgaggtaccggcggttaagacttcacataaaaatttgggggagaacacagttcagcccataaaaatgaaacagcagatatatctcacatcatagagtttctattaccctaaaatagggcatgtacattggctaagtcgcaagtgacaagtgagccttgaattaattatggtgccttttagggaaattgaaaattactttgtgagtggaagacttaggtaatgtcattatgatgtgaaagacaatatctaatcctggtccttgatttcaactaactggtctttgaggagttgtgggagaggctttggaagtgggtctctatcaccttgcaaactgaagatgttgggatcccttgttcagggagatttctcatgatcctcctttccatacaacaaacggcccaattcctctgggtctccctggatcacagcagtgttgattggtgtgctcaatggcaaatgcttggactttcttctagcaatagaagctttagaaactttgatttagtccctgtggacaactgactgtacactctccacctgttccagagatctctctgcagcacaggccagcctaaggcacttgaaattactacagcaacagccatagtaaagaaatttatactgtctggccagaaacagttacagactctattgttgctggaacgaattgtgttcccagcttactcccagactgtgaaatccagtgagtgtgtaacagtgctggcccttactggagccataaattaatccctctcccacgctgcttacctctcatcttcactctagcaacctttctttacctactcagggctctccagccttctgatatccaacaatggtccagtactttcaaaattcttctagctgtgtctttctccagtgacagcacagtgcttcaaaccttcaggatcttctaggctcgcccaacctttatatgcatatgctcactgtatcccttgctcttgtggaatggctcaatgatagaaaacccactgtcttgggcaacaactcatttcatttttgaattactttcaatttttataacaatcttcctgttttggaaccatgatttttgttctctcttaatctcatggatcattcttagtctgctgtcaatcagtcatactcaatcagtttaatccatcttcaacttgactgtcattgcacatctggagacagctggaaggcctggtctgagtcttctgtaccttaggttaggtggtatggtatggggcatcttcagccatggttttaggtgccattatttggcccttttcatttgggcctcaattctctgggtgggtcctactggctattagtggatcaacactgcaacatgctgagattcctcttcatttctcatggttcagatcaaatgctaatttttttttttttttttttttttttgagacagagtctcgctctgttgcccaggctggaatgtagtggcgtgatctcggctcactgcaagctccacctcctgggttcaccccattctcctgcctcagcctcccgagtagagtagctgggactacaggcacccaccaccatgcctggctaatttttttgtatttttaatagagatggggtttcaccgtgttagccaggatggacacgatctcctgacctcatgatccgcccaccttggcctcccaaagtgctgggattacaggcctgagccaccacgcccggcccaaatgctactttctttgcaaaaccttccttaatgctacccaaataccaggatatgaacagcttttttcttggtattcttgtatcaccttgtactttgctgtaacacttgccacaaggtactgtaactattgaactattggtgtatatatatttttttcctgctatcttgtggacctctctttgactagggactttatcttaatcattactgtagcctccattccatgctcagaataggggattcttattgattgctttactgattcaattggttgctttactgattcaataaaccaaagttagaattccaggtaccatgctggtcagagagggtaatgtctttgttccgggaggtttttgatgttcctcaggtcagtctcttgggggaaatcctggattgtttatatttaaatggtccaggccaggatgagagatgtgtggggagtagagtgtagtgtggcatacctctaagacttcctggatgcctctggatgttccattgcaaaccatggcttgagctccagtgtgaaattatgcctggtttctggaaaccactaccccagttaatgaagcttgacattagctgtcttttttctttttattgaagggcgatcgatcatcaggcttgcttatttgcttttctggatgaaagttgtaggccactgttaacaacgtctgactccttcccagaaagaatcaagtataccaaaccaaaatgtatctcctcttccccaaggcacacattttctaaaagtgttttttgtcagcttgctgtttcatttgcttgcttgctgatattatgggaacatagttctgagtatcttttaaatcctaaatgcactaggggcaggtctcaggtcatcctgaggtaatactttctctccaaccagtaaacagggcaagagaatttgaacctggctctatatcttcagggcaagtctgctaatatcctcttgcaactgaaatatgttcttcatgggctggaaagagttaattttgttcattttctcaaacctcttctccatgatggcttttgtctacctacctattccagataatattaatagatatctatgcaactgttaaagactcttcaaggacaaaaacatccctcaaaatgtgctctcaccctgatctgtaaatagttcttatcagcctttttatcttaacatctttgactaagttcagtatttggaagatggcctggtggtttacatacctcaagacctctcaacaatccagacactgagatgctactcggagtgggattgttcttcttttaagatcagatatgacagatattcctatagtagtctagcatgttcgttgaagataactttgcaagttggcttcacatagtatttgtcatttggtgtagtctaaaagcaaattctcaggcataaataaaggcagtgagaaagttttctcaccttatgtgggagtggggagcatattggagggtcgtggtagttattcaaaagcttaatcctaggtttttgggccatggaagagattgctgtcccactctgtactcttgacatataagtgggaagtatcggagacatttcagaaggacaaatagtaaaaagtaaataaaagtcagcctctgcagagcgagactctgtctaaaaaaaaaaaaaaagaaaaaagaaaaaagtcaccctctgatgttgaaatatagaatttcaaaaggtaaaatcactttacaatttatggaatgtgacccgatgtatattttctgtcttgtgttgacaatattactcagaaaagatagctccatttcaagagtggttaagtatagctgggacaatgtcctaattatatggccagttttgcaggaaggaacaatgacttcccaaacccgaggtgctgaatcactatcagagataaaagcatggacattgactatgattcaaggtgcaggagcttatttattgtgctataagcttgttagaactgcctgattccattgcagttcttaaggttgtcagtgaggctctgccaacccactagacgggaggcctttatggaagcatcttccttttccaccaatagacaaggcaatagagggcgaatgttgccctgagaatttgaaacaagtttattaagatgcatctgagcttgaggctctcatctaagatatgcagcagttgggaggtgaaggtggtggggagcatcattggatggttagtgcatatacagttgtcaaggcaaggagagagggtgttgtttagtattgaaatcatgtattccagatgtgggcatttggtagtcagtctgctctgaagtgacatgctgctgaatctttaaaggcttcagccagggagagcaaaatctgattgggcaaattgctaaaatatttaaagtgcagcctgttaaagcttttactgcgaagagcatcacgtcagaagttgtagtcagaaggagcgagtaattggctttccatcctcatgccagtcagtcagcatgaggctctattcctattccttcctcttcattgccgaggctcatagcaaccctttggtgtgtctgtctgtgtgtgtgtatgtgtgtgtgtgtgtgtgtgtgtgcacgctggggagatcgaatagctggtaaaatgagaggaagaggagtgaggtagccttaaaaagggaggctgaatccacaaaatgttaggaagaccatttaggaaaagaggagcgggggaaaggcagaaatgctccctgacaaaggtcacctgcacttccagaagtggggtggtggtttggggcagttgtctctcaaaggatggattctgtaagcagaagaatggccttcagtgacaaccacttcctctgcatctttcacatcctctgagatgtaattcagggggcactttccatttataatttatcacattttccacttaggttttcctgtccttttcttcccaggcatgaccccttgttaattcctggcaatgatcagattgacaacatggactccaatgtgaagaagtacgactctactgggatgtttcactggtgtgcacccaaggagatagagaaagtcatcctggtgagtgagggactgtgcatctgatgttgcccgcttctgccccaaaccacatttgctaggaatggggtttccctagttggacagtgggataatactgtccctggtcctaattatttttgatgagtgaaattctgagcatagattgaagcagctagacctctgatcagaacataagcaatattcagatttttcaatctctgaatatattggctcctcataagagtaggtgagcacttgctgtgggaaagccatggtgggaggtggtatgaacataattcctgtggccatggcgctggtgtcagagcctgcctgtaccaattattagctgcatggcttgggtaattcatttgactttttgcacttcggttttcttatctgtaaaaagatgagatgagaatgaccctaactcatagggctgtagtgaagattaaaatccaacagatgactcagtaaagttacctcttattcttactattattaaatgctgtgaggaaagctgaatgctgcctgtattgttattggtttatagcaatgttttgtattcttatagataatagccttgtgcatctgtgagctttcttagtgcatgttgtagacagggaaatgcatgatgatgcatgacataatgatgacaataatgaactacagtccccttggggaggctggggctcagagccctatttcgtggaaggcttgtgaacatcttcatagcagcagtgggctcacccagtctctcccaggaatgtcagcataggtaacaatccattctactctctgcccttgttctattaacagctttgggtcttaatgcctacactggctttcctacagtttattgtcttgctaatccatgagaaatggattaataatcaggaaagtcagatggaagggttctttctcccttgggcctctaatccccagattggtatgggtctgttcctttttgtcagccaggaaaatcctatcatttctgatgtcaggaccacccttcctaaacaaggactgttctgggtcctcggaatggctttgtatgctaacacactggactttcccctatgctttatctatgtgtatgtgtgttctcagcttaattataaatgagcattaacagccaatacagtatcaagctggaggctgtctcagaggtgggaaagttgcaggcaagagcacagaaagtcagaattcttagcaaacagctgttgtccaactgaccaggagtgcaaattgttctactcgcaaagctgcttcacgtatgtacattctttttgttttgttttgtttttttgagacagagtctcgctctgtcgccaggctggagtgcagagccctatcagctcactgaaacatctgcctcccagattcaagcgattctcctgcctcagcctcccgagtagctgggactataggttcgcgccaccatacccagttatttttttgtatttttagtagagacagggtttcaccatattggccaggatggtctcgatttcttgagctcatgatccgccaaccttggcctcccaaagtgctgggattacaggcgtgagtcactgcacccagccatatatgtacattctgatgtattcatggcacttttgccctggtggcctaaatttagcctgatgttaccacttgtggcaggtcacaggctggatgccgtatctgggacctagggttttaatgacttgcctggatattggtgtagtatgcatgccaactgatattcaatcaacatctcctgccagcataaaaaagtttaaggaggtgagttactacttctatcctatgaaaaataacatcatttaacaaaacatctccaggaggcctactatgtgccacacaccattctagttactggagatgcaatccctgacaacgactgctctcacagagcttgtgttctagcagggtggggctgggggaagaggagttatctctttgtgttctagcagggtggggctgggggaagaggagttatctctaggtagacaaatgagtacttaataacatttcagatatttataggatgctttgaaaaaagtaaagcagcattgtaggctagaaagagactgggaggtgctgtctggaaagtatgatccaagaagccctctctaaagtaacacggctagagataagaatgacaggtagggccagctacatgaggatgctttgaggttgtgtacccactgggcacgggaaactaactactttggggatttgaagatataagagatagtcccaattgtaatttcctggattaattagagagaagatataaaatgtaacccatgaaacagtgtatttaaagctaagtggtaagaggtgcaaaatgctattgaaatgtaggggagaaggactagggtgtgtttaagtgaccaggcaagtcccgtcatacacacataggttgtgcttgggttgggcctggaaggatgcatgggaattccagatacatagagaaatgatcagtttctctctctagtgtgctttaaacccggcaaaatcagacacaccggggctgaggctctagaattaggatattcataaggttctctgggtgatgtagctgtggccagtctgaggatgggtgttttgatcccagatcgaagttcctggggtcagcatctgtgcctcggccactcaactaactgtgccttccccacctccctattctagaattcacttccaccctgggcccagtttatattcctctggcttgttgaagggagctagcctcccaggtgacctggccaattacaaataattaggagccccatcacataacagtgctttatagactggttggctgtctcctggtggcacccaggcacttgcacttccgtgcggcccagataactaactccaggtcttctgcaggaagtggggatatgtgatgtgagctccccagtgggtcttccttggtcacagtttctaaggcatttcttacagcttatgtctccggtttccctggactattgcagagggaaaccaataatggtgacagcccctgctttattctaatgatcagagagtgaaagctagtttcttcctctccttgggggttactgtaataaccctgacattgttgtgaattgcaacattggcatttatacaatcaatgcagtggtcaattctagagattaaatcaagcagagtttgatatgtacagtggacattaatatgcctcccccaaagcattgtaagccacatggggccatccaggcatgcagtgggtggacaggaatgggaggcattgaaccagaaggagaggcagagaaaggtccacggctggcctcctggcttcactagctcagtgaatcaaagggccagcagtgactaaacatttgtatttcctgggaagttggggttctcctctaatagagtgactgtgttctttcatttgtctcctttgtagatagaggtttggagttggaggaagacactggcctgttgctcttactaatctctctctagccccttgtaatgattatttggggagatcttttctctgaatgatttaagcaaaacaggcccctccagaaatgtccctggaaagtccaaggcagcattggacaggggtcagcaaactttttctgtaataagtcatataatgaaaaatttaggtttttcagggtataagatctctgttgctactgattagctctgctgttgtagcataaaagcacccataggcaatacctaaacgtatgagcatggctgcattccaatacaactttatgggaatttgaactttatgtaattttcacagattatgacattgtcttcttttgattttttttcaaccattttgaagcacaaaaacaatttttagctcactgaacatacaaaagaatgtagtgggccagatttggcctgtgggtcgtagttttccactcctggctttaggtagcatgttccacctgctgatgcacggacatctcactgataagtctagaattctaaagtcaaatttctcccactgagcccagtgcaggcatctgaccattttatcatcatctcagcaagcaagccagaaaaggcagctcatttaatcaacaatttcatggaaactaagacttctctttccaaatagcataaatattccttttcctttttattttacctcctgaaaattattatgaaggtctgctcacacatatttatggcatacctttcttaaatcttttgtcaaagaaggtagcaatgtgtatggctatacatttggacagatttattacaaaaatataatacatatacacgtgctcaaattatagctctatatggcatgtatataacattgatgaaataaaaataatagcacatagtaagctctcagcaaatatttgcttgattctttgcacaaatgatttatttcactccttacaacagccctatgcagtcttctctctgactcttacccacttctccctgttgtagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctgtaagtccaaggtcacattattgatgccttttcttcttttcattcacaaaagaaaatcccggatggatataatagttgtagctttgatcatgcctgtgcttcttcatctgggtatgggcctgaggactcagcacttcccctatgctctgtcaaggaaaatccaaaccctgggagaccttattaaaaggaatttgcagccaagttcagtccctcatcagggatgaagtttagcttgtatcaagtatattaaccatatcagcgtctaaacactctcactcctgcctatacaaaacctagagcattgttatattatgatgtttatagtaaggatttgcttacagaactatttatagcattatacttatggcatttttaatgcttgaagaaacattgatctgtgccaccttctgtttttaactaaataaatgcaaataacagagttctttatttctgctgtacagaaggccaactccttctgcagctcagccccaacccctgttcatttagaagtccagcaacgtgttcatggttgtgtttgtgtgtgtgtccgtgtgtgcatgtgtgcatgatattcttgactgcaaaacattaggacttcagtctgaaaaaacagtctgggactccacaatttagtgtgaggatatgggatttaggagtcatgtaattaactacttcctaatcataatgaatgcatagtccacaaactctcaaaacattgtagagaattatgcatttcaacatttgatgtaattctccacatcacaaattcatgcaaatctcacttatcctccaaatatttttcttgtaagttcacatccctgaaactgagaaacaggggccaggtgcagtggctaatccctgtaatccctgcattttgggatgctgaggcgggaggaccacttaagctcaggagttcatgagcagcctgggcaacatggtgagacctcttctctacaaaaagttaaaaaaattagcctgatgtggtggcgtgtgcttgtagttccagctacttgagaggctgagttgggaggatcacttgagcctgagaggtggaggctgcagtgggctgtgaaagcaccactgcactccagcctgggcaacagaacaagagcctgcctcaaacaaaaacaaaaacaaaaacaaaaactgaggaacatggatttctctacatgttaagaagtctgggttttcccccacttacaaagctaaaatgtattatttctgttatcagcttccaaaacctcagaaatggggggaaaaagagccaagtaatataattcattaaagaacacacaagaatctatccacaagcagtacatgttactcattagatgccaccatgtgcctttacataatgcctgacacaatagggactcaataaatatttaaaggagtgagaaaaagatcggacagttatcttttggatgctgggccaaaaacccactgccttagtgagcacaggcagttgaaaatagtcacctatagacaaacagtcatacacagaggagagcataagcatatatatgctttgctcattccagaaatatggtcgatttgattatatgattccatggttatctttctgtcatgtgctcctccacatagtcccctgacctctgaaagtgtctttgtaaagggtttattattttaccaggatacatgagtctgtgtgtgtatgtgtgtggagagagatgggtatatgtgtgatatttggtatttgtgtgtgtgttttgtgtgtttgtgtatgtttcctcctgtgtgaccttttttgtttgtttgtttttgtttgtttgtttgttttgagtccaagtttcactcttgctgcccaggctggagtgcaatggcacgatctcggctcactgcaaccttcacctcctgggttcaagcgattctcctgcctcagtctcctgagtagctgggtttacaggcatgcaccaccatgcctggctactttttttgtattttcagtagagacagggtttcaccatgttggccaggatggttgcaaactcctgacctcaggtgatccacccacctcggcctcccaaagtgctgggattacaggcatcagccaccgcgcccggctctgtgtgcccttgtacacgttcactcatctttcttcatgtatatgaatgagctgtcatctttgcaggtcatttcaaaccctccaaaatttaacatactcaagcacaatagattttcacaaaatgggccttcacctatgtcttcacagagtttattggttaaacagtaccctgcctatagggccagcccagagaaacataagcgatttctatgtatgtcatttgtatttcttgtagtttgaaatcacgtgtgtacaactgcacagggatcatcttatatcacaattacggctggcttccctacaagatgaaaattaaaagaatatggatgcaggcaattgaagcttatgcactggcaaaatgattcaggaagttggttggacttgttttgtaccaagagatcacaggagaagagggcattctccttctctcaaaaagacgctgctccagagcttggaactagttgtgtctcagcagcaaccacagtgctaaatgccccttcctccatagttgcacaatattttagggcctgagaatagaatcatgactaccagtgactcataaaagagggtagataggctccatctctgcagccaagtctctttccaaagccagttctccagaaagggagattagaggaggacattcccagatatgtgacagttggcaaacccttggtctacacaatcagtgagttgaaggtaactcaggtcaccacacaggcaaagaggaagctagattcaagctagaggaccaatgaagctggtggccagacaggagccccaaaatgatgccgcgtggccactggggagctatggcatggggtggcctgatgattttgctgtggcttcacctgaagacacagagcatgtggaggccatggccctgtcctaacctaacccttctattttccctatgcttgcattcccggactctgttgttacttcctggatctgggatttttccactgtcttttgttgttattttttatgttaaaaaatctgtttactggcttatttattttttaaatgtacctgtaatatacaaatatgttcttgttataaaatattcaagcaatatagaagtatataaagtgaaaagcaaactttcccctcacccccacgaatcctatttcccttcccagagggaattaccattattagtgtaatggctatttttcctgtgctttccttccaaatttacatacatttatatatatgtaattttattttgtgggtttttttttttacataaatgaaactatacttttttttaactgctgtagaactttttttttcacttccccctctatcttaggcttctaaaccaatgcctgcatggagagccagctctgcctctttacctcctgcatacattttcactgtgtgcatgtccaaaagtatatttctccattcctatgttgttggacaattaggtcatttccctgtgtatttttttcttgctgaaaatatgcaataaaattatatgatctgaagcttaactcctttccatatctcttttgcattgcacacattaattccactccatccatagcctccaaattgagccgcacatccaggcccacctcatcactctgtgctcactggccatttctccttggctgcattggaactgctgtcttttgcctgagacagaagtgacccgctattaaataaacaggcatttgaaacccacccccttgttacattctgaaagccagaggttgccacaggacagttacttaaatcaagacaatttccaggcaggaagaagatgtagaaccctggcattattcctctcccgcgtttgttagtaatagcttgattgagtattgagaacaagcttaaaatgctgccatcagcaccgactaccctttagattagcacacagctcctattcccttgaatgtagttaggccagcttaatgtcaaggcataaaaaagatacttgttaaataatttcccaaagctccgactcaatctttaatttgttttcctctttccctctcctctcacttttgctcctctctctctctctctgtctctttctccccccatctctgtttttttttctttcctctatgccaaagggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaaggtaaggacagcctgtaatacttctttgctgtgcctgcaggggacaggggctggcaagagggatatccttcactcagtaattcaaagaggctcacatcagcctgcctggcagtgaaacctgcggtcaccatgatggctttcaaaggggcatctgctgcctcttctttccattccagaatgcaggcttgagacctggtcacccacacacagactaggttgcctttccagaggataaacaagcctttaaatagccaccccctcagctttcccaaggagtggcttcatgaccagtgtcatcagctaaatgtcagagcactgaaaagaagctggctgcacaattctgaccgtttccttccagtatatgtttttgccattgagctgggatgggaatgaagctttgctattgttagagccgcctctaggactctgctgaccaagggatggtaatctctggagagtggcaactctatggacactaaaagtcatttagcaaatggtgacacttgtcagaccacacattttcctataggaggcaaagcagccttaagtgacacacgtctgccttcctactctgcccctagtctttcctgtcatttgctttgggaccctgggcaggtggttacaagtaaagatgtctaggggtctcagaaaggcaacacagcaaaaccttcataaaaaatgacctctgtaatcaggatctggcaggataggatgcaaagcattttccattgagtgacacctccgtgtaggctagccatgaattggaggatagttgttacagacgagctgccagagggtggcattggctgcctgatggggaccagaatcccatcagtccaggatggaagggtgtaggagcacagcccatgagagctatggctactgggatatgaagcatcaccttattgatagcttggcaagtgtctgacctcctccccatcatgccaggctttctagaagctcagctgaatcatgcatcctggacctgtgagctacattattttttgtcaacttgacatcaccaccactgccttctaacatttgcttagcattgcagaaaagccaggaacaatagttcctggaatcctcttccctgcatggctctgggctagagtcagctggtgggagatgggcactggggtgagatttggaaagtggaggagaaagataggctttgattctttggaggcaactgcagccagaccctggcagacccaggttcaaatcttctatcagatgagctttctgggagccagtgtcttcactgctacagactgagagaggggctggggcttctctgaggatcttgagattcacagcagcttctggtcaagcttaagagaaccttcccctttggtggtgcatgtgaaatggcttctgtccttctgacatcaccctgatacagcctgaagcctaattttgacctctccatgccaccgtcctccctgccacacccaaatctaaatcttggtatccacctgctcagctgtgcccgcaggacagcacaacatgtgaaggcctaggagaggctctgagcttactcccagctgcatcctgaagaggtagagcccgcatcctgtgcggcctgcccgggtagcacaggcgagaaaggatgtgagaagacagtaagctgaccttctaggagttgaaagaggcaagctggcatttggttcctgcctttaagcccttgactttcaatatgtgtcctctctgccctgccccagtatgggtgtctgttgggggaggctgttagagttacagaacctcatgggccatcccagacctgctgggtcagaatctgcattccaacaagatccccaggcaactcaaatgtgcccttttaaagcacagtaaaccttcacatgaacaggatgtgaccaacccttggtagatgctcctcctctcctggggaggagtgaaccatcaaggggaaaggaaaacagtgaaagcaatgattctccctttaagtacagacagaagccagcaggaggaggcaggaaaacactccctttccccaacatgcctgtttcctccaaactcgatcatgattttccagggccacagattagaatgtcagtgtataatttagttacatacacatctgatatagttgttccttccagttctcttaaacctcatcccagcctcttagatcctatataaaggccaaactggtaacaattcttccactccccggtgcccaaaagccttctttattcttttatagcacaggataagcaagaaaaataggttttgacaggagatatggaggaaagagaaagggagcttatttttcctccaaagaaaaaaagggcactctttcttttgtatacacacatgcacacagttatggtctgaatgtttttgtaccctccacctactccctgccaaatacatacattgaaatcctaaccctcaaggcgatggtattaggtggtggggcctttgagaggtgtttaggtcatgagggtggagccctcatgaatgggactggtgtccttataaaagaagcctgaggccaggcatggtggctcacgccttgggaggctaaggcgggtggatcacctgaggtcaggagtttgagaccacttggccaacatggcgaaacccaatctctactaaaaatacaaaaaagttagccaggcatggtggcgggtgcctataatcccagctactcgggaggctgaggcaggagaatcacttgaacccgggaggtggaggttacagtgagccgagatggcaccattgcattccagcctgggtgacagagcaagactctgtctaaaacaaaataaaataaaccaacaaacaaataaataaagtaaaagaagcctgagagagacccctcgtcccttctgtcatgtgaggacactgcgagaaagtcctcaccagagactgaacatgccagcgccttgaccttgaactttccgttctccagaactgtgggaaataaatatctgttgtctatcagccacccagattatggtgtttgttacaggagcccaaatggactaagaccgcacaaatgacagaagaaggcaaaggatgtgtttctatgctcagcagtgattctcgtagacccctggtcagcagtggagaggagcatctgtctctcactagccagcagtctgttctgctccctaagagagagtgtcaaagctctaggcccaccaagactttatgtcccattgttttcttgtctgtctgtctgctcctctcttgtttttgaatactgttctctggtgatactctaaccttgtaaaggcagtggtccagtgggagccatcaacacagagaaatcgctccttccccagagctcacctctggctgcagacccagcactccactccttgggctcctcccagcctgtgagctgactctgtgagctgagtttccctgcttttctatatctgagacccttttgactaactggagtgcccactggcctgagatacttttgtcatccttcatctgggcatttggcatgatcaagctccaagggaatagggattatggggaacaaaaaggatttcatgttactctccattttttttcttttcttttctttccctccttccctccctccctcccttccttccttccttccttcccttccctacattactgcnnnnnnnnnnnnnnnnnnnnnnnnnnnnnnnnnnnnnnnnnccctccctcccctcccttctttctttctttctctttctttctttctttttctttctttctttctctttctttctttctttctttctttctttctttctttcttccttccttccttccttcctttctttctctctttctctctttctttctttctttctttcgaggtagagtctctctctgttgcccaggctggaatgcaatggtgtgatatcagctcactgcaacctccacctcctgggttcaagtgattctcctgcctcagcctcccaagtagctgggattacaggtgcgtgctgccacacccggctaatttttgtatttttagtagagacagagtttcactatgttggccaggctggtctcaaactcctggcctcaggtgatccactcaccttggcctcccaaagtgctggggatttcatgttactcttatcattttggaaaacaaatctaacttcctctgagtgataactacacagatttctggccactgacaccttgctttccctcttatgtattctatggtcctttatggaacctcatgctctgcattgtctgaagaactgtctccatgtctctagaacctcactgggtagaaatgtggactcaggacaaatgtcatgctcttgggccagaatatgcatgcaaccctatggaaagctgtcctaagatgatataatttagcatgaaaaatgtgcattcacattgagaaagtagagccttcattggacagctgccactgcatgttattagggctcctagactaacaaagcctctcttttctcttctgttctcttttcacactcccttttgatgtcacttttctagcccacatggtgtcagaactgacccagcctagggattctggaccagacactttctgaaaagacccaagatgtgatggcttgttgtcaaaaacaattacagaaaaggtggcatatcccaagccagatggtatatccgatgtgacagttgggtctatgagatgcagttttaatatacagcaggcaaaactgcagtgacaattatataaagcagatgaagctgcttcttgctggtcagcaaacatcagctcagaaccactttacagctctttaccagcaactaagtgcctttatttacagagtgcctgtcacttccctttggctggagagctggtgtattatttagcacgcatttatctggggaaaacatttcaatttaaatcagctggtacaacagtggctcttgccagactgtttccctgtggttcaaaaagatgagaactgagtctgatcttggaagaaagggtgagcagagggaggcaatgtccgctctctgagctgcttcagttcatacctgaaaagagggagcatgccatggcatttcccattctgctttcatattgttttgaaatgatgatcttgtagttgcttcctgcttacccttccatgaaaggtaactcctaaggaaaagaaaaaggaataaatggctgttctccatgcatcaggcactctaaaggcccagaacacaaaggtgaccaaaggttgcttggattcagccactcactatgcttgcaggattcaggtgagtggaggaggtatccccataaacaatgacagtccaaggaaacaaggacgaggctagaaatagaggaacacaaagggatccttggtttaggtattttgaggaattgagaaggctttcaagaagaggtggcatcggccaggcacggtggcttacgcctgtaatcccagcactctgggaggccaaggcaggtggatcacaaggtcaggagatcgagaccatcctggctaacacagtgaaaccccgtctgtactaaaaatacaaaaaattagcaaggcctggtggcacgcccctgtagtcccagctacttgggaggctaaggcaggagaatcatttgaacccaggaggcggagcttgcattgagccaaaatcatgccactgcactccagcctgggcgacagagcaagactccatctcaaaaaaaaaaaaaaaaaaaaaaaaaaaagaagaggtggcatctgtggatgacttgaatgcatgtggctatggagcacttgaaatttaggaattaaatttttccttttaatttaattttaacaaatataaaaatttaaagtgatccatagccagtggctaccatattggatggtgcagtcctagagtgtagacttgtcttgctaagggtttggatttgggggagtcatcaaagatttataggaaaagagtaattaattccatgcttgaaaaagataacaggtggaggcaaagtgagctggcttgagacggagcgaatggaagtgacggcaaagattcctggggatgtgttagagggacagggacaagtacaatttggccccaatacagggtacatataaggcagcagggagagatgaagttgaaatgtgggttgggcattgaggaatttcttttctttcttgagttaggaagctgtaaataattttttatgtgtttatgagttaggaagctgtaaataattcactaggcactggggagctacagaaggtttcaaagcaagagagtgatgggattggacctgagctttagggagatggatctggcagccctgtgaagcattgtttggagtggaaaggaagaagatgcaaggactctggttaggaactgtggctatccagatggaagcctgaaaccttggactggaaaaagaatgggaggttctagaaggagtcactgtacatgcaaaacagtctgcatggatgtgtgtttccttctgggggtcagaggatggcagagtggagggacaggctgcaggagaaagcagtgttgggaggattgggttttagtcatggtttatttccacggggacttagtggaaaatccagatgggcatgaaaagctgaagggtggaaatgaagtccttaatccaggaaaagtttgcttctagcaatctggcccattgctcatgctctaggagcaaaggagagcctcagagagagggagagaggcaagagaattgcaggacagaagtataccatctcagaaagagagggtagaggaaaactttggtagaagccggagaaccaaaagctgagcctgtcccgaatgtcccaggggagggaggagccaagatctcaaacccaagacatatgtccactgccttttttccatattttatgctttatagacacacagacacacacacacacacaaacacacacacacatacgcacacacacacacagctttcctcccgccctctttgacctgaagctatagttacactaaatgaacatccacgtataagcggacaccctcctttctccacatttcaacaaaggttaagagcctcaagtagagaatgacatttttctttggaagtatggcagcagtccttggagagatagcattaattgggggcatagggtacaccttccctatcctaaagtctgagatgtcttttactgttccaaagaagaaaatgtgatttctcttttatctttgtgtgagacagtgtggattaggatctctaaattactggatgacaaaaagcagaacgaaaagggccttcctaaagtggaactctgggatcaaatccacaggacagaatgcattgaggacctctgcatgttaattttcaaatgatcagtaaagacaggctagataaaccttggtgataaaagcatcatttcttttgagcagtgactgtttcatctttgttgggataggagggaatgtgtcaagagctgtgaagatttgaagcagaaatttgacaaacaaacagaaaaatgttgtaaagaggacggccagaatggggcagtgcctggacaacatgtcacttgccaagtggttaagagaacaaagccagcaggcttaaagggccatttaatcttctgctccattggacaaaaaccagggccaatggttaataattaaggagaacaggattttagcccaacataaggaagatatttccagaacagcatggacagcctgcaaatgcagcgagcctcctatccctgactgtctctttgctaaaggagagttactgacacgctctttgtgatgggagggagattggtagagagatgagttctgtggtcctttataactaaggatatccagcatgttcttgatttttattacatagggatctgtgttttatatgatttgcattgtaactccagagggagagctatggtgtttgtcaggattggggtcatgagtcttttagtggaagcattcatgtccttcctgaacggcactgtctttgtgttcaaagatggggagcggacggcattggggtgagcagctgcagatctggcttttccattaattggacagaccaccccatcttcaacttccacaccacccttccacacctgcctttttcccagggctctgccttctcccacttctacaagcctggctttcctgacccccaggctgctcactgtttcttgcagacgcacctatacatgtatcctcacacacatttcccctccttgaagtcagagaagaattttttcagctgctcccatataacatttcattaccacaatattctctctcaattctgaaatggtgataggggagaagccatttctctttatacccactaaacgaacaaagctcagcgctaaaatatttttcttccattgtaactgaaactgctgttggcttccgtcccaaaaaccagaaagacaattatacttaactgtttagagatttataaataccacactggagtagcctctaggtagtaactttagatatctaccccaataattttcttttattggtttgtgatttagatcttatcttgagtcctctataataagagtagtacatttcattaaaagagcttactaaacaataaagaaaatctggcttagggctctgagcagatctcaagtacagaaaggggcctgccctgttacatttcttccgtggacatcccaagatgaatctcatcacaagaatctcaggtgcagatgtatttcagcaaagcagcaattgcagctgttttctaaatgacttcaacttaagagaatttttcctatatagcatatttcatcacatgagagatcctctttaaccctgccatttactattctagtaatgtattcctagcaagagaaacaaggaaaaacaacagcagcagctataataagagactgagaaacttggactactttttgaactcatggagggttttatgccctccatgcatgaaagactttcttggagagtggatgtgcagaagaaaaagtaaaaacagacagaatcatcttttccttccaaatggatgcagagcagattcatgtccccactcaggctgtgcccggcttgtgacaactgtcgtgaagggaaatcttagcttcagagacagaaagcagattttgggtggtcttggggttggactgaacttatggttttagcatctggctctcacatgccagtttactcctcaaaatttgtgtgcctggttaatgccttttttaagaaaatgtaatttttttttcaggtgagccatacaccagacacattcctatgtaatatcttatttaatctccctgacaacctgctgagggagagttaccaccttcattttacagttgagaaagcagagattcaggggaattaggtacctttcccatagccttatagctagtcaagggcacatggagttgatctccaaacatctgatttcaaagtctatgcttttctcggcacatcagcctgtctcttaaaaggcaagtgttatcctgatgagaatgggcctgaagctatacatgtactttcaagggtcatgggggcacccccaggacaaacactcaaggggatgaaagtgctcaaggtgtgccagcctcacttctaaactggtccttgcacctaaggggctgaagtttgttttcaacggttcttgtctctgtgaatccccattttttgagccccttgaccctagctgttccaacaatgagagatactaggattctgttggcttcagtctttcttgctactaccactggacaaatgagtaaatctgggggcaatgtgaagcactgtgcttagcctgtctctgtgaacagtatgactgttggagtctttcttttccgtttttcttgtgaatatagatgggacttcggagctgtaaggaagagagtggaatatttgagacctagctgttactttctttgtgaagacacttaaataacatgttcaggttttatttactccttccatgctcaagcggaagtttccgtgacagcagatgagaatgaagagaccactgtagcgcccaaagcctaggctcagaaaatggtccagagaaattgtcttatagtggggaaaccacagctgtagaatcagagagaagtaaaggaagtcttgtaatcccatggaccctctaagacacctcatgaaattctggataaggataggtcaactaccctatcctgcatgtcagtttggtttgcatcctatgcatgaggttagtgcccctgttgtctccatagtctatgctgtcatagaagtaatggggtctacaggcaaaagggacagaaacataaaataagttgtatggaatgactttgacacacatacttaaggatacagggcttggaacatttcagtgtattccttgtgcagagtgtgagccatttcattcaatacacctgctgtgaagatagcacacatgcctcaagctggcagataaatctagccagctattcagtgcatttttgtcttcacctattctctataggcaatagctcatgtgcagtcttaaaaactttacttcttttcttaaaagcaacaagagcgaaattccatctcaagaaaaaaataaagaaataaatggccctgaggccagatgcagtggctcatgcctgtaatcccagcacactggggggccgaagcaggtggatcacctgaggttgggagtttgagaccagcctggctaacatggtgaaaccccatctctattaaagtacaaaaataagcctggtgtggtggctcacatctgtagacccagctactccagaagctgaggcaggagaatcacatgaacccaggaggtggaggttgcagtgagccgagattgcgccattgccctccagcctgggtaacagagtgagatcccatctcaaaaacaaaaccaaaaacaaacaagcaaaaagaaaaagaaagaaagaaagaaagaaaaagtggcactgcaaagaagccaactgatttataaatgactttagttctggatttattgaacatttaaggatatggctagtccttaaatgcttcaattatacttcatggaatggtctggaggaaaattattttctgaattccagaaaagcaggatagtccttgagcatcttgttacagatctccaggagagatgttctaccagatgttttcagtgtcccatgcatgctgccacacaatgtgttatgagaaggcagaggtggctttgggctgtggtagtcaggaaagactccagagtaaagggaccagaatttgaaaataagtgtgattaatataaataaaggttccgacaggcatgtggaaagggctgaagctgagtaacagaaggcacagaaacaggaaaggccgagtgtttttcacagagggtcacctggctatttgtgtactaatggtataaccaaggtacttaaagggctcactatgtcaaaggaaatgcttgtaggtgggtgcactgttaacctgagtagatcctccaaagaagagcctgttctattgttttgctgacctcttcatgctcgccaactgccagaaatctttctaaatgcttagcacagtacctcacacctagtagacactcagtagaggtttgtggaggggatggatacatgaatacatgatttaatcctgctatctgttgtttgcagcctgttctctcttaacgtgccctcaaatgacataaagcagccaaatacctgtattaaaaacctacactttccctccaggatttagtctcccttcatttgacaactgggcactggacaaggtttacagagatcaaagatgttgcacttgtctggaggagcctttatcagatggccaggttgtctctaatataaactgtactattcccttaacctttactaatagctcctggccctcaacctttgactggcctcgctgaatgtactattacacagtaccaacccagggcccaaggctgtaggactgagacctccaaagttcaacaaagggcagaaaatatctctgctttctgctccagggagctgtgaatgcttcctgagagcttccctggccatgtagaaatgaacattcctctcagcggtagactggagcaggaggaacttggaagatgtgttttgttgctctagttcatgatagtgaatcacaaacatggctgtcagagtaatgatgcagtcatggagggttaaggaacagcttttaaatcctggttctgtccatcatgagcaatttgacataataaagattccagatttcatttcctcatctatatatctatatattaaatgaccccaccccaaaacaccgagggatcagtgtatgaatacaaagacataatggctgcagaaaggttattaaacatcaaaggctgtagaaatagcactttgcagtcaagttcagtcatggcacacatgggtctggaatgacagcttgggtttgaagcccagatctgccacttactaggcctgggaaaattactttacctctttttatctcaattttctcactaagaatactaaatgcacctggcttatcaaatgactatgagaattcaatgagatacaggactttctattgtccatacagtacctttaagtaagccagaaaaagtcactcttttctcaagacaccttattttcatctgctgaaaaaaatggtgataatctactaatatgtttgaacaatacacttttctgtcatctgctgggaaaaaatattgtcataaatatgcaaatatacaatgcctattgatatgagtggtacccacttagattagctactgtgtagtgcccaaccttcacaaccatacatggcaaccctgaatgaatggctgttaaagcacttcctacctaggatgggagaaatcaagcaatgttagctatttttgttattattattacaattttactattttatttcatcccctcctactcccagattaacaaatcataagttaggattatccacttgtacctagcagccagaattactgttgatctgtttgtctgtaaatatgcatagaaaatagatgatgatagaaaccaacacacctttggaaggtgagcagaccaggtaaggtagactaacaaaagcctacagaggagttgaggaaggactagggcagatgaacagtgagcatggggcgcttcccctccatagacaggctagcatggcgccatgcaacgcagctgctctctgaagcagagattgggacagctcgctgacagaaaacctcatacacttccaacctctggggtttggttgtggtaggagccctgatgttggtgaagtgacacccttccagagcaggacccatgctactccacctagtcaacagatggcacttggcctccctcctttgcctcttttttttttttttcttaaaacagtaattttgggtctcagccagaaaacctatagcatattagttctcaactgggaaaggggtcttgtacctacccctttaaatagctaataatgaatcttctctgtgaccctcctcctacctcttcatagacacataaatatttatatacaaatttaagagttttgtctaccctaatgattttcttcccctccaggtttattgaaatacaactgacaagtaaaagttgtatatattcaaggtttacaacatgatgatttgatatacatatacattgtgaaattattaccaaaatcaagttaataaacacatccatcatctcccatagttactattgtgtgtgtgtgtgcccgggtgtgtgtcatgaggacacttaagatctattctttttgcaaacttcaagtgtactacacagcactatcaactatagtcaccacactttacattacagccccagaatttattcatcctataatggcaagtttgtatcctttgaccaacatctccccattccccctgaccctcaccacagtccctggccaccactgttctactttctgcttctatgagttcaactttttagattccatgtataagtgagatcatacagtatttgtccttctataactggcttatttcacttagcatgatgttctccagttcatctatgttgttgaatgacagaatttctttcttttttatggctgaataatattccattatatatatgtgcaggtacatacacaacacagaccatattttctttatctactcatctgtcaatggacaccagtggtttctatatcttggctattgtgaatagtgctccaataaacatggaggtgcagatgtctctttgagatactgatttcatttctgttggatatatacccagaagtgggattgctaaatcatgtggtggttctatttttaattttttatagaaacttcatactgtcttctatagggctgtaccaatttacattcccaccagcagtgtacaagggttcacttttctctccaacctcaccaacacttgttatcacttgtcttttcaataatagcaatcttaacaggtatgaggtgatatcttattgtgatttgcatttttctgatgattagtgatattgagcaccttttcatatctacttgttggccatttgtatatcttctttataaagatgtctattaggttcctttgcccatttcttaatcaggttatttattttcttgctactgagtatatgagttctttatatagatgggatattaaccctttattggctaggtggttttaaaatattttctcccgttcagtagattggcttctcactttgttgattgttttctttgctgtgcagatttttagtttgatgtagtcccgctttttaatttttgcttttgttgcctgtgcttttggtgtcatatccaagaaatcatcgcccagaccaatgtcaaagagcttttcccctattttttctcctaggagttttacggtttcagattttacattcaagtctttaatccatttgatttttgtatatgctgtaagagaagtgttcagatttattcttttgcatgtaaatattgttttctgaacatcattattcattgaatagactgtcctttacctattgtgtgttcttgacatccttgtcaaagattagttgcccttaaatgggtggatttaattctgaactagcccactgtttttcaaccttagctgcacattgcactcacctggggaacttttaacattcttgaaatgctcaggccatactccagagcaattaaattagacattgatgcaggcatgcattggtgattccaacgtgcagcccaagttgagaaacaccagcctagccccttacttactcaaggaaaccatctctgatccttgtatcaggcagctgatttactaaagcttacatttccatagaaatttatcttggaaatttatttatagaataaatcattctcctaggcatgattgctaggagatttggaaagcatataatgggcattgtgaaaatgcaagatacatgagaaattcacaaacttccacatggttcccagcagggagctagtgggagctgggaaaataaaccagggggtgtccatttgagaggtcaaggcaggtgggcacaaacaattctttgaatacctaatcagcataggaaatggaagaattttgaaaatcaatcaggccatgggcctaaaggcaagcaaggaaggtaaataataataacatcagggttgaggtttcacacttaatctataaaactacttttaataggcccctaggtgattataaattcgtggtggctttctctttattgggattatatgggtctattccatatttccaaaggaagcccttcctattatgcaggtgtgtctccttatttatttatttatttgcatttaagatattgaaacttttttaaaaaaaactcatttctgtgagcattaagtatataccatgcaaggaagcaattgtctctatcttatgaaatattaaatcaaaatgcttcctgttccctcatgtcccagagataaatacagcagtactttgaagcccctcttggagctgttttgcctgcaaatttattgttttgtctccattttcagaaagccctgttttctatgaagtatagcactctaggtagtttttaaggcgcaaactcctctggagttgcctgtgtcggcaacaactcttatgtagatggcacacgagggatggcgcgttgatcggctcctttaagatgacaaatgggcagagagtgttattgtctttgattgcatgccttacatcatctgtatgtaggaataagagggccatactttatctttagccattttataaatatttaagtccttatagttgcctaaagatattaaagcatattttacagtagtcggaatataaatattatatatagcacaagataccaaagtagtttaatgaattcataattttctgctcacatttattggaatgtgttttatgttccaaaagttccatttaaagaataagataccattctactccctgacaacacaccaagcattggccagtgttgggggcggggtctgagttccaatgtggggaagattctattaggaagcatggaggcaggaagtctcttccctggaatatatttcttctctctttaggtctaaatatgtgtgtgtatgtgtgtgtgtgtgtgtgtgtgtgcgcgcgcgtgttcgtgtgtgtgtgtgtgtgtgtgtgtatttttctgaataaataattctggtgcttatttaagtcccgtagcatttcaaaaagaaaattttatatctcctttcttctgtttcaaggagattaattcaaataacataagtaagagcaataaagataaagtttgcaattttcccgtcctcccatctccaactcccttttgtaaacagggatgcagattctatttgccagtatacaatggtgatccagggtcttaatgtgggtagtgacttcccaatgcattttgaatatttctcctgaaattaaagagttccaagttgcattttccttttcctaaatgcaaaaagatgacagggagaatattactgcacctcttttcaattttccagtgaaatataaaggctttcttctttaatatttcacaaagttcctccagttcccagtgggagtctatgctgggtaatgtttgctaattaccaacaacaaaactagacatacaacgttggtaaattacctgaccctttcctttttaatgagacaacaaggatttcgcgaagtggtgttgtttcactggttaatggtgtcagcaatgttgtaattgtgggttgagacacattagctgaacaaccacatgtagaaagggctttctctcgacaagctgtttggagactagaaccatattatcattaagcctatgtcatttgcatgctgctaatcgcttactttattatcctgcatatccattgtctttctttaattactctttaaattaaaattaaaaatagttttaaagcccacaatgcccgagatagcatcttgattatgaagataacttcaagaaaatggaacaactggttatatattgcctggattatgagagtcccatcgttatgtactgtgcctgcaggcctcaggggcctaattgcggtggtttctcttcctttagcccatagtgtttgtttaataaatggttatttatggccttctcagccattagagcaactttggagaaagtacttccttctccttggtttgagaagtgaagttttatcctctgggcaaaggtataaaactgaatcaaaaaaatctggatgtacactagagcttgtgaaggagtctgtaaggagatcctctggattccctttgctagcttattttgttggagatcacgtttaaaatttggggtcatgaaagagacataaatctcaaagctgagagggccttagagtcattcctattttacagatgaagacaccaagggccacagccattgccacgactgtgatcgcatagcagcaaatgaatgatttgactgttagcaaatggaaaggatgcagggctcctggagggaggatcatgccttaggggctactcctgagagaggatatgatgtgtacctggagttgtgatgtgcaagctacatggttgttgtggtttaatgtatttggtgcgcatctcttgtatgaaatgttgatatgtttgttgataccgacaatgtgataggattctggaagagagggctcctgtgttccacttccttaaaagaacaaccccatgaatgactccacagacattcctgaatattgagtagctgaacacagaattatcgtggtttcaatattatgtatgatgcacggtaatctaaagggatttgggacattgctacaacctcattttatggatgggagaactgagtttggataagacattgaatccttctacattctcacagagaggtaggagttgacctgggactaaaacccatgtgttttgttttctctgtcagcttacaaccctgttgttgataaataatagtaagttagtactgatgaagtacatgctctgtgccaggtgctgttgtaagcagtttccctgtattattattattaactcattcaatcttcatgacatcttcctcttccaatttgcagatgaggaaactgagacacaaaatttaaataaattgccccagatcacaaattagaaacagaaagaggcaggacccaaactcattcagtctagccacagtgttcaagttctagaccacaaatggtatggcttatttcaggtagtggtcaaaagttattgaccacgctgtacagagagatgctcagagtcaaaccagcatcaaaccctcatctagtgaagattcgtgtgtgtatgtatgtgggaatgcctgaccccaagatccaagatcccagtttcctattcatctgccagcataaacgtatgtacaggaaacacttcaacacttaagaaaaaaagattctttcttttaaagaaccatcaactgtttggaaccttggtgctatcttgggccaggcgtcttgtctctagaaccattcagagatagctggctgaaagttgttgatgcgattctgctttcctgaatttcatggcaaggccttggatcacttggcaaacccatcttttacagctacttaattttctgtgtgcttaagatatggatgttatactttgctcgtgattttggagttctggtttctgctgtgctggccatcaattcatactaaaccaaacaactggggcccatttggcatttggtgttttaaatgtaaaaggacatttgaactacatgacaaatgctgaaaaacaaagcccatagcaccaagaacataaagaaactgtttataatgaaaaagtggttacattttcagtcaatctatcactttaatgagctcttcacgtttctttgattaatgcttgcaaaaggggagaaaaaaattgatgtaatggaaacaaaatggtatatagtcttggcagcatgaggggggatgtctgtgtgttttattagtatccccttgatatcattgtcttgtaatgtatatatctgccttttccctggcatagtaagcctctagtttactggaaatgtgatccatcatgaaagaggagatcccatgttagtggcaaaacagcctttgtcctcttgtggtggcagcaaagagggagggtcccagaacaggaattaagaataaataaaaacaataaagaaaggttagcataagctgtgccatattgaaattgggaagtccagtgggtatatgaagataaaacagaagaattaaagatgcttaacaacatttaaacattaatatgtagtaatttgtatatatttagtaataattcatacattttaaaataacgaataaaggggatggaaaaaaaggcagaggaaaacatcttcataaagtaactaaatgtgagaagttattcaaggcagacgtcctggaagaggtaaagaaacgacaggagctgggttgggagggaagagggggaacagcgtttctgaagtgggtaaggctggtgggagcagggatgggcatcagcaggtgccactttccctctgtgttggaaaccagctctgactgctcctcccttcccctatgtgcatggggcattgtgggtttcttgggctcttcactgcccatgtgtgctttatgtaaatggcctctgctctgagattgagtagctcttacaagatggtgggaggctgaaataacagagaactaggaagcctgaaaactctctctgggccctgttcttttaaagcccctttgctttgtaaccttggcctgatcacttccatctcagaacttcagtctccttaactgccaaatcaagtggatgttcaaagacctgtcagacccttacagatgaaccagctgtgtccatccatcatgttcatcagctgctctcaacccatagagatcacatgaggtttcgagatttcagggtctttaacatcaatttataatttaaaaaatttttttcattacataaataaaatgtgtttattttagaaaatttagcaattatagaaaccaaaaagaaaatgcacattccctgtaattttactgctcagacataagaaagttgacatatttgtcttatttccatagatataaatacttttaccctcaaaaaaatggatcatacatgtcagtatgttacctgtggtttttcacaaacattttatcatgaccatttttctgtcgtgaaatgtttttctgcattatttttagtggatgcatacttaaccaatttccctaaaattggacattcatgttgttttcagtggaatgttgttacttaatacctatgaatgaagaccctggcagccaaatttttaatgtaaggaaattatggctgtacacatatttttagaagtacaattgcttaggccaaagtggaggtaaaattataagtaatttgatccacactggccaagcaagtatgtctcattatattttattttttgagacagggtctcaccttttcacccaggctggagtacaatggcacaatcttggctcactgcaacctctgcctccctggctcaagcaatcctcccacgtcagcctcccaagtagctgggaatacaggcacaccctaccatgcccagctaatttttttgtgtttgtttgtttgtttgtttgtttttagtagagacgaggtttcaccatgttgctcaggcttgtcttgaactcctgagctcaagcaatccactcacattggcctccaaagtactgggattacaggcatgagccactgcatctggccttatttttaaattgtaagatgaattaagataaggtaaaactgagaagttgagatgttgtggagaaagcaatgataccatgagctcttgggtaaacggagacattagaccgggtgaatattaggtttctctccaaatctgtagttttaggtgtgtttgagttgttactagctttgtctttttcttccttcctccccttaaccaacccttctgagaaacatcttacacagtaagctctttaagcgaattctttttttctttttttttttttttttgagacggagtctcgctttgttgcccaggctggagtgcagtggtgcaatctcagctcactgcaagctctgcctcccgggttcaggccattttcctgcctcagcctcccaaatagctgggactacatctttaagttaattctaaggaaagagactgtctgcttggagagacaagtcctgtaaatatatttgtttcatgtgtgtgagacttgtctaagagctgaatatattttacgaatcttaatgggcaaataactatagagaagttttgtttgtttggttggtttaatttgctttggtttgggttggacccaaaatgtaaactctaaaaaggatggggcactttattcagtgggtggagtcaacttgcaaaggtgctaatcaaagacagtctctaaaaaaatgtaccgctaaaaatgtcactgttagttactgtaaatagaaagaaacaaggagagtattaagccaggtcttgtccctggtcactggagacaagcaggaaaccttaaatgaagatgcagtcatttgtttcagtagaaaatcaggccagcatgaatcatttcaccgcgaagagaatggagatttttctcagttgttgtactagttgggacattttggcacaagtgaaatccaatgcaaaaaggcttaagtaaaaacagagacatataactggaatgtctctggttttaggcacatttgtgtgcaggaacttgaacaatgacagagctctatctcattctctccacctcttggttcatttgccctgttttcattcaccccatggtgggctaactgcttgccagtagccccacacctgcagactcctgactttgcaaccacagaacctttaccatcttttacataatgtcctggggagaatacggacaggccctagattgaggaggacagactcatctctaaactgatgatgtggccaggattatgcaggaccatcagcggccctgtgaagtcaggatgcctggcttcatgttgccacttctgtttccagggtgggggcggagtttcttccctgcacccccaacaaacactgtggaatgggtttcttatgcatagaaggagttaaaaaggaacagaaaacagcagatatcaactatcctggttctgctgctaactggttctgtgaccttggatataataacttctccattctaagcctcagtttcttcatttgaagaatggaggaattgattagaggattttgaaaactctcgtgtttctagcatagaatgattgctgaagaggcaaaagacaccttatggtttggctcaggagtcacagaattatctgtttatacagtttccaagcactgtcattaggctttgtgcgggggagtcacaaattggcaggggcatttccccgcttccctccttgacactgacctccagcaccttgttgggggctacctctaccctgttggggtggcctttggggagtttcaggagaagctgctgccttggtaaataatcttttttttattgagtaaacatggtcagctgcctggccttcctgactctggattctagcttcataggaagccactgaaaactactgtgaaaaaatattacaaggttaaactgaggtttttcctttggctggatttttcttgcagtcatttccaaaaacctgtttcccaaatcaacctggtgtgtgtggattttcttcccctacaagttagaaagcaattgtgcttctatacatggaattttctttacttcagctgctgaagcattcgttggaatacatactgcaaaaatgactgctgtggctattaccgtagttgctcaggggagctattcagatgcctcatttattggagcttaatagattaaaagtccaaattgagtctcatgatataagcctaatcaagttctaatctgcataattttcccataagcagcaatgggaaatttggataatttatgtttcagcagttgccaatcatgtgttaaatagcattgttgcatttacttatcaaaatatttttattgatctgcacttcatctgacatttgcctttgaggtttttttccctggcattaacaggaaatttaattcatctcatagatgatgtaatatgagatgtttctcttgattttaacatgtctttatagatcatttttaaaggtgatctttcccttttacaacttcatattgaatacctgtctcagcaaacctagatgactcggcctaatttatttccctagtttaacgtagcatatggatttctaaccatcatttatatgcacacaataaaagataatttggcccaccatttgaaccaattcctttatgttaagtctatgggggtgggagaagcacttaccttcatttctccatctattctaggggagatgattgataagaatttccatctccctctctccctggaaaggctcagggatttaactagggaagatttagaaagtactttgtgtttcccccatggaaaagtactgtaataaagcatttattatatgtactgagttgtgcatgctgccataccaaagcaagttaagcataactacaatgggtcccagttgttatctgctattgtttaaaagtgaaaacaataaaaagtaagactggctcaggcctcagacttgcctgccagggacagtacctagaaggagaaggccagcacccaagtcagggatgcggcacagcctgcaggtgtcaggagtctgaggtcagactgcctggctgcggctcccagggacacttaccaattgggtatgcttgagccagttatgccactgctctgaatcttattttcctcttctacaaaatgcaaatatcaacagtccctaaacacacagggactgttatgaggaataaacaaggtggcccatgaaaaaacccttagcccagcctggcacataagaagcaatatggcgtggtggcttagaggagacactgggacttgtttatctgggttccactctgagatctgctaattcctagatgtatgtcctggggcaagttgcttaccttctctgtgcttcagtttcctcctctgaaaaatagtagtatatacataggatggttctgagaaccaaagttattacgtgagcaaaattcagtacatagtaagcactcagtaagtgttggctattttttttctttgggttctagttcagccttccccctctcttcttcattctcaattattaaccagtttaggtctagagtattcttgcctttgctttgagtctcataaaaacaatgccattgagcctttctcattttccaatgcacttgggtttacagtgtcctggaacccttttccagccattacttgtgtatatcttgtctgagccatagtccttctttccttatgatcacataaggaatattgtgtgtatatatatatatatatatatatatatatatacacacacacacacacacacacacacacacacacacacaatgctcattgccttctcattagtattctaggattttctgtgtgtgaaaaatcttttttaagaatctactaaatacttcttcagttctttatccatagggaaggggaagtgatccacgaatacttattgtatacctaataaaatattaatattggtagccagcattttttagcacttgcctcataccagatattgtactaaatgttttaaatacattattttattttatccttacaattgtcctatgtgggaggtatttgtggtttatcgatgaagaagcagactaggagagagtctgcacaatgcttatagtgccatggcttataggtggaggtgccagaatttgaatccaggacacctgactttacagcccatgctgttaacaatttcattctatttcttttctatgtgctgggcattttgtagataatctgggaagttcaaagaaatgaaaatccagtctctgacctaaagttcttatacagtatatagaatgagaatatctgtcataggataaagttggtcaagcacttatgtctcatgctgaatgaataaaataggtaacaaaaacctgccacaccagccactgaagattggagtggggagaaaacttacagtgtaaggagttcaggtggtctttggaagttatttattttatttttattgtttccagaagttattggggtattggggtacaggtggtgtttggttgcatgagtaagttctttagtggtgatctgtgagattttggtgcatccttcacccaagcagtatacactgccccatatttgtagtcttttatccctcgtctccctcccactcttaacccctaagtccctgaagtctgttgtatcattcttatgcctttgcatctccatagcatagctcccacataccagtgagaacatatgatgtttggttttccattcctgagttacatcacttagaataatagtctccagtctcatccaggtcactgcaaatgctgttaattaattcctttgtatggctgtgtagtattcactcacatatatatgtgtgtgtgtgtgtgtgtgtgtgtgtgtgatgtgatatatatatgtgtgtgtgtatatatatatatatctcacagtttctttatcctctcattgattaatgggcatttgggttagttccatggttttgcaattgtgaattgtgctgctataaacattcgtgtgcaagtatctttttcgaataatgacttcttttcctctgggtagataaccagtggtgggattgctggataaaatggtagatctacttttagttctttgaggaatctccacactgttttccatagtggctgtagtagtttacattgccgccagcagtgtagaggtgttctctgttcaccgcatccatgccaacatctactgtttcttgatattttgattatggccgttcttgcaggaataaggtggtatcacattgtgttttgatttgcattttcctgatacttagtgatgttatatacaaatggccaacaaacatatggaagtcatttttagcacaaaacttgcctcccatggccatgatcaacaaagtgctatgggtacatggctaaagaatcaggagcccatctggtgatagctttggctgtggatgatttaaacttcagtcttttcctgattgaggacttctcattccatgtctctaatggtgatattcttagtcatcttttctggcaaaataagtggttgtttctaaaattaacttcccaagtgttagtttaactaatgaagggagtgtttcccagtttcactgttctctagctgtagatctctggagtatattccatgtgccagtgtgttcacatgcagaactagggcgttgtttaatgtagagagacttcaggtgctacccatgatatagtcatggctgcaagcaataatgggaaggagagcaagatggtcagagattgggccacaatttagacctgcccctttatcaaatgcagctatgaggaatgcggtggacaccatcctatggcatcaaaggccggattgcctcattcctttatggaaggtgcttgaatttctcttctctccaaagccatttaaggaatctggggcaatcctgccgtttctgaccataattttcccatatcagtacccctaagaaagaaacaatgctaataaattatgttcacctttaacataactctacaccagggaaaaagaagaagccaactttgctgttattgttgccttttgcttttaaaaatgtgtgactagaaaagtagggaaacaaaaagaggcatgaagttttcttagcaataaaagcacacttttttggggagtcatgcataggggagagttgggccttcaacagagagatgtctttggacacctaccatagtttgtcagttgcagatgctaatggaaccaggcctggtgactgaaggggaaaatggaatatgaaagcaaaatgaaagaagcctatgaagcaagcatgtcatttccaaatgaaggtttcatgcaaaggaattgagtcttttcacagctgaaaatggaatctttaaataagataaaataaaaggatgccgtggcttgttgcgagttctgtaatgaaatacagttttcctaataccgtgtgacctgcatttctccctgctttatgggtgctattccttgacgtacaaacccgtattttctcaagtcagcatttgatgatggatgtcaaaatacaggccatgtattatgcatatagcattaccgatttaaggtgtttacttgtcaagttgaagaaattcaaaaacgtcacatccactgaatctgcacagctgtcacttccagtttttcatgtttttgaatgaaacttctaatgaaaacagtttagttttccccttcaccatcctagaagaagaaaacagctagcatttaaaaatgcgtgtttttggttatgtggttggctgaaaaacatatattcgaaagtttgaaaagatggacactacaatgtcaatcaaaatgacttacccttttcatagtgtattaatgtaaagaatcaatttaagtgcagtcagggaatggatattaagtaaaactttgtctttctttttgaaagtatggcactcagtgataagaaatgtatacacgggagagcagaaagtaagaaaacccttttatatttctctggcattttatgcattatgcacctccaaaacaacaggcaattattgagctcccgtatttcattcctgactcacacctagccaaaatgccagactcaacacaatcttgtcacattgctggaaagtgagtcagatatctggtcacataataatctatttggagttttatccttggaaatttagcaagtgactttgttcctaaaagtccctaattcattggtaagcccatgtagcattccgctgaaggaaaaaaggagaaaccgaagtgagtgtgaatgcttgcctatcatctaaatgtaattgcactgggtcttgccacttgcgtggagctgccgtatgcttcgttagaaaaattaatttttaccagatgaatgtaggaagtaaataggtttctaatattgatatgtgtccatgcaaaaccttaacgaggcagacattctgcctagccgggatatttctcactctcactaaactgaaagttacagttgttccaacctcatccaggtatgtacttggcttggacctgggacccaaagaagcccaaactgcaaaatcagagaccaagcaggctgctttccaattttcctgtgtccacatataccttatgtggtctgtgtttggcacactgggaagttcaagggatcagccataagcaggtggcatatacattagtcaggaggatttagatgcaagtaaactccttctccatttagcttaaacagaaagaaaaaaatgtgaacatcttattatattgtgtgtatgtatatgtataaatacatttgtgtatgtgtgtgtgtgtgtgtgtgtgtgtgtgtttatgtgtataaaatctcacatagggagaaatcctgaggtgggatggctccaggctgcttgccccaggaactccaggacagctcttcctgtcattcacttgagccaatatcactaagttagttatgccctcagctggtgcctcagttcctggcactacaggcacataaaaccgtgctcagtaaattaaaagagaatctcttcctatgtgtttctttttaagagcaaggaaacacttcctgaaagccccaggaagatttcctgacacctcccattggccagaactctgtgaaaactgaggcctaagtcactcaccagcaagaggataagcaattgattggtttacggtaacagtcaggccaggttaggttatgttgtggtaacaacaacaacaaacaaacaaacaaacaaatctcagcggcttaaagcaacacagctttattcttgactcactcagtatgctttgtgggtctgggtaactgtccagggctgttgtctagccttcatctccatagtaacctgtattctcacagttgccatggcctgggaagagagagatggctgtccaatacctgaaccagcagtgatatgcactgctctgctcacttttcatgggccagagcatttcatgtgtcacatggccatacctaacttcaagggggcacaggggataattctcctgtgtccctggaaagagatgggagccaagatctatgagcagaataaataattggtatgaagtctggattttttagggaactatgaagtgagttacgattatttataatggtttcctaccctgtccttctaaagaattaatcatcagagtttatcccgggaatactaattgttgacctgtgaataatgcataagctacatttttggggttgtatgtatatagtgtactctgattatttccaaattttctacttctctgatttttcttcctcctctgtttccttcccactagggttcacacctccaggaatggatagatcctctccagataacagcccagtgcacgggatgttacgtcaaccatccatcacaactggggtcaacatccccatcatcactgaactaggtaggggtcaatgtcagctttggggggagtttttgttctgtctttcaaaccatacaggatatgaggaggttggtttatttcttagccctttcaactttgtagctgctatggggtttgttttgagggggctgggaggaaggtatggggagaaatatggcagattaccggaagggaaaactgatctatctttcttctgagatgaatagacagtttccttcatgctggtcactgttttcaaaggagcatgagatgatggatttgcgattggggcattcaattgggaatggagaggaaaggaggaaaggcttagttcacggattctttctggtgatttttactgtaagaacctcttttgagcattctgtctggacagctcctacaatctgagtcctccactgatatacaaagcctcggatctaagccaaacccattttgggaacaaggtagaagccctgggctaatgtgtaataacttgacatttaacgtatcgtagttgaatatctcagccaaaagccattttcagcaaatgccattctggcccccaaaatgatggggttttgagggccatgttggttggacaatagaatctaacttctaacctggccatggcactccctgttaccattagtgagtgtgcaaaactgtagagtggcctcttcccccaagacaaatgcaaactacctgtggtccggggtccctttacttgagaatgtttcctctgttattccctcactctcttctttttctgtactttcctccactccctttccccaacccttaaatgctgtatccaattagctaaaccgggcaagttgcctttggtatcagtcaatcaggaaaaaaacagtgggacgcacattctaatgataactgaactgggtaagaagcactgttttccttcacatcagtatctccttttgttctgttgttggtgtttccaactatcatcagcttgtttttatttcaccggctgtaacagaaaggctaccccatggcactgctttgaatgtgttttatttgtggctctggttggaatcgactgtcttgttctggcctttcttaatgattttttccccacacagcatcagtaaacctttgatcacacccatctgacctggcagttgtttccaaagcatctttgctctaattcattttctctggcctgagccttttttccccacttttttttgtcaccccgctctcccgccttctcccttctactcctcttccaacatactgtcagtttgaatgacatgtcttcacagctcttagaggaagtcaaaggagaatatcaaaattttaagataagaaacctaagatggcactttccctccagctgtttatttttctttattctgactttatttgcctttttttttttttccccctactagggcatttctcagaagctctggttctgaagccataaaaacacctggtccctaggagaactttttttactaaaggcagatttcaagaagggtgcggaggataaggttagcagccacccacgtgcagccctgcactctggcccccaatcccagcccagaatcctctctgggagattcacaatggactcaggtggacgataaaggcctccagtcgtgactgcatttgttaggttcttccccacttccccgtgacttggttaataactccatgaagggcacccatcagcagcaagtctcagaactggggattgatcttctaaatagagacagcaaaagtgctgctcagcagaggggtggatagagaggtgggagcacctgccttcacatgactcacaaatgaaatgaacaccccattttcttggcccaaaaatatatttcaaaataagggagcaggctttcaacacagtaatcttgcttgcgagatgtctagaaaccaaggaataaattgtccaccactcagcagtgcattattgtaggtatagctatttatcaggacaaattcactcaggtcagggagtatcacactattttctgtttccaaccataggaggggtatctttttcatgtttagtgtagttgtttaaaagccctaggtttctggattgctctcctcagaactggagggcaataagagacccagggctcatgtggtccacgcctctggttggaaaattaatccaaacatctccatctcacaaacctacagcagcatttcagaatcctcactgccgggaatttcattttctatttggaattcacgtgccgctgactaactaggatatcttaatttgtcattagtagacgagaaaaggaaaagcttggtgccccaaacctaaggcaacaattctggtatttgattagcatcattgactctcctgaagcctttgtcccacaccagatttcttccttgtgttcagagaatctttcaggtgctcacaccacccttgtcttctgccttgaaacctatttctctagccactataccaccctcctcagaccacttcacctcccacatcccccacaaatacttcttatttatctacatgttctgagatgtgttctgcattatgccaggccagtataatgaattttaagagacacagagggcaccaaggccacacaagctttcaaagctgtgtagcacattccacttttcatctacttggagactctcaattgatgttagcatggcaaaggctcctcagagtctcacaagaaaggactgtgttacagctgtttcacctgactattccaattgtatttgaccacatatgctttggggtgattacgtgggtacctcttagcacccacataattactgttctgtgaaataggccttgagtagcattgcttgctctccttctgagactgggtatttcagaacggtatacaaggtattcactggaccctggctggtctcttggagcgcttttcctatgaccccagatgtctagctcactggcaatcgggagtcccctccccctacttggagtcacttcacctccatatctggtaccaacccttccccatcttcctgataagaggtaacagatgctgtgcttttcggagcattgccacacacaccattggtggctattacaagtaactaaaaccacattcttccatatgtcgtctccagtttacattttctgattcacaaaacagaaagactaaacagtggcctacaacatccctttggacaagtgaagggaggtgaggaaaagctacctcttgaaagacccctgagcaagaccttcagtgtttccaagagaggcagagggaagctgggtattttcatgctataatgggtggacaggtatttaatgtcagaagggagatcatgacagcagctggtatttatcaagtcatggcatgatccagatgctgggccaggcttactgggcaccatcccattcgtatgagcctcctgacagcctcatgagagagctgctgtaactcccccattttacagaaacaaactaaggtatagaatgatgaaatgctttgcccaaggaagttggcagcacaggctggactgaagcccagttgtcagagcctggattttggactttcaccactagcctgcaattcaattgctgcttaaacaatggggacccaaatgtgaccaattttggaagaacagagcaaagattttccccattagaatttttctctggggaaacaagatgatgtcattttaaaatactaattccatgcctagcctttcatgctagtatcatttattctgcttcatacagtaaacaaaagttttttttttttaaaaaagaagagttatcaagaaagttgcttaaaaattaaaacaatcactctagaaaaaagaattagctgttgatacatttagaaaggaatcagggaaaggaaacctcatctgttctcttcctaaaatcacaataattatttcagaaattttgagtgcccccttctcccatccccccaccgacttttcccctattacttgctctgcaaaactgataatttccaaagccaagatgggaatggaaattaatttgtcatttaatttttaataagttaaagacatctgagtgacacaactaatcagcctgcacgtacatgcgggaggagtccttgaggaatcctcagatggaaatgaaatacagcatccaatgctgcatctgcttgaatgcaagcatataaaagattgagctgtttaggatgggaaagggagaacgtgggcgtccccatgcaactcaaaattcagagcaagtccttgtcagcaagcagcaggagacagccaggcatccatcccacctggggtttcctgtgtattaaacagggcctattgggtgtggacctagatttagggcctgggaccccgggaactacccaggccaatcccagtgggtaggctgcgggttatgcctgtggctgaattccttgctatctgcctttgctgtgctccccttccagcgctctttactcccaataagctgctttcttttcattgtggctaaaatgactatcccagcatggctgctcatcattgaaatatgtccatctctcaaaggacttggttaccaaaaaacactggaaagtgtttttaggtcatgatcctaaagctatgccaaaggactggccagcacagtctattggtcctccagtggcctgccgtggagcaagcctgcttgaacttattgctctccaggtctcagacacttaaacagtgacacaggaacagtccattgagtcccactgccccccttacccaaagatccatctacagcttattccatgcttttgtttccttctcaatgacttcagtatttctaaaccagtagcctggtctccctctggcttcaatgcctgtgtgtggtcttcagagctaattcttattttatgctttttctagtgaacgatactaatgttcagtttttggaccaagacgatgatgatgaccctgatacagaactgtacctcacgcagccctttgcctgtgggacagcatttgccgtcagtgtcctggactcactcatgagcgcggtgagttatcctgttccctcctcctcactcaagggtggaggatgtgccaatagagcacctccaacctttgaggccctgggctgcactggggccacagtggagagcaagactcctagaagctcacaccttagaaggggagacccacattataaaaccatcacacaagtaaatgtttgattataaattcctcaagtgcaaggaaggcaaggcaggctagaaggaaatataggtgagggcttgacctggttttggggatcccagaaaaattccccaagggagttgtacattttatgctaaaatttgagccataaagaggggagatcttgggggaagagcattctctgaagaagaaagaaagcaaatgcaaaacctggtgttgggggggacctgaggctctcaaagaaggcaaagaaaccctgtgaggctggaccatggggagacaagggtgcaggaggatggccaaggttagacctgcagaaccttgaaacacattttcatggttttggactttttcttaagaataatgaagaggcactgaaggattttagttggagagtgacataatcaggttcatgctttaaggggattgccttggctgttgtagggaggatgattcagaggtacaagatggcggcaggaggtctgagtaagaggctgtcatggcttggactaggatagagctggtgttgggatcgagggaggtggatggagctcagtggtattgggcagtacaattaataggacttgggaaaagattgagcatgagcagaaggtggagaggacagtgggtcaaagatgactgccaggcctgtcactgagactgaagtccttgggagagaaccaggcatggaggcaaggcctggctggaaggagggaggagttagtggcagagagaggacagtgggctggcccagggatcaaacacagctttggtttcttttataacttgatgtgcatctagcaatcaggcatttgttttttcacttttgcaaccgaaaaacaaataacgattaaaaaatgggtcccaacattatggagccatctttcactgcaaaaggcaaaagtaggcatttagaatgagtcataacctgggtattatgaagtcttcccactgagcatctttatttattatgtagaaaatcttcttcattttggagttctcaaattctcaatttgtgaaaatgcagacataggctgaacaaaaacttgacctttggagaatccatgataaagagcttttctgaacacattaaaaccataaacagaactcagagtttttacacacgtatatttcttaaagtgctgaaagttattctcctgaatgtgctaaacaactgatatgctaattatgtactggtctcatctattcattaaataatgctaatcccagaaggacctctatttgaggaaagaaaaaacataaagctttttaagactaatttgggttattctgtatgcctgaacattgtccaactgcaagcatatcttatttaaaaatcagaattttggatttaaaaatgactgtgaaatgacattcgtctgaattaaggttaactgggcttcatgccatgccatggctttccaagccaacaaggagataaaatggtccttggaaaagggctcccttggtttcctggggctcatgatctttcttatggcctgatgataccaaggctaacctttctacctgctagtgatgttgggctcagtttgggcaaactccttgagcaagccagaaggaatgatagaagcctcaagatgtgttcctaagaagaccatattctcagtcataggcctcatattctgcaaatccagtttcaaatggattttggtaattcatctcattagaaatttttattttagttctgatcctaattacagagatctcagaagactgttctaagagctggttaaactatttacagtagaatttttttttcagaactacaaaatactctgataacatttttaaaattccaaatttataaaattgtttatgtttctacatatcagatatttagtatgtttctagcaggactggctacataatttgcaaggtcacttttcatgaattattaagaatttcaaaatggtgacagcagagtattaaaacaaaagagacttggggctgggtgcggtggctaccgcttgtaacccagcactttagaaggccgaggtgggcagatcacttgagcccaggagtttgagaccagcctgggcaacatggcaaaaccctgtctctactaaaaatataaaaaaattagctgggtgtggtggtgtgcacctgtaatcccagctacttgggaggctgaggcctgagaatcgcttgagcctgggaggtggaggttgctgtgagatgatatagcgccactgcactccagcctgggtgacagaatgagaccctgtctcaaaaaataaaataaaataaaataaaacaacagagatgtgtctgagtacagccctgtgcaaccacataggctgaacacccatgaaaccagccctggttccaaggaataaaatcggtttgagcactggagaacttcttttcaacacagccaaaggggcatatggtagccacagggtggaggtgggggcccatctggatttgagttgcacaagcatctatatcatcagtaggtagtcagttcttggaaattcaaatgagaattcaaagtgaattgatttgaaatttttaaacaagccatctctcatctcctttgaaatgcacacaaaaatgtttgggatagtgtgactaaggcatgtttggatgcaatagtatgggagcagcatgtcttctgcattctagcctaggataaaagggtatcaggaatctggtaactgtcattgtatttatcatcaggagcatcatttactaagggcccagaactgtgcgaggcactttagctacactatcgaatcttttggacaataatgtgaatactcttggtttaagtgttgaagcaagacatatttaagtaagtcattgatggtaacttttcaaatcattaatcaaaatgcctatcaaattattccaggtcttgttttcattgtctaggatgaacaagcttcataatgaggtcttgagtagggtctgagtccacaaatctagttggatccagacgttttggtaaaatgttacctgtgatttctttgcattctaccccaaccttaatgtatgaaaaaacagattagtcaagtgccaaggcagtaactagaaggaacaaaaagggctgtcatgaatataaattgagaaagtgagactcctccaaacagcaggagacagaggtaaactttcattgcaggcattcactcataagcaacatcacaacatccacacacaaatctcttcagctgttgacagtctccttattctagcgctcctccccaaattgtcatttaatcatgtgtctaaacattctctgaatattgtccttcataacccaactcctgctgcttactgcttcatttgttaaaagaataatattttgattcatcacaggcattcctggaacagatcaggatgttacagacatggccctgtggctttatctcacaaatcaacagcagaaacacaggatgagagggaataattaggtttttggatatatgtctctaagaagatcacaacttagaaatgtatttttcagaatgataccatcttgatgcacacagtcgcaccaggtgaaaggaatcctctctgtttttagggatgagactcacatatgagtattcagatttctttttcatccagctatcactttctcccaaccccagccccaacttaagctccacttggaccctgaaaagtgaatactggacatggactcaagcgccagatggcttagatctggattccagaactgctgtttactggctgggtaaccttaacctccctgtgcctcagttttctcatctttaaaatgaagatagtaatagtacctatgtcacagggttgcagagatgagtaaatgggtaaaggttgtaaagcgattagagcggtgcttagcacttgacaagctctgtatgtatttattgttgctagtgtttttaatcaatacatttattgggcacttactggacaccaggcatgattccccatgctgcggattcagttgtaaaaaagaaggatgaagaccttgccttcatgttatttaaactttcattctagtgggttaagagtaaataggtaagtgaataaatgaatagtgtcacataaggataattgatttgaagaacatgaaatagcttgaatgggtgtggagacctgttttaccctcagtggtcagagtaaaattatcctaggaggtaacattgaagctgacactgaaaaaaacagagggagagaacactataaaggccaaagctgcacagtggtgacaagctgggtttggtttgttggaggaagcagttggaggccattatggttggaatgtggtagacaggaaggcaatcaagaaggcaaggccgctggccacactgagtattccgagtacaatagaccacatctggccaagttctaagtctggaatgagacacttcagacttggcgagaggatcctccttcttctgaaagccaccagcttcctcctaatgccactgtttctggatacgctggctaggacagtgagctcatcactgagttgattcctgaagcgcaacccttgattatttttttgtccaacaccccatcctcatgcactcattttagaagaagaaatagcacaatatattggcatagtacttggcttgatatcttgtttctaataaaagatctgtaatagaagtctcgaaatgtcacattgcagtctacatctaccccacagacaacttctgcatttatcaagtttttatttttaaattgaatttgttgccaatattttaaaataagattttatataaaatcggggttcctgccttctttaaattagagtcagaaggcagagtcccagattcccgtaaagcagctattggcttgagctgagcagctgctccctttagccacagtccacactactctctattgtatcccaccaggcctgcttcattcatgtcccttccctgcttggttcatcccactgtcctggccttaccagcctcctgcgttttgcttctaatcttatgtgtctgcattgcaatgtctgtggtcagacagcatccttggccttccggtcacttgcttgtcctctgagttaggaggttgtgcacatgatgtccattttccttgagccttggacctttcctaaacagataccaatcacactgaaccatcgttattgaaggagcagtgaggagccacctccttctgaggagaaaaaggggaaccctactacaagagctaatgagttccaatgcacacaagttgggagtgttgtcgttttttttttagaaaacaagatttaatgaagctttaggtttgcagggcctacctaatctggaaaaataaagaaaaagcatattataacagtgttaagagaaagagcagagaaaagcagaggccccttttgctagtgtacgatacatctgagaagcgtgaatgccagcctatggagagacccatgcgcaggatcccccaggagctagagagaaatttcaatgtgagccagttaaggcaggtgtgtctttgctctgcccactgcaccacaatgcccagggcaggagtttgcatgtccagtgcattcatattttcagaacaaaggcagtgacttggaggagggaaactgggccatgaattaggacttgtagcttctggtcctggctcaccggcagcccttgcacattttttctactgttaaatgggaatgatgttactccttatgactttctgctaatcggagaatggcaaaggcatataaaaatctttcacagagcagatacgtatttcttaagatcacatgtaattacaaagaagcagatttttttggtatatatgcatgtacatatatgtatatatatttatgtgtttgtgtgcacttatcctctctctttctctctttcatgaacacacatcttaaataatatttgggagcttagtgggtagatgagttggggtacccagaagatatgattccatgttctcatctttaatatcagagagctggcctgtttgccagaaacgaagttatatcagtaagactggagggtgtgaccgtctggaatgtgggttcacatgatttactgtctttcctgtactttcattaagggccaaacccttgaacctggtgttatggagaggcctgagttctctatcagtccaagctaacctaatgccatgtgattttagttacataaacaatttattgctccataaccctatttcttacactccactcaagagcctccatttcaactgctcacacggagacagagggcacatggccgtcccgaggcagaggagctagcagtggtgtcagtcgggtacatggaggtatgtcctgctagactcaggacagaccactgctgtcacatcaggccaggcaggcctggggtagggaaaaaaaaatccaatcattttcatccctcacgaaagaaaaatactaaaaataaaaatctacaccatgaaaactagcaaatataaaaaatggcagctatgacatggaaaatgacaattttagagcaattataaacgaaaggcagagagccattaaagttaaggcaatgttattaaaagatgtgttaattttcagttaaattttctataaaagaccaattagtttaaaaggcttgacagcattaactgtgaaacataagctccggtaattatactttaaaaaaataaaaagaggaggatgcttgggcgggttacacttgcaggcacagcggggcgtgggccaagcgggctagatggcgctgtgggctcaggtttccctgttacagtgccttggtccctcccctggcatttcatggtttcctcagtgtccttttacaggacctgagaatcatcaaactttagaggccaagcgggccacccttgtgttctgagccagctctcagagattagaatcagaacgccgagacacccggagagggaattgtctaaattggttgcattgctagttgatggttctttttataaactcccattttttgagtatgctttgtctatcagaagtttcacaaatcctctcatttaactctaatctataaatttttgttttgttttgttttttcatctctgttatatggatgaggaattcaaggcagagaaaagttaggcaactttttcattgttgtgcctattggatagcaaagcaggtattaaaagccacactaattggatttggaaatctgtactcataaccagggggccacgttgccttaatcagaagaagggcttcgctagtcaggtttgcaaacttgtccttggcagtgggaagagggactcctgtattccttagactatgcgggttccctgatcccaggctctgaacaggaccctaactcagctgtcttatactcaatgcccatgtgacgcaaggatagatattgagaaggtctctgcctgaagcatccctgaagactaaccctgccagagttggaggttctatacaagagcttcccagaagacttctagcacaggtatcatggtaaggcacagaaaagactggcaggacaaaagcttaggaggcaaaggatctcacctacatgatcctgcctttagaatgtttcatttcttcaattttagcatttatgttaacccagaaaaaaatgtgtgccttctgggtcaggtgagttgtagagaggtttcctccgcaggaagcgcctttggtaattggcatttgaagttctagcacctggtttgccccatgatgcagaaacagccatcacctatgcagaaagccttggagtgatgcttaattgcagactgctgaatgctccgtgaagtgccctaccccaaccctcactcccatcacataaggaaatttgcatcctccaatatgactgacctgacacccttttccagaaaaggcattgtctttccaccaaattattcagatcctgaagagataggtgtgcagagcacacccgtcagcaatgctcagagtccttttctgcatccgaatattggggtatcaaaacaggagcaaaagcatctgctggcaaaaatacatcatcattctctgtcatcacagattctgctgccccacagctctgctcctggatgcctgcatggaaaaatcaaggagagccatcatctgggatgcagtgccagctcagagagcagacaattatgctcagagatatgagtggtcccagagttgttcagacacctgtgaaaccctgggactgactatgaaattgtacctgttgatgagcaattctaaaagtcatgcactctttgactttcacacaatttcaggctaaaccaaggcccaacgattagtaggtgctcaataaatgtcagtgactgatcaaaaagatttgggtataactgatttcaacacagaagtgggaacatgttagggtcaaatcccaaagatttgacaaaacaataacctcccagcctgaccttctagatttatcattgcaatggataacctatagtgccctttgtttaaaaaaaattgactgtgtttttattagaacagttattcatacttcttgatgaaaatttggaaagcacagaaacatataaaagaagacatataaagaagaaacatataaaaataaaaagaaaacatataaagaagaaaatataaatggcctatgtttccaacaccaaggataagcatggttaatattttggtgtctttccttctaaatggatggataaatacagaattatctcattttataggttggttattttttcccttttcagttaatattttatccagagtattttattatttccttaggtgtcatgatttgcagagcctccataggactttatgagactccagtctgtggatgttccagaatcgatttatcactaaatttttggctatttagctttaaaaaatttttgttatagcaatgattaatcctgtaataaaaattattgtacataaatctttgaacaagtagcaacttattatattgaggcaaatgtactgggtttttttttttttaacaaatagggacattttaaaatttcttgatacatattgtcatgatatctccaagaaacaattttaccaatccacactctcgtcatactgagccatctcatacattatggcaaatgccgattgtcatttttcctaggaggccctttaattgtgtttatgatagttttgaagcatatcagtttttaatctgtatataatgatgtaaatacatattttatatagtgaattcagtttttatgcataaaaagtgcatgctgaacatgagaactatcaagcatcttgagattaaacagtttgctatatttttgtgaagttgtttgtggctacattttttgcctttaactatttagtaacatttactttcttttttacagaaatttaaaataaatgtattttcacagcagaaaatatataaaataaaattataggaaaaaaaccccaaattctaaaaccaagaattaactactaagtagaaattttgtgtactacttacagttactttcacataaatacgtctatcagttcaggtatgcattatttttccctctggaagtccccaaatcagagcattatgtactttttgtaatactttatggtagaaataaatgagtgaccataataataaacaggatatcattttctgataactttccattaaacattgaagatttatatttaaaaaataattcaaaaagtaataagtgcatgatttgttatattatgaaacagtgtacattataaagtttaataataaaaatgatctctacattttataaacatatgataattgaaaacattaaaaggaatcattagtatgaaaaagccaattaaaagtaatattaaaacttaaaacccagtaccataaagattcaatatttaaaagtgggtactcttaaaattaaattttaaatacagaaaaagttaatttccctagccaatagttttgcaggtatgcatttttaacatgaattgtgattcatggtgttttggggatcctacttttaaaaaacattttagtattatataattattaccatgccattaaatattatctgaaagcacaatattcatgtctgtacaatatgagtcatgtcaaagaaccattgtttaatcattaccatattgttgaaaaatttttatcagagagccagtttcccccaaatcattcattgagtaaaatcccttccctgtggtatgcaatgctttccttgttatactaaggaatggatcagcaaactgtcttgtaaagagccagatggtaaatattttcagcctttgagggccacatagtctctgtcacaactacttaactctgagtttgttagcaccaaagcagccccagacaatacataaacaaatggacatggctgggtcccaacaaaaccttattttaaaaaagtaatggatggcagagcaagatttggcccaagagccagatttgccaacttttgtattaaggtcttataactactaagctatggttctcataaatccattctggttgatcttctaatttttcacattgtctacaatatttggttaggaaacctttaaaatttactatactacatgagaggacaattttgtacaactctttccaggggaaatttagcataattttatcaagttttaaaaagtccaattcaaatctgcaattacacatatgtcaaacaacaattttactggaaaaaatgacattaaatggcctatttacatgttaaggaacatggaattttccttttttcctaatactctcctctgtctcttcatagatgattactactttgctttttgcctaaaaacagtagcgattcttattcacgtccagtgattggtattaaagagagtatctggaataatactgttaattctcctatgtatctgacattttattctccttatttctaattttatttgtgttttttcagttatattgtcataagtttattttttcaaggaattatttcttgaatttaacaattcactaaatatcctcttgctaattcattaactgacacttttcatcctgcttttttttaaaaaaagaattcttttaatacttaattttacttattataattctgttgtatttaataatagcattaaaggctctgaatttgtctctatagcattggcctcaagacatgatatttttatatgtcattctcaaatattctttaattttaaaatatttcatattctaagtttgatttccatcttgacctagtagttataggatacttaacaaaatttttttgatgttctggaatatttacttttgcctctattacattgtatttaatttttaaaatgtaggttatacagcttatactttgttatatgtattgagatttgatggttttggccattgatttttttttttgtaatcgttgttacaaagtttagtaaaaatacactaaatcaacctgattatatcctcaattttcttatcttttgatctatttggcctgtaaaagctaaaaacagtgatagtgggaatatttcacgtattacccttagtccagatttattctagtgtaattctaattagttttgctttctatatttcagttataatatttgtccataaaaaattatagctttattgtgtcaactatgaatataaaattaacttatctaacataatagtttaaaatttttctttgaagctatactttttttcttccctttttctcttttaaagatatcagagtttgattttggcatttgaacaagtctgaaaatctttgccattttataggatcatttagctcatttatgtttagttatataacataagatgctatagtcttgcattatgttttttacatgcttctatcataattatatgttttatgatccatcttttggtatgtggactatattttgtatgcttattttctgtagtgtaaactttccattctatttttaactctagttagttgttaccagccattctatagatgtattttctaagtattattgtctagaaaaatttagtagttcttgattcctccttgtataagatcaggcaattttcatgcctttatttccatcatcatctctatctcatctcatttttctaactttaaaacataattttagcaatactatattaatagctagttttgtcatttttttaataattagttttgacatttgcattccattttgtaataatatatacaataatcttttacaattctgttttaaatatattttaacagtaaaccaaatttgctcatattttagttactaagggtttaaaattatctttaaagaagctaatttttgtttctaagtatttaaaaaaattaaatcaataaatgcttatgtacgcaaagagtcaaaaaatatttcagttgccttcacaaattattggcaatttaactatatgtagaatttttggaacaaatgtgtcctgtcaaaattcctttgacattcctcttacattttctagagaagcttcagcctagccttattttatacttgtatttcttacagcattgttttaggtcatttttattctccatttaatattttgaattcaaatattcaccgagtacaggtctaggagttggccacattaacttgctgaatgcttttgatctgcatcctagattcatttcccagctcaggacaggttatttttatttgtttgtttgcttgttttacacgcttgcattttgtttacaactttgatttgtaaatacttactgtttatcacttgacctttgttgtctttttctcaatatcaaccagcactcttattaaacaaacaaacaaaaatccctatatctttctctatttagcttagaacttcctggttttacttccgtatcactaattgtgtgtgtgtgtgtgtgtgtgtgtgtgtgtgtaattttcacctctaatactcatggctccttagattaaaaagttggccagtgcaaatttagttgtcttttaactatttattttaaaaaaatgagacacaacatactatacaactcatccatttaaagtgtacgattcagtggttttttttttagcatattcacagacatgtacagccatcactacagtcaattttagaacatgttcatggcatcaaaaagaaactttgtattttagttatcctaccctcccctacaactccacccatcaacccaccaaccctaagccaccactgatctactcattatttctgtagacatgccttttctggatattttatataaatagactcttgttgcaggaagtcagagaccccaaacggagggactggctgaagccttggcagaagaacataaattatgaagatttcatggacatttatcacttccccaatcagtactcttaataatttcctatgtctgtctttaatctcttaatcccatcatctttgtaagctgaggatgtatgtcgcctcaggaccctgtgatgattccgttaactgcacaaattttttctaaagcatgtgtgtttgaacaatatgaaatctgggcaccttaagaacaggataacagcaattttcagggaacaagggagataaccttaaagtctggctgcctgtgggctgggtggaacagagccatgtttctcttattactgaaaacaggtaagagaaatattgctgaattctttccccagtaaggaatattaataattaacaaccctgggaaaagaatgcattcccaggaggagcctctaaaatggctgctctgggggtgtctgccttatggagttgcagataagggatgaaacactccctggcctcctgcagcgcccccaggcttgctaggattaggaaattccagcccggcaaattctagtcagaccggttctctgctcttgaaccctgttaagatgattatcaatgacaacgcctgcacagcaggacatggaagttccttaataattctagttttgccctgaccttgtgatctcgccctgaccttttgccttgtgaccttttgttgcccttgaagcatgtgatctctgtgacccacaccctattcatacactccctcccctttgaaaattgctaataaaaacttgctggttttgcggctcagggggcatcatggaacccgccgacatgtgatgtctcccccagacacccagctttaaaatttctcccttttgtactctttccctttatttctcagactggccgacacttaaggaaatagaaacgaatgtacattgaattatcagaggtggtttgtctgatagactctcagtacaatgtgttcaaggttcatccatgttgtagcatgtatcattgcatcactcttttttacggccaaataatactcattgcacggatataatacattttgtgcatgcattcattagctaatggaaatttgggttattttcaccttttgggtattaccaataatgctgctataaacatctgtgtacacgttttcatatggacatatatttttatttatcttgggtatatactgtaagagtggaatgtctgggtcatatagcaacacaatgttcaaacatatgaggaactgcctagctgttttccaaagtgactgtgtagcaggacgagctgcagacaaaactcctcagacaccgagttaaagaaggaagaggtttattcggccagcggcattggcaagactcctgtctcaagagccgagtatcccaagtgagcaattcctgtcccttttaagggctcacaactctaagggggtgcgtgtgagagggttgtgatcgattgagcaagcagggggtacgtgactaggggcggcatgcaccggtaattagattggaacaaaaaaggatagggattttcacagtgcttttctatacaatgtctgtaatctatagataacataaccgattaagtccgggtcagtctttaactaccaggcccagggtgtggcaccgggctatctgcttgtgggtttcatttctgccttttaatgtttactttttctttctttggaggcagaaattgggcataacacaatgtgaggggtggtctcctcccttaactgcaccactttacattcccaccagcagtgtgtgagagttccagtttctccttattcttaccaattcttgttattatcatcagtcttttttattacagctattctagtaggtgtaaaatatctcattgtggttttgatttgcatttctctgatgactagagctgttgagcctctttgcataagtttattaaccacttttatatctttttggagaaatgtttaagtcttctgcccgtttaaaaaattgggttgtcttttttggttgagttataaaaggctttttaatactgaatattagacccttatcagacatatgatttgcaaacatgctctctcattttgtaggttgtttttttcactttttggatagtgtccttcaaagaacaaatattttttaaatttttatgaagtccaatttaatctgttcttcttgtagtttatgctttttgtgtcatgtccaagaaactattgccaaatcaaaggtcataaagacttactcctatattttcttctaagcattttgcagttttagcttttacatttagatctttgaccccttttgtgttaatttttgcatatagtgtgaggtataggtcccactttattcttctgcctgtggatacccagttgttgctatgccatttgtttaaaagactatattaacttctccattgaatggtcttggcacactcactgaaaattaatagatcataactgaatgagtttatttctggattttcaattattttccattggtctataggtctatcctatgccattactatcttgattactatagtcttgtagtatgttttgaaactgggaagtatgaaacttccaacttcgtctttcttttataaggctataagattgctttggctattttgggtctgttgcagttttagagtcaatttttccatttttacaaaaaaatggactttgtgattttgataggtattacataaaatctggaaattagggtagtattccatcttaataaatcaagtcttctaatccaggaacatgggatgtctgtccatttatttaggtcttctttaatttctttcagtaatattttgtagtttgcagtataccagtcttgttcctccttcaatatatttatttctaagtattttattcattatttttctgagacagaatctcactctgtcacccaggctggggtgcagtggcatgatctcagattactgcaacatctgccgcccgggttcaagtaattctctggcctcagcctcccgaggatctgggattacaggtgcccgccaccatgcctagctaatttttttatttttagtagagactaggattcaccacgttggccagcctggtcccaactcctgacctcactcctgacctcaaatgatcctcccaccttggcctaccaaagttctgggattacaggtgtgcaccatgcttggctgacctcccattttctaccacatcgagtttaaaatcccttgcttggtttttaaagccctgagttccccacgcctccaagaaaacaaagaagattaaaaattcaaaggaaagttgagaatggagctgactgttcctctacttggcaaaggcctcatgtctctgatatgaggccaaaatgtttatcagtgcttcctgtgcaccaagcatgtttctaagtgcttcatgggtaggtcatagagccccacagccttctattattacattttacagatcatgaaacggaggcacaaaaatgttaaataactttccaaggtcacacagcttctgagaggtgaagtcagcattaaacccctcagcccagctctggatccctggatcccataacctctccagaaacatatcctactttaagtatcctttttctgcttctgtgcctaagggcatatcttaactctgagcataaatttcctttagggtctggcaggctatggataacattcctaaattcttttgcagttggaattttgtatcacaatgggtgtttttgtaagtatttcaatgaggattgtgaatccagccccgctagtaactatcatcttaattcagaagtcctcatggaattatgtgaatataaatttggttttaatgaccactgttattttacagacgagaaaaatcaaagtccagaatgactaggcaacctccaagacatagaactagttagcaaacctgggatgggaacttgagctcacccttacttggtttgttccctactatgccttgccagctaaactctctaagaagctgctgaggtgcaattgcatctttccttacctctttccaaagtgcatcctcaaaagccacaggcaaactttgatttgagttttttagcctgcttgatttctacttacataggaaaatggaatgcacacccttacctgagaatttctcaaattaggctggtgacaaataccttttaaagctcctttatttgacatcctattaattttttttaaactcccattcttttgttcctgacagatctgttatgtttcagatgtgacacaaatgtacacttagagggaaacttctttaataagtgatatttgcctcagactactgaggttattttagaaaacaaaagccaaagtacacttaccaggacattcaccttttcataaatttatccggcatatttaattgatcgagatttctgagttagacagttatcaacgcatgtggtaaatcgttaagcgtgtggcattaatgaaaggttttgccgttgtcgtggggaggaagcttcctggcacatggatgacagggcctcagagacaatgctgcttgggttagtagctggggcaggctgcattttattacacgtgtccagaatctcatagtagtcacgtagactttaggagggggaggcaatatttgtatccctactaaaaccaattatggcaaacactaattattcagatttgagccctttactaaaaaatcccctgaactgggttttttaagtcaggctgtcgtagcagagccaagcaagagagaaaataacggaataattggaggctgctgtcttttcactccccacatgaaattatttgaagagacaggccagaactttaaacaggagataccaagaaaagttgtaatttggatgtcggctgtcatgactttagggtgtttgcttaaaggacttttccctcactttctctccttccccagacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggtgagtccacagcaccgaggtcacctgagcttgctgtttgggaaaagcttgatcctgaagaacgtggtatcagatgtgacaagctaggcatctggcttttctccttcctattgtagataactgtaagaggtgatatttatttatagtttactctggatcagacactttgctctatgcatagtcattcattttaatcttcatagcaaccctttgatataagttctagtatcacaccttctaagtcaactgaggcccagagagaatgagcactagacctattgggaatttgcaccaaggcatcctggcttcagagccagtgggctttctccctccttggtgttctcttcacgtatcctctgcacaaggtgagaagcagcaggtgatgccagcatgcagccaaggttgggaaatatttccacaggctcttagcgtagcttagggatactcaacccaactatacattaatagcacatggaggtggccagcctcagcctgcaggtttcttagtttttatatgtgaataggacccaggcactggtggttttcaaagcaccagggtagtcagtagtcagatgtatccagaaccaccggccaaacaaaccgaatcttatgtggatcctttaatgcctgtaaatcaaaacctagaccttgtaatttctgagagtggacccagtcacgttccctcatgtcctccctgtgacggaagtggccagcgtctcccttctgattccatgtatctgcctagtgtaggcactgtgacagaagtgtgctgtctttgcccttattcccagcccaaccccacagatgcatttaagagatgcagccataagtcacagaaactgataaacctgttacacaaacaatggtgtcgcccagaaagactaaatagtggaaaaggagccaaggaaagggtctgtctctgttttttctgaaacagtgctgcatactttccccatattttagtttgatcatggactgggacctatgttagactaggctttttttgaaagggaattttcatagctagtggctctttatacctatcatttacttattgatgcacttgattaggataaagactttagataatggtaagatttggtcccatcagtgttctttggtatgagaccaatatgagaattccaatgattggaaggacaaagacagtcattttatacccagtgaagccatcccgcagtgcccagtgcccttcatataatacaggtaacatctacctgaagccacctggccgctgaagccagcatttccaagtggatgcatttgctttcactttctgcatcaggccccagaccccgggaaggtggctgtgaactgatcagaactgcgaatcctagttattcagcctgcagacccctggctcctagggaaacacattctcttgcacccttgccatctctgaggtctgtaaattgtgcttttcacagggtccttacctcctgaaagagtctgtcaccataggacctggtggggtcctcctccttgcggtggttttcattatcactcagacagttttgacaacacgagcctatcacagcggttacagctgagctgggactgaacataatcaccattttgcagagaagggttcatctcctcagctgagcatacatctgagaccatcaagctttacactttgacttaaagtgagggagaagcataatctccttagagctttcaaaccccactgcgacaggtggaaaactggagagacaccagaggaaaaccccattgttacctgatccctaaaaatcacacatattgggtgtagtctgttaaacatgttgacttcttccactgccgtcccttggcacatggaccctccaacttgggagacaccaaaacaagctttgatgaaaagacccgtttccctgctgtcccttgattttcaggcaaataaaaaggatgtttctctctgttcttttgctgtctcccaggatggtggttgttatggtgatctgttctgcaaagctctgaaaacatataatatgctttgttttggaatttaccggctgagagatgctcacctcagcacccccagtcagtgcacaaagaggtgagtattggtttcaactctgccctcccacctaatcacagaaatattaatatcctttcctgtcccctactgtaaaggcaaaggtctgtatacatctcctcaacatgcaaattactctgcccatattaaatccaacactgagtttggaggtgatgggaagcatttttctataattactaatagtagatgtaaagacattttggtaagaattcaagttttgtattaatagaataattccatcacctaattacaaaagtctgaatacacaaacatctctcccaaactctagctactaggataacatctgttggtacctaatatagagatattttacattgctagtgtttaagataagtttttttgtttttttgttttttgtttgtttgttttttgagatggagtgttgctctgttgcccaggctggagtgcagtggcacaatcttggctcactgcaacctctgcctcctgggttccagtgattctcttgccttagcctcctgagtagctgggattataggcacacaccaccacacccagccaatttttgtgtttttagtagagagaaggcttgttggccaggctggtctcgaactcctgacctcaagtgatccacccacctcggcctcccaaagtgctgggcttacaggtgtgagccaccacacccggccctaagataagtggttcttctgccatatctcagaatcccatatttttacttcacatattttaaattgactcgctttttaacttttatatatttatttttgagacaattatatattatcaccttaagcagagaaataacagtttagatgtgccaattatatttttctcatatgcattaaaataaattcatagcaggcaaaaattaaaagtacatcctagaattaccaagatcagtgagtttgcataatataccctaggcaacagtgctgcagagacaagcgtttctcatccctgcttgcatagtagaatcacctggggagcttttaaaaaatattctgattactctaacttaactggtctggaaggaagaaaacatcatatatatattttaaattatgtaaacattttatatataataaccagggattatagtgtatagccagaattgagaacaattgctatagaccagtgggttctcaaaatttagccatcatgagactcacctgcagagcttgttcaaccacagattgctggaccccatcctcagcacttccaattcagtaggtctgggtgggattgcttaagaacttgcatttcctagttcctaggtgatgctgacctgtgtggcctaaggaccacacttggtgaccactgctctaagtgaaacagcgtgattttcttagtcacatctgctgttgaccaaagaaagctccaactaattgtgaagaacaacaaagtagtgctgataagtaggcaggtttcttagattcttccatgtggtgaattccaaattccaaattctctcaccaaagtagattttaaaaggtaaagagcgagaatagtctaaggagacactctgtcatggtaaacaaagatcttgtgatgtatatctgggattgtccgaaaattatgaaatgaaagttgcatcacacttcatgaaacctcttgcggttgggctacttgaaagtgactttgaccttgtatagaaaggtacatgtagaccacgagaagcgaagtttggttcttccattactggctctaattccacatctctgcctgggctcctggctggcctcctttattgagttaaacagaggaagtttccatttaacaagaaaaagaatgtttaaggcctcagaccagctaggagtgcatcttccagatcctctgaaagtcctgagtaaccaggccattgcttttggttcagagagagttgaattctttactcagttactctcaggaggtgacatctctgctttccctgtccaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttctcttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtctctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggta

SEQ ID NO: 13970 - DNA, 11500 bp, Human
aagtgagtagaggccagggatgctgctcagcatcctgcagtgcacaggacagctcccaccccgaccccaccacaaagaatgacccgaccccaaatggcagtagtgtcaaggttgaaaagtctagattggggagatgtggtacatcaaagtgctgagcgtgcagtaggtctgcaaggtcctcaaagatgtgatgggagggggagccacgccatccccacctctgccttcctccttctgtcccagctggtggcaactacatcccaactcagggggtccaaaccgactgctttctgtgaccttcagcaggaagtagccccttggcttgaactgtccagagtaggcaggatgctgggaataaaagtcaaaaataacagatactgtgcgcagtgctttgcttgcatgacctcccaaaatggcccaagtggagagaaggttctccatttatggtgaggagacagtagctctgagaccttcaggaactcgtccaaggtcacacacatctgcctgactcagagtccagctgtcatccacagcatctcaccaccatctccctctagggggtacagggtaactgtgtttttgtttgtttgtttgttttttgagacggagtcttgctctgttgcccaggctggagtgcagtggtgcgatctcagctcactgcaagctctgcctcctgggttcacaccattctcctgcctcagcctcccatgtagctgggactacaggcacccgccaccacacctggctaattttttgtgtttttagtagagacagggtttcaccgtgttagccaggatggtctcgagctcctgacttcgtgatccgcctgcctcggcctcccagagtgttgggattacaggcgtgagccaccgcgcccggcctgtaactgggttttatgctgacttgaggattttagccaaaaacaaataccaacaacaacaaaagaaaaccttgttaactcactcctttgctccaatataattttattcataaaataatcacttattagatattgattacaggcaaaattatactttgttagacacttaaaaaattcctggaagctgggtgcagtggcacgtgcctgtagttccggttattcaggacactgaggagaaaggattgcttgagcccaggagtttgagtccagcctgggcaatgtagcaacaacctatctctaaaaaataaaataaaaatacctggatctaccttttttctttggtcataaataagttgactgtgatggtcacttttatttctattgaggctaagatcccaggtcctggagcaggccagccccttctctctgctgtgtgattctgagtaaatgggttcacctctctgaactcagtttctccatgtataaagtggaatcagaattcctcccctaaggatggctggatgagaattccatacaatgcttgtgaagctggcacaatgccttgcgtgtagtaggtgttcaagaaatggtagctattattcgtgcgtgtcttctacatgaagaaagtcagtctgtgagttctgtgacggcatcctatggaaacggttgggtggatttgcgcccaagttggagagtatggttagcgtgatctgacttaaaacttaggccacatggcacatggaaactggagagtgtctggggtccctcactttaagaactagaatttttccaaaggttgcgtgtgactcaataggaaatggtgaccccaagaaaccaaagaaagggagttggtggttgtggggagacacgggagagctgcacaccgtgccccttgcctggcgctgctgggcttcccacaaagccagtgaggttcatctgtccccaggaagtcatcagagacggtggctgaggagacaggcactgggggcctccgtggacccgctattggagtgaagtggcctggatggaattgggtggacagggtgctgcctcagcaggctgggatgtgctgggctgtcagaaagtgctcataaatagcatgccccttgcgaagacaggcgagtctgcagacggccgtggctcctctgttcttcccgaggctacagcaacaggttcattctgggatgggttgggggtggggaggcaaaagccaccctggcaggcccggaccttttgtagtttctgtgggacgcgcatggctgaccgcctgcaaagaaaaacagcgcctcccttaagggtcaggtcccagtgagaggaccctgacagcccagctgggggtggaacgagggacccttgtctgcagtggccagggtccaagcccctggacatgtgcttagggcaggggaccttccaaaacagctcctctgagggaggggagtgggcacacatggtacctgccaagtcccccgagagtcccctgtgagctggaccaagccctgtttcctgctgaggctaggagagacagaaccgacagcccgcaggctgtgcatggttaggcccacatccagagtatgtgggctgtgcagctgtgcatgctggggtggccgtgctgggagccgtgggtgggtaacagttggatgtggggtgtagatgtaggtgccttgtttaccactgtggatgtctgaaatgggcagggatgtgtgtgtgtgaggagagagagagagagagagaaagaagctgtcctgtgagcccatgggtgaaatataactgatagtgaccatagaaacttttgcgagtgtgtgcacctatgtgtgtgtgctgacaaacagaacagtcctgtgtgtgtccatgggtgcaacaatgatgagaatccttccatgtgactgcggcaggggcctgtattgcgtgtcactgtccctgtagcaatgaagaactgtcggtgtctgggtcttgaagtggctggtacacagtcgtgttcaataaatgcttaaggaatgagtaaccgaacgcagggaaactgacctggagcaggtgtccaacgacctggtcttacaagccttttctctagaggtctgtctgtccacctcccgacatatggggtctcctgtccctcctggtcacccagcccagagcctggcactgtgtaggtgctcatggaatatttgttgaataaagtaaccagtgaacaaaagagttcctggagtacggaggtgggagagacccctgtagaggaaactccctgaagcccaccctttagccaggttctgggggtgggacatctgcagagagctctgagaaacctgggtttcggggagcatctggatcaggggaaaagggcacgggctttggagccaggcccgacccaggccacttcctcactgtgtgcttgaggaagtggcctcactttgctgagcctcagagttcccctctgtacaatggggctcctgatcccactgtctcagtccacgtggcccatggcaggtgctcaatggatgtttgctgaatgactgaatgtcgatcataagttacagccacgccccatgggcagcaaggctctgtagctcatcctggactccagtcacatcaacacctggcttctcccgggtggatccagtgaaccattttcttttggtttgaagccagaggtgttcctggggagatggcggaacagcacggagcacccgaacaggctgcagctggcaagagccatggagaccttgggggcagctacaaggtactgggcagggagggggtcagagggcccaggctactcctgggcctcagggtcatcttcccagccaagcagcacctctgcaggaaggaagagccatccttccaaccacccaggccaggacaaaacgctccgggtgggtcctctcactgccaccctcccgttagaaacttgcttcatgactttgctgcatcttccctcgtctgcaaaacagaaatggtcacccacatcctgcctgcaccaatggatcagagaggcccgggggtttctggaaacggctctgagctctgactctcctgtctgacctcagcctggtgtcttgcccactctggggaaaagggcacagggtttggaggctctctgggcctcaacagccccatgtttgaaatgaggatggtgcccagatattgtgcccagagttggtgtaaaggctgaaagacatgagtgaagccagctagcagagggaggcacactagaaatctgagagaaggtttgaatgtgttggctctgccctttccaaaccatctccggggtctttttgggaaactattccagacagagtctaaggatgggtcgaatcccagtgcctcctcttaacttgctgtgcagcccgaggcaagtatcttaccctttctgagcttctttgatcccttctgtaaaatgacgagaacagatgttccctggggatcttctacaaagtcagtttgtgtttccaggtgggtgagagaggcaaaaccttggtctgcctttgcagcccttctcttcctaggcttggggcaggcagaggtcttccccgagactgcaaacaggtgttttcatttttttaagggggaaatttcctattaaggaaaatacagatttctgacctctcttgaaaaaattggaactgggacctcattccctcatcgccagaagcagcttcatttccccaccgacctctcgggttatttcagtccgctggactccccacctggctcctgctggacatcagagttgcaatcactagtttaattggtctcattgaagttcctgaaggcgtttccctccatgaccattagagggcagtgcaggcccacctcagtgccagctccaggctggagagatgcagaaagcagagggtacctccctctaatgcccaaaggaggggcagaggctggagctgggagcctagcagaggtgggatgtttaggactctgctcttctaggtgatcttgtacgaactagagaacttccaaggcaaacgctgcgagctctcggccgagtgccccagcctgaccgacagcctgctggagaaggtgggctccatccaagtggagtccgggccgtgagtacctagacccccagtccctcgccacagccctgagccttctgggagtgtggaggccccagtctgagctctagatctgttgtggggcttttgacagctcccctgccttctctggcctcgttttccgcatctgtaaaatgagagttgaagaattctctagaatcctagatgtctgcagaaaatcccaggatacctgaggttggaagaacagcaaggtcaacctagcacctaactcagtgactggaacatgggatttaatatttataattttaataataattgtaacacctaaaatttaacatgcattatgtcattgaatcgtcatgaccctgtgacagaggtatcattcttattcccactttatagatggggaaactgaggccaaagttggtaagtgtcccatccatgtccacaaggcaggcaggtctcccagctgggccctgaattcccgcctttggattgcaagtccaggctctggcactaaccatctgggtgatcttcggcaagttgcttcacacaccaggcctctgttttctcatctgttgaatggggataacaatggtacgtacttcagagagagtttttatgaaaatgaatggaatgatgcaaataaatacatattaataacaatacaatacaaagaagaggaaaaggaagaggaagaagtcactgtcacctatggaatacttactgtgtaccgggcattgtgctaaagacttttctgggtaccttgcacagaggctagattctcaataacataccctaggatggttttctggcccagagtctcagacagttcccggtatgtcctagcagctcctttaattacaggtccaggaattagcagtaggtttggagggagggtacaaggttcaaggtcagcagctcttggacacttctctcactaaacttgaatccttcctcagctgcagcaaaggtgacccagccaagcctcttcctccctcaggtggctggcatttgagtccagggccttccgcggggagcagtttgttctggagaagggggattatcctcgctgggatgcctggtccaacagccgtgatagtgacagccttctgtccctccggcctctgaatattgtgagtgtggttcctgctcacttctgggtgttcctggaagcagggtgcactgagagctggtcaggcagctcattgcacaagctgggctgagggtttggcccatatggacctggcctgggaagggccctcatgtttctgatttgaacaattgtgtgggacaagaagtgggatattgaagggacattcggttggggattgagacaccaggactcacatcttgaattaaaccagcatagcactgggacttttctttgtaaccgtactaaaacgatgagccacatggcccagtctcaaatcagtattgttatcaaagaaatgcagtccaggaaataacttcagaaagtagccaaaatactttaagttctccacttgtgtttttctagcacctgaaagggacacagtccacagtgacactttttatttatttgtttatttatttatttttcgagacagactcctgctctgtcacccatgctggagtgcagtctttctctctctctctttttaaacatttttatttatgtatttttatttcattttgagttgcagtctcgctctgtcacccaggctggagtgcagtggcatgatctctgctcactgcaacctctgcctcctgggttcaagtgattctcctgcctcagcctcctgagtagctgggactgaaggcacatgccaccacgctgggctaatttttgtatttttagtagaggtggcgttttgccatgttggcaaagctggtcttgaacttctggcctcaagtgatctgcctgcctcggcctcccaaagtactgggattacaggcctgagccaccacgcccggcccacagtgacactttgaacaccacccttctccctcccctgcttcactcacaccccgcagctgctccagccctttctctttgtcacataactgagtcctccttagagggcagtggaagaggggaaactgggaagattaaaccggcatctggttaggaaagagggaaagctcatatgttgatacttttgatctctgtccaccctctcctggcctcagtttctctatcatttaaatgatgggattgaacaagatctggaaattccttttcagttttataatctacggctctaggttcctaaatcaaccagctttggaggaatctccccgtccctcctacagtgaatttgggggtggaggcatctcctgaggcccttccctcctgcagcaggtttgggggtgggtgttattttgtggtgacctgttgattctttccggcatctggagcctccttgacctctgttctggatatgggagcagccgctcaccccacgatattgccctcaggatagtccagatcacaagctgcatctgtttgagaacccagctttcagtggccgcaagatggagatagtggatgatgacgtgcccagcctgtgggctcatggcttccaggaccgtgtggcgagtgtccgtgccatcaacgggacgtaagggacccaaccctcacccttgccccatcttctggtcagccatgcctctggctccaaacagaatcagtgcccatagtttcttattattttatttatttatttatttatttttgagacggagtcttgctctgtcgcccaggctggagtgcagtggcgcgatctcagctcactgcaagctccgcctcccgggttcatgccattctcctgcctcagcctcccgagtagctgggactacaggcgcccacgaccacgcccggctaagtttttgtatttttagtagagacggggtttcaccgtgttagccaggatggtctcaatctcctgacctcatgatctgcccgcctcggcctcccaaagtgctgggattacaggtgtgagccacggcgcccggccatcggtgcctatagtttcttgcatgattcatgttccctgcactcctgtactgttgagatttctaggcagccttgacttaaaacaagtaaaatctgttctctccacctgttcccatctgagtccttcctgcttttttaaacatccccacacccttgaactgattcttgaaatgttcttccccctcacaactcttgttcttcttaacaaggggcccaggatgtatgcagttattgagatgtgacacaagttgtacagaggagagcaggcttatcacctccctctttctaggcttaatatcaccgttgatgcagtcttaggatcacctgctttttgtaggtggttacatctcacttgtgggcttgtaatctggggttgggccttgagaggtgccacctatccctgataataatttattcaacaattttttactgaacatctactatatgctggtgtgctgatacagagaacaacaagaatggcacatcctctggccctcaaaaaatttgcgtagtctggggctcacgcctgtaatcccagcactttgggaggccgaagtgggcggatcacctgaggtcaggagttcatgaccagcctgaccaccacggagaaaccccgtctctactaaaaatacaaaattagccgggcatggtggcgcatgcctgtaatcccagctactcaagaggctgaggcaggagaatcacttgaacctgggaggtggaggttgtagtgagccgagatcacgccactgcactccagcctgagcaacaagagcgaaactccatctaaaaaaagaaaaattacatagtttgatggagagacagacaaagtaacaggtattcacaacgtattgtgatcaggattgggactgggatgcacaaggggctctgggagtcccagtgaggtactcgattcagcctgcaggagtctggagacatctaaattgagctgtaatggatgcaagtggaaaaaagggggaaggagagggatgaggtgagcaagagtgttccaggcagaaggaatcatgcatacaaaggccccccaacacagcaggttccgggaaagtagaataagagaggccacggtgttgagtgtgaatgggatgttgagagataaggctagagatgctttgttaagggtcctgtgagcagggtaaagagtttggattcatcccaagggctctggggagctaaagaggaatgtaggcaggcagagtgcatggtcagatgctggctggaggcagggtgactggaagcagaccgtccacatctcaaccttggtctcccggcaggtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctggggttggtcccccacccgccacgttcctcggcatcacttcctgagggagccaggcctggggcgggacctgtgggagaggcgtgctgaaggaggctggggcttgagtgttctgagactcccaggaaggggctgggaaatttgcccatatcctaggctctaatcctttcaggcagagccatgtgcccctactgccctgatcttgtgtttgtctgctgctgcatgtttccatctgaatgtctgtcagtctgcccatccactcacccatccatccatcatccttccacccacccacccacccattcatccacccattcacccactcatgtgcccatccattcgtctactcacccatccatccatccatccacccacccattcatccacccattcacccacccatgtgcccatccattcatctactcacccatccatccatccacccacccacccatctacccattcattcatccatccaactacctaccacccattcatccatccatgcatccatccatccatccattcatccacccacttacccatccatccattcattcttccttccatcttcctatatttgttctttccattaattcatccatttttccttccactcacgcatctttctatctatccttttatccacttatccatcaatttttctttcaatctacttgtccatcaatgtgtccatctgatcttccttccttccttcctttcttccctccttccttccattcatctatccattatttccccttccacctctctgtgggtcagtctctgttgtcattaatgtattcagcaaatgccatgccctgttcagtgtattcagcaaatgccatgccctgttcaaggcctaaggacagggcacaatgtcctgccctccaggttctcaccttctgtgggagagacagaaagtaaataaacaggtcgatgagggctataatgttgggaggcggtaaataccaagaacaataaagctggataaaaatatggaagtgatgggggtggtggccaggaaactctgtgcaaaggagccgagtcctcagtgaaccaccagaacattccaggcagagaaataacaggtgcaaaggccctaggcaggagtatgctggcctaatgggaaacagccaggggcccagcaggtctggaatggagtaaaagactggggatagggttcagagggaacagggtcaggtcatttagggctttgcagaacctagtggactttgcttgttctctgagggaggtgggagccatggagcatttgagcaaagtgagccgtggtctgcagtggggtttaataggatcactctggctagggtgcaaatcatacacttagtggccaaggagggatgcagagagaccagttgggaggctactgcagagagtctcgtgagctgtgtttgtgcggtccacctgagcctctctctctcatgcctcagtatctctgtccccttgcccagaggccttctgcagcctcgcctggggtactgagtgcccatcccacctccccccactgaccactgctctgggcccccgtggcttcatctgggcagtgggagttgctgaagagctgaacagagacactggggcagtgccaggcataaatgaggcctttgtttgtttgtttatttagagacagagtctcgctctgttgcccaggcagtggcgcaatctcggctcactgcaacctccacctcctgggctcaagcaattctcctgcttcggcgtcccaagtagctaggactacaggtgcgcagcaccacgcccggctaatttttgtgtttttagaagagatggggtttcaccatattggtcaggctggtctcgaactcctgacctcaggtggcccacccacttcggccccacaaagttgctgggattacaggcatgagccaccatgctcggccataattgagtctcttctgcccccaggtgggaagaggaggggcctcctctctgatagccagctgacaacggacttcctgcaggcaggccccggcaccacccctc

SEQ ID NO: 13971 - DNA, 8344 bp, Human; identical to SEQ ID NO: 11775

SEQ ID NO: 13972 - DNA, 6454 bp, Human
tggagcagacgtggagagtaagccgggacaccaagtaaggttttcaaataagctcacgcagaaataaagcgtagcgatcttgagcccagagaggaaagtaagagggcacgggaatgcggagcagcgagagagaggcggcgagcggacggcacagggccacacgcgccgggtgagggcagaaggcggcgtttccccagagaccactgcacatcctcgccgtcgtggctgcaggttctccggctctgatgggtctcccctccaactgccaaaaggtagtggtgcattcacccgcgatgacggcaaagtggggaggggttttttgggtgttcccagaccctgctcttaaggggatggaaggttcttgggaaatagagtagctgggtgccacgcaccccaatgtatactattttcagctaaattggaatctatcactgttggataaggagaaattaaataataggtggttttgtgatgctgtgcctgtgcaaaacaaaacacacaaacaaaaatcaaaagcttaagtagcaagtgggagccctgaagaatatcttgttaaaagtgactctgaaagtgtctacaaacatgttaccgggagttataggatttgacgggaaatattcttaattggaaagacgtggcatctaaattaaaggtagacaattaaaaaaatccacctagttttaaaaaccacaacgtaaccactaagtagtatttctttagtttcctgtactttgaggacacaactggaccaccaactagaaaaaaaaattcctcctcctgtttccaggttccaaaattcagaaatgaaatgatttatttcatttttgttttcaaaatgatgtttaaatccaaaaaaccccccagataactgcaagttaattttctttgcaaatgttaaccattttcccttaattaaatcacacgaaatagtataaaattagaagtctactgccaggtcaccacttaaggacacttaagacaggagatatatccttaattatacatctgtaaacaagccagataccccaaaccttcaatttttcgggatagttatctgtgaggaagcttgatctctatgatctcacctgaattttatgtactaaaatacaggtcactatgaaataacgctaaagtactctgtccatcccacagacaatttatttttcaaatgtttctataagtgcatatatagcgttgtgtcctgcttgtaatgctgggcaagtccaccaaagtgcaaagactgcatctgctggggcagagggatgtacgaaatattttttaaatatcctaacttaaacaggggtagaacatctcacacactcagcaataattttcagattcaacaaatggagaaaagaaaaaaacataagtaaaaaaagagcatactacctccataacgtttcaaaaaatcattttaacatataggaacatccagaatgagaaaattacacaggtactcctccatctaaagccaacttccatatgccagtagtctgcatgaaagaacaaactttcaacctgcatttaagaagaccccaaggattaacagacgttaattatcttactctaaatgcaagttagtgattttgttttagaaaaccccgtcaagatcactaattgatggatgcccattaatacacctgtatttgcatttcagcggtaaaagacaagcaggttttcggcacagaagagagccgctttgccaagtcttttcaaaacgtcaatatgcttcaagtaataccaaagctgagagattcctcttgatttccaaactgtctaggtggcctgagtggttttccgccggcagcagcctcctacctttagtttgtgtgcctatatccatgagtggggattaattagccgggttggagctgaaggaggctgtcgtgacgagcccagtggcgattggccgcccgcctgcctggccctgcctttataatttccacacgagtgcatctgggctcttagacaaaccaacagcagcttcttctgacatatacacacgcacactcaccccggacacacactcagcacacttttcctccatttgattaacagtgctgcacacacaatgattacgggaaagcgcaaataaatacggaaaggggtgcttattttgactactggaagagctttgctgggtctcagcgcaacttttgttttttattcctgagaaggtgatctctccatgcggttctctcacacaaggattctttaaaagaggaagagagacaagcagaggggggaggacagtctttcactttaagaacggctgggctcaaagataaaaggaagggaaaagcagcagcagcagcagcagcagcagcagcagcagcagcagcagcagcagcagcagcagggaaaccaacgctgcagcacttccgaaaggcatttttgatccatttctgagtgttgcggcccgtttctccaccgaagttggctccagctctagcagccgcattggatcccacagcttactgcgagactccggtgtacaatccggatctctgccccaacatgattgcggcccaggccaagctggtctaccatctgaataaatactacaacgaaaaatgccaagccaggaaagctgccattgccaaaactatccgggaagtctgcaaagtagtttccgacgtactgaaggaagtggaagtgcaggagccgcggttcatcagctctctcaacgagatggacaatcgctacgagggcctcgaggtcatctcccccaccgaatttgaagtggtgctttatctcaaccaaatgggggtgttcaacttcgtggacgatggctcactgcccggctgcgcggtgctgaagttgagcgacgggcgcaagaggagcatgtccctctgggtggaattcattaccgcctccggctacctctcggcgcgcaaaatccggtccaggtttcagacgctggtggctcaagcggtagacaaatgtagctaccgggatgtggtaaagatggtggcagacaccagcgaagtgaaactgagaatccgagataggtacgtggtgcagatcacgccggcctttaaatgcaccgggatctggccgaggagtgctgcccactggccacttccccacatcccctggccgggacccaaccgggtggcggaggtcaaggcggaaggtttcaatctcttgtccaaggagtgccactccttggccggcaagcagagctcggcggagagcgacgcctgggtgctgcagttcgcggaggcagagaacagactgcagatggggggctgcagaaagaagtgcctctccatcctcaaaaccttaagggatcgtcaccttgaactgccgggccagcccttgaacaattaccatatgaagactctggtttcctacgagtgtgaaaagcatccccgagagtcggactgggacgagtcttgcctgggtgatcggctgaacgggattttgctgcaacttatctcctgcctgcagtgccggcggtgtccccactactttctaccgaacttagatctgtttcaaggcaaacctcactcagctctggaaaacgctgccaaacaaacgtggcgactggcaagagagatcctgaccaacccgaaaagtttggaaaaactttagaggatgatttaatcaagagccgaaattattacccttctcaaagtccttattaagtgtaaacttctgttcaattcctaatattccactccgcagtgcaaacaatctcttcctttaacaaggaataataatacaatatttaaacatcatctcacccacccccacaaggggagaaaaagtaggggaagcggatggagaaaaacccaaagccactagtattagaagacttctttccacacgatttcctatctcccttgaaaagtacaccgtaacactccgtaaacagcccagctgtaacgccagaccgagacgaacactctgcctaactatcaaaggattatagcaatcctggtgatttaggtgcatctgtctgtgagtaaacacgatttggatatgccatctgaaagaaactgtaatgtatattttgatttgtaacaaatattgtgatctcacattgtctttgaaagtgtggatgttggtgttttgtgatttggtgaacagaacttaaattgccattctggatacttccagacattttccactaacaaagatatcatttaaaggtagatttcttcctggtacttttatctgtctttgaaagtgtctgaactttaaaaagtttacattttgtttcaaatattgcttgttctatttctaacattccataaatatacttgaaatgttatttaaatatattcaaagaaatttgaattcagcttatataataacgcttgaatatctgaattatatatttgaaaaatgcacttgaaatacactggataattacttttgtgatttagattttaatttgttgctggtttttatttaattagatggtaataaatgaagtaaaataaaagttgttgtgtctcactttaaattgtttcctatcacaagatgtaatgatgcattttgaaaatcaaacccacttgaatatcttaaatattttgagaaatatgctaatgaaatccttaaaaataaaacattggagaaaagctctttctgtataggtccataagataacaatctactctcagtctctaacttacttgtaagacaattcctttctacaacagaaacaatttaaatctacctttgaaagcttgctcttcttgtagcatttttgataatataagaaaaaaagtctatcatgacagtagagatgactgagttaaaaatctgactaattcagaggaaatgaacttaacaaagtcataatgaaacttcgaaaattatgtatgaaaactaataaaacgatcctttctgaccaatatattttatgtcaaaccttattttatgtaataagggttccattagcagaataaattcattagaaattcaacatttctttttgacttcatagggcaagctaataaaaggatgaacacaaaatttaagttattttaaaataaaatacagtgcattcaagctcattttaaaaactacatttgcagctagaagtaaaagaagtcccatggctctcctttggaagagtttagtagtcaacaagtgctgaaaaggctgatcacctatgggccttaagttagttaattcaggtgatggtaaatttttggatttcagctctagtctacaaatactattttataacattttatttcaatatctaaattaaaaacaataaagttctggatctgtgggagcatttgtctttgactattttagaataactgcctctgaaaataaaggaagatctttgcaaaatgatgctagaatttctagcatgacacttcatgctgttgaattcttaaccccagaatagaagtttgcaaattgcacagtaacatgaaagttaaaacattagaacagatctcagaaaatgctgagaaagagctactctaatactctggtgtttaaaatctacacaataacatttaataaatatgcatttaaatggtccaaatttgtattttctggcattatatccaaagaatacaatatttaaacatctgagtgctagcatatatatttaaaatcaaagctcagagaatcagttgcttttctcttaaatccacatataaaacccattcttatttcaggagatggacaaaatgggtgtactaatggagattaatttatatctaaatgctctccccccagtttccttataacttttcaataatcacattacaatataaagttttgaaaattaaaagtgatcttaataagaaatttctcaagacctttcaaagtcagcctcagagcctgagattctgggccccagggacttggaagcaattggcttaactaccaaatctgcccaaatgcaaacaaaggcactcatagaaagactgttaaaatgtgcatgctctggtaatacaggatttaaattcattaatatattcttcaattccataaagagaacatgctatttcattcattttattttctatgagaaagaggagaatgtgctcccctcctccactgtcaggtaaaaccaaacaaaattgaaaaccacttcctgccacaaagccaccaatactgtacatggaatcgctttaactcactttcgtgtcgatcttcttgaaggcagaatcatcctcatctacctcgaagtagatttctgtcgtggtgatggagagagtccccttggccaccaccacgggagcgatgagctgggcaggggtgctgagaaccactgggcctgcaaggcaaggacaaggggagtcaggctgagcccctgtggcccttcctgctccctcccagaaaggtaccagaggtttttattggtaaggatgcactagaaaaaatggtgcctgtattatgcggcaaactcttttttcacgtaagataaggactacttagcttttatacattaccttataacgagactagagagaaa

SEQ ID NO: 13973 - DNA, 5776 bp, Human
cctttgctccttggttggcctttcttgttttctacgtagatttttctccccctccaacctctctctccctgaccatcagaatgatttattttcctgccattgatgcctgccggcctgggggagtctgatcagttagtctatttcaaaggaagcaaaagcgaatcaccatcctcagggtttgggggggaaagaggtacctccagatctacctctcagcctcctcacctctttctggcttggtggattttttaaaaattattttttggtacctaaaggtgttatcttttgaaccctctagcactgtccaagatgcgctcagtctcaagtctccgaattggaaaaaagataatgaaggagaacgagaacctttataattcctccttgggtcgcctcctctcccccgcagtgctgtttcccacaacagaacccggaagcaaacatccccggtgcccaaggatcaggaaggtgtgggaggcagttcaggctgccagggagcactcgctgtatctaaaccaaccagcccccaaccagagcgacaaggacaagaagaagggtagaaaaaaaagagagagggagggagagagaggagcaagcatcttctctttccctgctggtaacttccaacagacttcctggaaatcggaaatactcaccgcacccgagccctacgggtatgaaacccagaatgccaggagccgcacgcgcctgctcggggcggcatttctttggctggccgccgccctggctacggggatttggacacatggacctggggttgttgtctcgcttggcacatgcatctttctccagccactcctgagaagttgatggcgcaggaaggtcgggaagcttcgagagccgcctcccgttttccgcttcccgccggagccagatgcaaagctgccgtggaatagcctgctaacaatgggcccggggcgcagactctgggctggacactgggaggggggcgagaggctgaggggagaaggggaggcggacagaagagagagggagggagaaagggggagaagaggaaaaagagggaaagggacagacaggaaggaaaacagaccgagagagatcagttttgagatccaggaactgcttttaggaaaagtgaaggaggaaaagggaaagaaaaggaagaccccttcccaaccaaaatctttcctttcttctctcttttctgtcttctctttctccatctctcaaactctctcttcttccctctctctttattctccctctctcatctcctctcttcctctgctcctttctcctgctttaacagaacttatgtggctgggacgcagggccctcgggtgtcaaaactttgaagattaatggattactttgttaatgactgcaggcgtcagactgaggtgcttaaatgatttgtgaggtgcgaggcgtcttcccgacagtcccaaacaatgcgcggagtgtgcgggggaggcagagggcagccaccggcgggaccgacagcagggcttacactcgcgcacattcacacacacacacacacactcccaggcacacacactagatagatccttgcagatcaggaggcacgcaggcaccctcgcccccacgtactccgggacatccccacccacaccaacatatatgtatttttgctctgaaaaaagtgtaaataaagcctcgctggcccccaatgaggcgttccttcccgacttttttggatcaatcaaacagacagtggcttcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaaggtcagtccaaagacttggccccaggtctctgggaccctcttccttctccgggctgccccgagagtggctgtggggggaggggagagtgggctgggagagaaggaggagagggagagatgcttggttgccttgtccctgcccctgtgggttcaggagtgggtttgatggagaggaaaggggatcctgcgctctacaatgagacatatatatttttaggaagtggggggaaactttcccgaacttgtgtaatgtgggatgatttatttgagttggaactgacctcctcctgtctagttgtcctagagtttggctttttgacagtaatgaagagtgatagatcgctcttgctcagctaagcagctgacgcattaattataaattgtgttgtggctaatataaagtttgctcccggatgaagaggttggggggagccacaggcatgaattcgatagagatggaggagacggggtctgcccaggctgggctcccaggaaaggcagcacaatagctctactgcatccaggggcggccattttgttgcagttgatcttttctgctatatttattctccagtggaataaccccgctcggacccctccacctccaactgtgcgtgtgtctcttgttggtttccctttccgcagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtagcttatttttctccccctcttttttcaaggctcataacgggttctttttcttcttttagtctaacttcgtaaataaaattcgtcacaatttatcttcttttttcaattttaatacatttattaaggcggcatgttcaaagtcttcaatggacagcaacaaaacagaaagccaaaaaatgactagggcttctaataagtgttttttctttcttttttgcttcttcttctcctctttctttttaaaggatttgattttcagtgcacaggttcaagccatagatttaaattggtaatagaggcagaattggacagtctaagatttgggccaagcccaagctcttgaaagtggagaaataaagtgcctacagaaacccccaactccaggaatgagtaacacggagtttctttaataagctaccagtctccaggtcaataactaagttatcaacaattcatttgtttatacacttttgtttcaaacacccacatttcaaccccctcccccataaatccctccacattttcagtgtggttgattaatctcccagctgttgatgggttcaggcaaaacagacctaaaagatagagaaaaacaaaaataaaacaaaacagtgattactatctggaaaatgcaccctagaaaatgttctttccaatcctctggttcagtcactctaggatttttttttttttttcagggtcagaaaaatcaatatttcattcttaaacctgtttacattgctaataatagatcgttaatgcttcgaagtcaggttagcaagttgagatttaaaatggtgtgtttctacaccctaggttataaattaacgcaggttctagagagagagaaaagcactttaaatgaaatatcaataaaatgtgatctagggtgtgtcactgggttgttgcttttcccccctcccttgttaggtctccccatgtttatttttccctttctgagctctcttctgatgcctacttacttaccgtgagaaaacgcagcatgtaagcaacatgtgtgtggggcgggttgatttaagaacctggctcttaacagcaaaggcttggaagttccaatgacaacgcgatgtttcttcataggtttgctccctaccttccctcgccccttcctccgctaaatctcagctgcggcggcggagtgtggggactatggctggtttctggccccaagctcagcgcggagcagggcgtcccggccgcggccagggctgcgcagctcctggatgcgattcgtcctacgctcataaatcaaacgctttctatgaatgagaatgtcatcaaagagatcaattgcaggaacacatgcacaaataaaaatcctcttacgttatttgccggggatccccgtccgaaagcattaagttagaaggcgtttagtcataattcatttttattgctcttttaaaacaacagcttggctgagccgcggatgccatgaacagttcagggcctcggcgtcattttatctcctccttattcctttcctttctagcataagagccctgaaagaggcgttttgagccaagagaaccgcttgtaggcgatcattttaagcgtaaccaagctcgcctttcacccagtctcccaaggcgttgaaagagaccagct

SEQ ID NO: 13974 - DNA, 106418 bp, Human
  misc_feature (1)...(106418): n = A,T,C or G
gtaaccccttcccttactagtcctgcctcctgtgcacaatgggcaacataccatcgtgcacataaaatacgacacatcagaaatagacttgtttttaaagggatggcttctttccaggaatgtatattatattcatttttaggaaaaggaaaaattagagaaaaaaaccatgaaggaattatatggaagacaagataaattgagtgcagcaaactagattttaagaggaaataagaattatagagaaatgtaaacaaggggtcagtttcattcttgggactctaaaaaccccctccctaagtaaagataaaaacaaagatcaatggcagccccttgccaacaagatgaaacccaggtgagatactcagctaagcagaatgcataccacccctgggttttcattcgccctaggcagctttctgactcatggtttagagaatcaagctcactaatttcccaagtgacttaatatctgactaacgatgtttaaccattaagatgaggaaattgacaatattgataatcttggagagaaatggatctgcttatttttgtaccaagcgccaacaaattcttagtagctttggaaacatgatgaattactctctcttgatatttagtagtgtgtattttcttaaaaagattttgtgaaattgtagtcgtttttcttttgtttttctgaatagttgcaagttcatagaacaaaaaggaaagattcaaagtatctattattttgttttaacaagcaatattgcattatcttcctcataaaaaaattcatttatcctttcatttccaaagctcagatcagctaggcaatgatttgctttgtacttgcgtcccaggatatgttttcattgtcctgagttaccatctatgaaaacataggcagtagaacctgggaacagcaacagcacgtaacttcggttgtgtcttagcaaaaatctttgctgtgtctctaggttcaaacagtaccaggccatggatgagaagtgtgaaaattgatttcctcagtaggacttttagggacagaccttcacatatatccctgctgcctaacttctctttctctgcttcttgctttcataggcgagcgcattttaggaagttctttcacactttgccttttccatttttgaatatatcaaaaagaaaaaaaaacagtcaactggtcattaacagaggatatccagatgaggggtgcttgctggcttttttatgctaccttcattaaatcaaccttatctaaattgatatgtaacctgatggcctcaccagacactgtagaaggtgtatgagattgagcatcagcttgaaatcttcatgctggctttttctgatcttgggcatattagttaatttccttaagtttccatttcttcacctataaagtaatattagtatctgaccttccagattgctggagaatgaaatgaggaatgattttaaaaggtaattagtctttatcactgccatgttaatgagattcatttagggctgattccgagatgtgcttatgctcttatacttgagtaacaacggtttggcttgggtaatattcctgtctttctccattcatacgctgtcttgattggtgaaaaaagtggtgttgatcagattgggcccagatcagccaggacaaggcatgatgcatactgacatggtcaagatagaattttaaatggttttcatattatcacttctcttaattttgaacaagtcatttttgtctctgcagcaaatacctccttccctctgctctgctttccttttccatctgtcttctttcttccttcctttgttcttaatttctggggccaaggtactgtcatgactgtgtacctgtgatgacttgggttaagaaatttaaaagacatcaaatgatccaagaggcacttagggtttgatttagggtacttaggctgtgattactgagaaggacttcttagacctgatctgtattggatgaagtgaccttcactttttttttccccccccccaggaaacttggatttaactggccagaagcaggtattcaaagcagagaacaatccctgggtgacccccattgcagaccagttccagcttggcgtgtcccatgtttttgagtatatccgttctgagacatacaaatagtaagtagactctgattttctgaaatagtagactgtgattttatagtatttataattacgcctttaaaaatattatgtgacagtatcctattgatggcagttagcacttagcattttaagatgttttattaaaaactgcatgtcggccaggtgtggtgtggctcacagctgtaatcctagcatttggggaagtcgagactagaggattgcttgagcccaggagtttgagaccagcctgggcaacatagcaagaccccgtctctacaaaagaaaaagaaaaagaaattatccaggcatggtagtgcatgcttgtcattgtagctattctggaggctgagttgggaggatcacttgagcccaggacattgaggctgcacagagtcgtggtcatgccctgcactcgagcctggatgagagagcacgaccctttctcaaaagaaaaaaacaagaaaaaacagcatgtggtcattgtctctatttgtaaattgttttttattgatattttcaaggggatttttactgattttctttagagaatttttgaggtattaaattagttgaatattcatggcactaaggaaattcaccattcagatcagaacatattttttttcttctgtgaatgcaaagaattacaagtgttctgaacaaaattgttaagcagtttatttataaaatcagtagagagtactagcaatgcgtcattctattatagagaagcttgtactgtagtgagatgataatctcttagagaaaaggggaaggcaggagaggaagcggaatctgccagcttaaagtcacagcatccaaatacctcaagtcctcactccaggtgaaaggagtctatgcaaaactgtcccaaaaacctcacgattcctgcttctttcttcctccatgtgtcaaggttgaaaggaattctgccacttccacgtgcttctgttgttatatgtaccgtcattattttcctaccttatcccagcccccagctgcaaaacaaactgtcatttatcaaatacttgcctgaccccaaatgctgagatctagtataattttaagcatatacaaaaaagacaaaaacatccctactcaaatgtaatctgtttttgtgtctgacatcaacttttaaaatttattttttaattaattaattaattttttttaagagacagggtctcactgtattgctgggctggagtgcagtggcacaatcacggctcactgcagcctcaagcgcctgggctgaggcaatccttccatttcagccttccaagtagctgggactacaggagcacaccaccatgcccagctaatttttttaattttttgcagagacggggtctccctttgttgcccaggctggtctcaaactcctggtgtcaagcaatcctgctttcatcttccaaagtgctgggattacagtcatgagccaccatgcccagcctggcaccaacttttgagaatctaacatcccaactattggaagaaagctagaagattgctaaaggtcacatttagttaagagtttcttttcttttttttttttttggtatcagaaatatgtcccacactcaagaaaaccctgtgaatctgtgccaggccagtgggtcgggattgattggcagggcagagcctctgcccagaagtggctggctgcatttctgcagtcttgcagcctgagcgccatgctcctggtcaaacatttagcacttgctgtggccatgtttccaccagacagaaacagagaagacaagctgtaaagaataatggccagccggagcatggtggctcacgcctgcaaccccaacactttgggaaggcaaggcgggtggatcacttgaggtcaggagtttgagatcagcctggccaacatggtgaaactaaaaacacaaaaattagctgggcatggtggaggggcacctgtaatcctagctattcaggaggctgaggcacaagaatcgcttgagccagggaggcagaggttgcagtgagctgagatcgtgccactgcactccagcctgggcgacagagcaatattccatcccaaaaaaaagaaaaaagaacaatggccttaaaatgaaatacactaaaattgccaaaatgataccgtatcctcctatataaaagcaatgtaaagcgtggtttagattactttagacaatactatgacacttacagtataagtctaaagacttaccttaaggataaaatgagataggtataggatgtgtattaattgtttcataagccatatagatatgtacagttattacagattcaattttttttaaaaaaatacgaatgtagctcacccttagaaattagttaattatgaaaatgtgtgaaaatatagtcacaaattagcagatgattgtttatcttcttctttgtaaattgttaatcattgctatcgtgagttttagatggggctctaattttttcttagtaaacaggaagctatttagagcttggtttgtatggtatcttgaaaaaagtcattctgtatatgatagtatacagaaaaatgcatgaacaaactcctagccatctggaattagaggaaattctctgtttattattctggttaacaatttttagttttccatagatcactttataatttatagaggatgagaatacattgcatatgaaagtgcttttaattttaaaagattaaattgtgagtttctggattttgtattacctcaaagtaattattaggcaattaatcaccattctgcactgttacagactattttaactgatttgaatgtggttaggattctggataaatgagaggtatctataacataattggtatatctgtttttatgtctgttattagcatcctattttggggggttggcgtagtctaagcaatgtgtctgctaactttttctgtttcatttcctcatggagccttggattaccttttatgcagttaagtcaacattaaaaagtttcagtaggctgggtgcggtggctcacgcctatgatcccagcactttggggtgaattgtggggtgattcaccatgaggagggtgaatcacttgaggccaggagttcaagaccagcctttccaacatggtgaaaccccatttctactcaaaatacaaaaattagccgagtgtggtggtgggtgcctgtaatcccagctacttgggaggctgaggcaggagaatcgcttgaacctgagaggtggaggttgcagtgagttgagatagatggcgccactgcactccagcctgggtgacatagtgaaactgtgtttcaaacaaaaaaaaaaaaaaaaaaaaaaaaaagaagcagcagcttcagtaagcaccggagagccattgcctcctttccacggggaccagctggttccataacagctgcttttaggggcatctacatgatgctctgctgggaggtcacaaggtacatgagctatgctagggcaggggcctgctgtgagttctcttctgtcctccttgggaaggagaagaaggttggttactttgtgtatttcagtttttttgtccttctgtcattctcctgtagcagctgtcgtcacccctttgtcaaacatactagcccaaaatatggactgttagctgataagacaataagtcaaactcttaatcattaaaaaaaaaaaaaaaactgcacaaaaatgccgctattgtgtttcaccagattaacacaaactgattttcaaaattaagggcctcctttatatgaatagatctgtattatattaagtatatcctcatacaattagaacccaactcaactctttgtgtgaagcagccatttcataattaggggatttttagtatcctatctgaaaaatattatgcgaattagcaggtatttggctactttttaaaaacgttttacatgtggcagccttcaggggaggcagtttattcatgatactcatagtttttttaaaaaagcaaatttcacattcattgccttagtttttgatcttctagtctaaaacttattatagttcctaattttcacttctttgtctctgttgtttaagccgcatacttcccctttattaaaaagaatccttacttatatatttatcagtgtctgtgtgttgcggatgtgtatttgtctatctttaaactaccatgaaaacatacttttggttttggcacttaaaacgcctatgaacctcctcctccttcccccaccccaaccgcttttttctaaccagttaacccattacctaaatgagaggaataaagaactaaaaaacttaccggaatgttttcttttcattcatgtctatgatcggcgttcacagtgaccttcctcagagcacgtcctcaagttcttctgagtctagggcagagaggatggatgatctgatttataggctctaatggactccaagaggagacatggatacttgaaagaaaacaatgaattcagtgtgtcaacagaattaaaatacttggagatgacttagcttcatgaagatgggaacttgttccattaagcaggaggggtgtggctggtaggatggtgaggtatagttcttcagagattgctctttggagtaacattctgggcattaatcacggccccttcatcatgtctcaggtggaagctgctgtctcttcatctttcgtgccttccacaggggaacttgttggctgatgtcactgagttgccggttaacatgaaattatgagcttggttgggtcgttgaagcttacatcctacatgctccactgtgtttttaaactgtcgctgagttatacaattacctgttaactctttatttgatggtggttgtctcttcgacctcttttatttctttgaagcagaattatgatggaatactcatcacttaagtttccagaaggtagatttttttcccccaggagaggcagtcaagttgaagtcagcacccttgacaagattctttgtgaaagggggtaactcacactttgcacatttccatcaaggaacgtggataccaactgcaagccattttaaaagctgacaagttaactcttgtcaacaagttaacaaaagaggtttgacaaatgttaggctggaaatgcttcccttgaaagaggtatttggcaaacaggcgtcatcatgaaaactgcaatttgccaagcatggcagtcctaaagcctcatttccagcatggcatcactcacaggatgcttcctcgtcattctgcctgtctttttcacctttcttttctctctccggaaaagttccccactcatttgtgttttgtgtgttccgtttttttaaccttaaatgaaagaccagccatactattattcatattagttaacaaaaacattttaacaaagcagtctttggtgaatggtgggaaaccatgagataaaagctgagaattcctctttattagaaatctagccaaataaatcatcctgtttgatttataaggaaacattcttttggctgttggttattgtttttcacattgttttacttgtggaattaaagctaattaatgttttatttttcttctgcatgctgtgcaaacctgttacaagctgtaatggacgtacatgggctttattaaacaactactatatcctctagtgactgctgagtcagtggcctagaaattctttaaataacttcactgatacaaccagtccaccacaaggctagggcatttcaaacctaataggtgagcccattcattttaaaacagcccttcactgtaggaaattatctctaagaaaaacttaataaacatctgatgaagtataaatgggtgcacagagctagcaggtgattttataaatatcttcacaaagatggaggagagggttaaatttccaggatctttctagtggttagtaaattgaacatagtgacaatcagtatgtagaacaatgtagactcttctttttcattgctgtatctgaaaatagctcaaattaagccacagaaaaacaatttctgtgtagtagacatgaaaatgaagaactgtttttctttaaagctttttttttttttccttagggacacagtatcactttgtcacccaggctgcagtgcaggggcaccatgatagctcactgcagccttgatctccagggctcaagcaatccccctgcctcagcttccctagtacctgggactacaggcacacaccacaacgcctggctagttttctattttatttttttgtggagactgggggtcttgctatgttgcccaagctactctcaaacccctggcctcaagagattttcctgcctcagcctttcaaagcgctgagattacaggcacgcaccacggcacctggcttttaacataaaggtagtttttacattttacaagttgactatgtattctcttcctggtgatatatattttcttcataaatggtacatatttgtattattttttctttttttgagacggagtctcgctctgtcgccgaagctggactgcagtggcgtgatctgggctcactgcaagctccgccttccgggttcacgccattctcctgcctcagcctcccgagtggctgggactgcaggcgctcgctaccacatctggctgattttttgtattttttttagtagagacagggtttcgccttgttggccaggatggtcttgatctcctgacctcgtgacccgtccgcctcggcctcccaaagtgctgggattacaggcctgagccaccactactggcctatattttcttttttaaagttgaaaatgcattatcacattttatccataatatgtgattcaaagttttggcatctgtggacctatttgcaagaaaatatgttgcatttaaccagtattgctaaaaagtatcagagaaaagggaaacccatataatatatttggggtatattgtgtcacatctcttatttcatgttaacttcaatgataaaattaggtagcatcacattttaaaacacaaaaaactccagaatgtttattctactgaataaaagtaagccaatatgtaatactaacttttgaaggctgggtgcagtggctcatgcctgtaattccagtactttgggaaggcgaggcaggaggatcacttgagcccagggagttcaagaccagcctgggcaacatagtgagacttcgtctgtacagaaaatgaaaaaaaattagccgggcatggtggcacatgcctgtagtctcagctacttgggtggctgaggtgggaggatgccttgagcccagaaggtcaaggttgcaatgagccaagatcacaccactgaactccagcttcagtgatagagtgagaccctatctcaaaataataataataataataatttgattttttgtttaattgctcaactgttcctgtatgtgatcatgaggtatcagttaccctgctaaattgatacctccctctttaatatgacaggaggaatacagaggatgtaaggaagaatacgtaagttcttactctcttccaaatgttgtgatagattgcttagtgtattttgcatttaaaggatttttttttctgccttgtaacttggttaacactattattcatatatacttcacaggtaactagtatttttcccttttttgcattttcataatttattcaatatatgatgttttcacaggcttttgaggctttacttttctgtaattttatagctcatgcaaaatggttcagttttttaaatggaaggtgcttgttcccatttgatatttccaggacacttggattctgtgagttaagttgggaacttccatcccctaatcctatgaaggtcaaaggtgaaactctactagggcttaaaaaccagcttcaggagactagctgtattcctgaagacatctagtaagactccattgtatacgtgtcctactctggagtgtttttcactgtgatatgcaatagatgcaaataaagacttggaaaatgtaccctcccatatccacgttgctttcttcactacttccctctggtcctctaatgtggttaatcctccagcactctgtgcttgcctgggagctctgactgggacctggtaggctcaggtttgaccagtgagaaaaaaccctatgctccttgccttttttactcaatgcaatttgcattttattcaatgactagtgtacttatctttgaagagttgtggataactattagaggggcataggggaaaaaaactacagctgcaacatcaaagggagaagagagatttatcctgaaccttgcactacaaaaggcttttccgtaggactttaaagagtaaaactatctcagtctctctctgtgtgtgtctctctcctcctattccagtcccctctttcccctgttcccttctccatccccctcacttgattgttgactatcaagcctgcatttggcatgccttatacagctcctaaagtggagcatgatacattacagtatcaatttaaggtaaatagaatatagataatttgtctcacttgacagaaggaaaataaatatcagctagactccatccatactccaaaaaacccataatgtgtcaggttacattctcttcaagaggagctattctgagctccttttttttggatgctattcatttgatataatcatattgaactattggatattgacctcactgaagtgaaattggtcacctctacatattgattattaactcccaggagtcttaaaagttcaatgcttgatgctttctattcagctgagatgaattattgcctgcatttgctgtttttatttgagagataaatttaaaagtggcgcttttataatcaaacaaaactgtttgtggtttctaatctctacacagtaataacttgttttattacatgctggttttttattgaactctggtttcttatcctggccaggcattgttggaggttttgtggggttttttaaatttttaattttgggcatttaaggattcttctgtgttgtcagttattttagattaaaatgcaaaatgctatgaaaggagtttcaatcaactttatcagataaaaaacttaaatgtgagttatgttcacaggcatttatccatgcctcaatgtattcatcaagcattaaggaaataactttccatattttgttctactgtgtttgcatattatttgtttataagactcttgatattttttaaaatgtagtcaagaataaaatattattttccactttaatagttctctctgggacgcatgaaccagagcgactccatcttcaatggtaactgagtaaaatgaggctgagacctgctgggctgcattcccagatggttaaagcattctaagtcacagggtgagataggaagtcagcacaaaatacgggtcataaagaccttgctgataaaacaggttgcagtaaagaagctggccaaatccaacaaaaccaagatggcgatgagagtaacctctggtcgtcctcactgctaccctcccatcagcgccatgacagcttagaaatgccatggcaatgtcaggaagttaccctatatggtctagaaaggagaggaatgaataatccaccgcttgtttagcatatcatcaagaaataaccataaaaatgggcaaacagcagcccttggggctgttctgtctgtggagtagccattgttttattcctttactttcctaataaacttcctttaactttactctgtggactcgccctgaattctttcttgtgtgagatccaagaattctctcttagggtctggatcgcgacccctttcctgtaacagttcatttttaaataatcttatttggtgttgtttggttttgagacggagtcccgctctgttgcccaggctggagtgcggtggtgcgatctcggctcactgcaacctttgcctcccaggttcaagcgattctcttgcctcggtctcccgagtacctggggttacaggcacacactaccatgcccagctaatttttttgtgtttttagtagagatggggttttgccatgttggccagactggtcccaaacccgtgacctcaggtgatccgctcacctcagcctcccaaagtcctgggattacaagcatgagccaccatacccggcctaaataatctcatttggaacatatacaatactgtcattgtcaaaatgcacatactttatattctctatccaattaggtagtgtctatttggaaattaaattattgaagttttggggtttttttgtgacaggttaatgaataagtacagtggcttttgggtgtttctttttcttttcctggtgacagctgattttgtctttactatttgtattcgtttgctttggctgccataaccaagtaccacaaacggcatggtttaaaagcagaaattcattgtctcatgttctagaggccggaagtcccagatcaaggtgtcagcaggattggttttttctgagggcagttagggaagggtttgtctaaggcctctctccttggctcttttacccctgtgctgcttcacatcatcatctctctaggtatctctgtctctgtgtccaaagctccccatttcacaaggatatcagttatccggggtgagggcccaccctaatgactgcattttaacttgattatctctttaaaaacgctgtctccaaatatgaccattgaggactaagctctggtttttttatcttgccaaaattcgtatctagagagttggggagtcatgccctactaaccataaattcttatcagatgggttttatttaaccctacatatcctgacttactttccaatctgactctggcataacattatgtgacaaagaagaaaataaaaatcgtttaccccaaaacatgtttctttgctatattttgaaatggccctgcacagccatcctttgtgggtgaaaatgcgcatctgtaaagaatctctgctagcatagctagatctttttctttcaccaccctcccaatcctgaggagatgaactgagtgtctagcaccttgtataggtctgaatagggaacatttgtcatctgttgtctctaaggacagccagtatgacacttcaagaatcttggtctccacaatcttttatcttaacctgagcatttcctttctattaatcccaggtcttagacaaactcaaccaattgtcaaccagaaaatgtttaaatttacctaaagcctagaagacccagcttcgaattgttcgaagttgaacaattgaattgaagttgaattgttgaaccgcctttggaccaaaccagtatatttctcaaatgtatttgattgatgtctcatgcctccctaaaatgcatgaaaccaagctgcgccccaaccaccttggacatatgttctcaggacctcctgggggctgtgtcacgaccgtggtcactcatatttagctcagaataaatctctccaaatattttacagagtttctcctctttttgttaggaggttaggacttcaacaaaaaagtatttggtaaatttgccatataaaataactaaaacttcaatgataatttactcagtctccatataaacaacatcaatcaaaagtatgtgcgtgtcaaaggtgatagaattgtctgtcttcccaatgagatgatttacaaattaaccattatagtggaaaacagtatttcctgggctattttttaataccatgaaccttataaacacatatgaaataatatacaaacacaatagaatgaaatatttattgttactcaaatgcccagaaacggcattgagttgtttatgaatttgttccttcattttcctctcttcatctgtagcctctacaccttcacagggagacacgttctgtttatgagccagtgtgtttaaatggctctccaagtcttgatccacacccctaccacaacacacacacacacacacacacaccacacacccattcctctcttaaggcttgggtttcaacatcatgttattctccagaaatgcacatttaccactgtttcattgtaaggaatggcagaggggtctgttattgttaatcttttaagaatggaccctgttaaaacaaaagctgctttgaattcgaagatgcgttaggaatgaaaggtacctaacaaaccacctctttgtcctatttggtagagaattcatgaagggagggttccacagagcaccaacccctattgtgtccttcactcataaggagggcatgtgcggtgtggagggtctgtgtcatgtgatgggaccccctccagtaggtgtggatcctgggacctgtgtggtcctgtgtaatggctcttggagttttgttacaggaaaggggtcccgatccagaccccaagagagggttcttggattttgcacaagaaagatccagggtgagtctgcagggcaaagtaaaagtaagtttattaagaaagtaaagtggtgaaagaacagctactccagagacagagtaggtgttcccgaaagtaagaggaggaacgcatgtccaccctaggtaacatgcatgcatgtgtgtgtgtgtgtgtgtgtgtgtgtgtgtgtgtgtgtgtatgaatgattttaaaagaccatggagagatgtgttctgctacaagggtttctgataaaggattaattttcttaattactatattttgcaagaatcaatattatctttaaagcaaaattaggaatgcctttgttttccagatatcgggatatcaggacactcccaagtctgggtctgtttagtcaacattatcagtctgttcccgtaactataagcatttagaggctaggaatgcctagctgcctgggagtgcagcccagcaggtcccagcctcattttcctagccctcactcaagatggagtcactctggttcgaacgcctctgagggttttgccctatagagtgtggagtcagagattccctgtcccatcttgggactctggtcaccacatctacagccttcatgatttttgtctcatttttcctaccttgtcccaggagatctatggattggtgggtagcatcaagaggcacagaattctcttctcatgtagttaaagctggcttgctttctcagcatgccaagagaggtatcaaagatggagtgcttattttcataggatgcaccatgctgtaaagacacagtgactcttccgtgaaacactaaggaaaaaagaaggggaaataaggaatataggacttgttagaggaaaaaggctccaggtagagatggattgatttttattataaatttgaactttttaaaatcaaaataacatttttaaaaaacatacagcacatatatatggcatatacataggacttgttcttagattactcatcttagaggtggcttctagtgtcagttttctcatggcaaatgacctcatcccacccacctcagcttccccatctgcacagctcaagtttcaaactagatcatctctgagggtcgtcccagcaatgatttctaatcctcagttctttatttttctaggaaacatattttattgacatcaattcattatttttttaattcaatttaattcttaaatttgcctcccatctggatttgctttatcgatttttttaaggcaatagaagacaatgatgaccctgaatacaaattgttacgggaaaatggatccaagataaaattaccagatcaacctttttattccatattttatggaatatctaatggatgtttggcagtaacttattcttacacacgaattcctgacagtttcgattcttcagacttattaatcagtgtagtcagcaccagagcaattttatgagacttaacagtcatcaaaaatttattatcagataaatcagagaaacaacgagcatcttaataggttagagaaagtggcatgtaaaggatcatttaagatggtgctttttgtcagttgtgcgttatatttacaaccaatatctaagaacttactcataatttcatgcaaatagtcagcagggtgatagttgctgtcttaggtcaaccttttctctttgtttttctccagcagaatgttgtgtttggtgtaactataaggctaagactgctaaatagacacacaataggaagcatcatttcccaatgttaagcctatagcatttattttaatgcagtatctccattttcttctggattttattagagttgtcatccaaaattaagagttactgagctcagccctttcccttgggaacaaggtgctaaacttgagctctttgttttgttttgttgtttcattttttcctgacatagtttggatatctgtccgcacccaaatctcatgttgaaatgcaatccccagcattggaggtgaggcctggtgggaggtgtttggatcagaagggagatccctcatgaatggcttttgccgtcctcttggtgatgagtgagctcttgctctgagttcacacaagatctggttgtttaaaagtgtgtgccacctccctccctccccttccctttcctcttgctcctgcttttgccacgtgacatgcctgcacccccttcatcttctgccatgtttgtaaacttcctgaggcctccctagaagcaagcagatgccagcactatgcttcttgtacagcctgaagaaccatgagcaaattaaacttcttttctgtataaattgcctagcctcaggtatttatagcaacgcaagaatgaactaacacagtccttgttttttatttttcttcttcttactatttttttaaacttgagctctttggaatgtcatgggaaaatggtattcagattgcctttcttatgtccaggcttcacgtgtacattctgtcctgagacacaggcctgtgtctgctgtattctcggcactgtttttgataccccgttaaaggtgtaataagagaccagatttcttaaaaatccggtttttggctttgtgcgatgtctcacacctgtaatcccagcactttgggaggcgagggcaggcagatcacttgaggttaggagtttgaaaccagactggccaacatggtgaaaccccatctctactgaaaatacaaaaattagccaggcatggtggtgcacgtctgtaatcccaggtactccggaggctgaggctggagaatcgcttgaacctgggagggagagattgcggtgagccaagattgtgccactgcactccagcctgggcaacagagtgagactctgtctcataaaaaaaaaaaaaaaaaaaaaaaaaaaacttgagtctttattgtgccagatgaggggagtttttccatcaccgtatctttgccctgagtgttcctgcatcacagtatcctctagggcagaaggatggtgatggtgggccacgtgggagctgagctggcaatagagagccttcagacagagctgctgggaatggacccagaaagacaaggccgggttacatcccagcagagatacaacctgctttccacctcacgtccacgtgtgctgccttgtctgtctggaatgctctttcttcacatctttacctattaaatgcccagttattcttcaagtgtcaggttaaatatcgcttcctcagagatcttttcttggaaggtttccctactgcccatcaactctaagctccttttatcatctttctttagggcctctactttcattagtagtaattttaataataacagtggctatcacttctttcccaggtgtcagacattgtatgccttgtatgtactgtatgtaagtttctcactcaatatttattggtgtgaatactacctgtattttagtagttaagtatgtgtttttttctcctgtaagagactgaagtctttttgaaagcaagattccttcttgactgggctttgcacatgacatccccagtgtcttatataacttctgacaggtcaccctaatttctgaaaagtaagaccattctggggtctggagtgttccaagttatacagttcattgtttttggtggtaggtaataaaaagtactggaaacattaaaatgtgttctcactatctaatactcagcttagattatgacttccctatggtgcttcgttatttttatagatctttttaccacattactcttatggtgcaaatgaaacatttccttaaccaataaactaattatgtttgaaagcaagacttttttttttttaattcaaatctgagggatctgtgattcacttgtctgccttctctttttccatgatggagtagtccatggggcatgtggaatgcgtgattgtgcttgtaagtggatggaatattcctgaaggataggcaataaactagtaatgtagtaatggtggttatctctagggaaagaaactggatggcaagagacagggaggagtgggcacatcctcttcactctttatcctgtggtacctattgaatgtcctattttcacatgtattcactattgaaaagattatttcttaaaaaaagaaaatactccccagtaggaagtttttacttccccatgaatgtataaaggaagaaaccacaaagaatgtggctttgtaactggttttgtctacactatctcctattttcattcatttgaagattgtgtggaagtcctcctttttagtctccctttgatcaggtacactaaaaattttcaaggtgatatcacctcgtaaaatgagtcccgaatcttggaaagagacaatttgaaagacagcttgagagaaggtttctcgcttaatgcatggaccatcccaattcttggctgaagcattgtgaaatcttccactgtttataacacctgtcagataacattaggctttcctatgttcttggaagaatctgtggcagtctgtttttccttgagaatcaaatgagaaaagatggtcattcatgaagaccaacaaaagagaagaataaagaaaaagcaagaaaatggatttctacgttgggtttgttttgttttgttaggggtattttcccacctaagactttaagtgagagaaaagcttttctatttttgaaagggcatgagggtttgaaataaggaagaatggatcttgaaagaattgattgtgtcttaaaggatggaaatgcgcttcggattcctacagtgagacaaggattttttttttgtttcttttctccttaatttttttaagctgtcaactaagatgacgtgtgtgtttcagactgtttatgtgggattatgagcatgtttaatctgttcttgtgcattcccaatagaaactgcgtgagtggtgtgatcttttaatagaatgtgtcttgcaactaacaaatgtattttggtgctaaattctggataattcctaagaaatgtaaatgttgtcaataaaagtttttgttttgaaatacttataatcttggagctatattattttaagttttctgaagacagtctctgcttcatttttctaagtttagttgagacagggcaacaagaaaaaatactggccataaagtaaaaatattctctataaatttttggaacatggttagaagagaactgcaaatggggaaacagctccttgcaggccactgtacacatgcatgatacaagacgacttgggtttactctggtttcagtactaagagtattgagtggcttttactagaaaaattcaggacctgcattataaagtcagctactcccaacttcctacccccatttttattttcttcatgtagattagtgtgtgatacagtttgcctcaattacactaaggagagagaattgacatttattgacttctgtgttcctaccatgcacatccaggccctggtgaattctttacagaattcatctcctgtaggttcacagtttgcctctgctttcagacgagaaaacggacagtcatcgtttaagtaaaacaactgaggacaaagccagaaatcaagttctggccagtttaaaagaacgttgtctcattttccatgttgctttgagtaacatctgggaagaaaataagaaaatgttaagtttatgttgataccctcaaagggaagccagtgtatgaagtttaggggaatgtacatgatcatttgacttttctggttcttgaatcaaattcagcttcctacaaggcctcatcctcatactagggttgcaggcacatgcgacattcaagggtccctaacagtattcctactgccagctccttagtccctcagggctagcttcctgcaattcaccctgattctaatttagcaaccccttatctgagtggttctggtacaacaagtacaaatctatctttctgctagatacaccctctgattttgggattagggatactcaacctgtataactgcagcccacagtggatatataacacacatttatacaggttgagtatccctaattcttcaccacggggcggaaggtccgcgtggctacgagcgttagaggagacgagactagcgccaatnnnnnnnnnnnnnnnnnnnncacacatttataccagtgcagtatccctaatccaaaaatcccaaatctgaaaggcaccatatctgaacctttttgagtgctgacgtgacactcaaaggaaatgctcattggaacattttggattttcagactagagataatgcactggtaaatagagtacaaatatgtcaatccaaaaaatctgaaatccaaaatacttctggtcccaagaattctggataaaggattgatatggtttggctgtgtccccacccaaatctcatcttgaattgtagcttccataatccccacatgttgtgggagggacccagtgggagataattgaatcataggggtgggtttttctcatgttgttcttgtgatagtgaataagtctcatgagatctgatggttttataaagggcagttcccctgcacacagtctcttgcctgccaccatgtaagatgtgcctttgctcatccttcatctgctgccatgattgtgaagcctccccagccatgcagaactgtgagtccattaagcctctttttcttcataagaagtttaatttataaactactcagtcgtgggtatttcttcatagcagtatgaaaatggactaatacagggatcaacctgtgttattttgtagtcgggcttcagtctgttaatgcatattaaagggtatgacctttctctagaatacttactagtatttgtctcttttggacttgaggatggactcctggcttttcttggctcatcatgtaccaactgactgtaatcagattggccaggacagtctttaccaagctttctgcgtgatcccttctttgtctttgttttattagctctagactcaggctctaattctgttgcccatccaagaatgagcccttctccagggagctcttatccactaagtggaaaatcatattagcatccaaatctgaggcccaggaaagttttagagcatggaagcagaggcagggtgatgtcaggtctgccagctatttgagtgacaaagcagaaaaattactttctactcaaaggagcacgcgttcatgttgatgttctccatttacttctatcttttttacatttattttgtccttactatattaccagaatttattaatccagtccccctttgccaagccatatgtactaaatgaaaccatgtgtttatgtgaatagtgatcccatatttccaaattttccttttcttgtctcttcctgacgctggtctctagtgttctggaattggctgccaagtgtgtaagctcaggaagttccccttgttactgtccacagagcaatacctgcctgaaaagaaaaagaaacagcgacctccttctaggttttatactttaaaaaagaaaaaaagaagtgtgggccactcagtagtagaaagccttaggtcacctgatgtctaggtagaataccatttaattatggaacaataacagtgacatcgggaagacataactacaaaaccttttgaagtctgttacctcctgattttcttgggcactaatgtttgtcttttaacactaacagctttacacttttttttctttctttttttttttttttttgagacagagtctcgctctgttacccaggctggagtgcaggggtgcaatctcaccgcaacctccgcctcctggattcaagcgattctcatgcctcagcctcccaaacagctggggttacagtatgtaccaccatgcctagctaatttttatttttatttatttatttttgatacagggtctcactctgtcgcccaggctggagtgtagtggcacagtcttggctcactgcaacctccgcctcccaggttcaaaagatgctcctgcctcagcctcccgagtagctgggattacaggcgtgtgccaccacgcctggctaatctttgtatttttagtagagatggagtttcgctgtgttagccaggctggtctcgaactcctgagtctcaagtgatctgcccacctcggcctcccacagtgctgggattacagcttctggccggctttacacttatattcagtttctaaatgaccttaggcttgctgtcttatctcattcaagtttcagttcaaatgccatctcagcaaagttttttccattatcactgtatctaaagtggaccccatcgcccaccacccactcctgcctccaattttatcgtctctcttatgcttagaatggagtctcctgcaagagcgggagacgtagttttgtacactgctctgtcctcaggagcttcagacattgcctggcacctagtggactctctgaatattcgatgagagctgttgttgtttcaagcatactttgtcacctgcagtgtaaacatttctgttagaggatttaaaaaaaaaaaaaaaaaaccttccgtgacacatccgtgacacattttcagtgtttcccttttccttgtgtctgagttgctcagatttcatattattactgccacttccatcaccataaatgttgctctgatgtttccaaggctgcagcctttcccaaccagctatttcccatcaaatctagtcgctctttttagctaggctttgaaagaaactcctgcacacagaattttaaagggcaatatcgggggccagggggaggggaacaaaacaaaaacagacgctttgtttgacctggactcagcccacttgccttatattttgttttgtttttgagtcagccaggcctcccatcccctaacagacacctctgtgtgtaggacctagatattggctgctgagagcctcaggatgcaggtgttgcttttgtgttccatcacgatggtgtgaaagagcctataaaaggtaaattggcaggctttgaactatagtaattgcttgaaaataaacagcagaggagaggggaggggaggcagctcttcttcccagcccttaaaatatgtgcgggttacgttggcaagtcagaaaaagtacttagagcctgatctctgaacctaaggacctaggcagaagcgagcataaagagtccctcagtcatcacgcagtctttgggtgccagaggtctcctgatcagccccattgagaagcatctgtgtgctgcaggaggctgtgccgttgctcatccttccacctgcgtcatttgagatggagcctgacctgttgaacacagggacatccagcgccagtcaggcatgatcacgtgcttcaagaaacatttggcttttctccacacagaagaatcctgtcaagacagggcttctccatttgagcttaaattttctcacagatggaattaatttcctatattgctaagaaaaattctcccagtcaaattcccattgttaattaagtgttgaggagaaaattggtattttgtttctttctcctaaaatgtggaaataacatggtttcattttaattatgtatggcaccagtaaaaagaaaaatttgtagctgctctgttcatgttggagcaaatgtcctgcttttgagaataagtgtggctgcatgctatacaaaagagaaacagggactccacagcaattgtcagaaccacagtatcacagcgcttctggtctctgagtcctaccaggtaccggagatgaacgcttctcccagcgggacttatggaccctgaagaagcatttcaatggggtcaaaggacttctgaataccctctaaggaaatgtacaaaaactatgaagtgccttttaatgaggagcaggtgtagccttggagaataagcttgccctaggagacatgctaggttctcttccacctgtagaccagtgggtgtaagcctggccctggaaacaggctgcctgggttcaagccctacccttaccttttgctagctttgtgacattgggccagatagatttgtttttcttttaacatctttatttgacaacaattggcatacaacagactacaattagggtgtacagtttgatgcatttgataaatatatacatctgtaaaacaatcaacttaagacagtgaacaaattcctcatccccaagggtttttttatgcccatgtataaaccatatttctcatttgtgcctctcccttcatttcccccatccccaggcaaccactgacctactttctgactgtatgtttgcattttgtagagtgttcgataaatatagacatataatgtgtactctatttaaaaaaaaacaactggctcctttcattcagcataagtattttgagagtcattcattcttgttccatgcatcagtagttgatatcttttcattgctgatttgtagtccattgtgtggatatacctcagtttgtttatccttttgcctgctggtggacgttaggcttatttccagttaggggctattagaaataaagctgctgtgagcttttgtgtaaaagtcttttgttgaacatgtgctattgtttctcttgggtaaacacctaggagtggaatgcgtgggtcatatggcaggtatggatttacctttttttttgagacagagtcttgccctgtcgcccaggctggagtgcagtggcgtgatctcagctcactgcaagctctgcctcccgggttcacgccattctcctgcctcagcctcctgagtagctgggactacaggcacccgccaccacgcctggctaattttttttttttttttttgtatttttagtagagacggggtttcaccatgttagccaggatggtctcagtctcctgacctcatgatccgcctgcctcagcctcctaaagtgctgggattacaggcatgagccaccgcgtctggccagatttacctttttaagtaactgcaaaactgtaaaataagataatcctggattatctgatatacaatttctcacttaaaagcctttgagccagccgggcatggtggctcatgcctgtaatcccagcactttgggaggccgaggggggtcgatcacaaggttaggagattgagaccatcctggacaacatggtgaaaccccatctctactaaaaaaatacaaaaattagctgggcatggtggtatgtgcctgtagccccagctgcttgggaggctgaggcaggagaattgcttgaacctgggaggtggaggtagcagtgagccaaaatcgcgccactgccctccagcctcgcaacagagtgagactccatctcaaaaacaaacaaacaaaaaaaaacacctttgagtcaggtgtggtggtatgcgcatgtagtcccagttacttgggaagctgaggtgggaggatcgcttgagcccaggagattaaggatacagtgaactcagatcataccactgtactccagcctggacaacagaacaagaccctgcctcaaaacaaaaacaaaacaaccccctttggggcctttgaggaaatgactaattgcaggtccctatcaggagaatgtagaacaaagcctcaaacatcttaacaatccagaaagcaagggagctatcaaagattgtcaaaagatcacacctgtaatcccagctctttgggaggacaaggcaggaggatcacttgaacccaggagttccgagactagcctggacaacatagtgtgaccctgtttctaccacattttcttaatccagcccaccattgatgggcacctaggttgattccatgtctttgcaattgtgagtagtgctgtgatgaacataggagtaggtgtaaattgttctaccacaaggttctttcatttcagtcatttcaggagctttaacagggttctggctgggtgtggtggctcatgcctgtaatcccagtattttgggaagccgaggcaggtggatcacctgaggtcaggagttcaagaccagccttaccaacatggtgaaaccccttctctactaaaaatacaaaaaattagccgggcgtggtggtgggcccctgtaatcccagctactggggaggctggagcaggagaatcacttgaacctgggaggtggaggttgtagtgagtcaagattgtgccgttggactccagcctgggtgacaagagcaagactcaggcttaaaaaaagaggttctgtggcgctatccatggtgctgaccagtactgaccaagggaacaccagaagaaaaagaggcaaagcagggagcatgaaagatgagtttggtcttatgtgcactaaatttgaggttttgggagacccttaagtggagagatatctaattgagaatgtcttatgggcttggaattcaggaagcaagtttaggctggaggtagaacttaccttcctgtggccaagtcctcccagaaaccctgctttgattagtcaccagcctggcaacccctcattatggtgcagcccagaatactgcagcaacagaatattctagcttcagggccttttgctttgaagaggtaggttctcagtttatcaattcatgtctgtgggtatgcattgctagctgctttgaggagttttgtttatcagattgagtggccatatcttggatcttaccatggaataaaaaggggtctttagcatgtacgattatgtagcaagctcagtgaacactgtcgaaatctatctcttttcattttaggcaccaagccaagtttgctagcccctgcgctttcttctgtaatttaaaatgttctacgtttttcctccttagttattctccagcataagcaatgggaagtaaacaattcacctggtcagcttagaaaacaacttactgaattgatttgcactacatgggcctgagtagaaactgctttatctagatcttagttttataatttgggagaaaagatggacctagacaccatttgtgagagactacagtttctatgaactcctcttaatcagtctataaggtaagaaagacatactatatgctattaaataccagtacttttgccttcttgctctgactttgggcatgtaagtatgaataaagaagagaagatgaatttacaatagcaaagacatggaatcaaccccaatgcccatcagtgatagactggataaagaaaatatggtacatatacaccatggaatactacgcaaccataatataggaatgagatcatgtcctttgcagggacacggatggagctggaagccattatcctcagcaaactaacacaggaacagaaaaccaaacaccacatgttctcatttgtaagtgggagccgaacaatgagaatacatagacacagggaggggaacaacacacacacataaaacaaacaaaaaaaagaagatgaagaaatggcagcttttgtagatgagtgtcactgttaggaagagggaggtttctctttgatgatgtggaaagaagacattggcttggctttccctggggtgggtaagtagccaaacacggtgaaagatcagcagctggtagaaattccaaaaggggaattaatgaaaaatggttaaaaagcagtatggtgctttggggggggaaaaaaaacagaaaatgttaatttcaagaagacaatacaacagaaatcacatgggccttttagagtgaggcaggcctgggtttgaatgacagttctacattctgggtggtcacatgatcgtgagcgcattattttaatgccctgaattttttttcttctgtaacatattaggagttgcacgtttgtaggtcacactgtgcacagctctggtctagcatttgttttgggaaaaataagatctgatagcagaattctaacatttgtataaatgttcctcttaacagaaacttacaaagactctttgtaatagactgcaggtcaaagtagtgaggcttgaaccgctacagaaagcacaacagtattaaaggaaaagtgcaccacctcttggtgaatgaacatgtctatggccataactatatataagattatctgagaagtttggtaaccttaaacatataaccagccatatttgtacacaacaggctttctgaggagacatagttgcctggaatcatgtcagtggctgatactcttgaaacggcaaattgacatcacagtgggaaaagtgtaaaccaccatcaaagacagaaaatgaggtcactgcagtgtgcctccttttatttacagatctaggaaagttaataatgagggagatcagaggaaggggagtagaaaggagacaaaataggaatgctcttgaaatttatatctgaggacctttgtgactgcactgagaaccagggaaagcagtaaaacttggggggaaaaaaaaccatgttcaattaaatcctatttcaaatgttttatgatgttcaaattttatagaattataaagttcaggaaaccatagaaatgatctcattttccttgttactttttagatgatgaaattgagttccaaaatgattaaatgaccaacccaagacgatctagctaggtaatatattttgctcacaggatcttctcaaccactggtccctctgcctgaaacgtgtcttctatacaatactcatcgtccttcattgcacagttaatttccactgttctgcagattttaggtcttttatcactttcctttgggagtctaccctgatcactgcccccacatctcatcaaggtcaaataatgataataacagaaaacaacctcatctaatgttcattgaatacttattaatcatgataactctatgaggtgaatactgcttatccccattttctcaaaggagaagctgaaatacagggggattaagtaacttgctcaaggttacagttttaatatgtagtagagccagaattgaaacccaagcatttctcactgcaaactccaagctcagtcctagtctaccagttattctattatcagaataccttgctcctcctttagcatttattgttctcatatatttatatttatttgtgtggttatttgattaatacgtttttttctactagaatgtaacttttaggctcagattacgtatctttttgattcaccaaattttgcttagagcctaagtacctgatatctggcaggctcattgaatatagttcatatgtaaagtagaggtgataatagcatattttggccaggcacagtgcctcatgcctgtaattgcagcaccttgggaagccaaggtgggcagatcacctgaggtcaggagttcgagaccagcctggccaacatggcaaaacgctgtctctactaaaaatgtaaaacttagcccggtgtggtggtgcacgcctgtaatcccagctacttgggaggctgaggcacgagaatcacttgaacccaggaagcaaaggttgcagtgagccaagatagcaccagtgcactccagcctgggtgacagagggagactctgtctcaaaaaaaaaaaaattaataaataatagagttaatggcatattttatggtactatttaattgtaccctagtactaattgcattgtttggagaattgagataatatatacagagtagtcactagttcatgtcactcgctagtactcagtaactgaaaggaggttaattgtaataaatagatttagcttaagataacaagacagaatctgaatccaaatgctcagtgctcttaacttttattccctacccctttgggtacctataatgaacattattagaaaagtgaatcttagaaaatatattgcttcccagagatgatttcagattaactaacagacagctaaagtataagttccctccttggtgtcagttttattcttgagctggagatagacccagagtctttatgactcagtggtaattaacagataacttgtttttttctttgttttttgttgttgttgttgttgttgttgtttgttttgctttgttttggtttggttttttttgatgcggagtctcactctgtcgcccaggctggagtgcagcagtagcgtaatctcaactcactgcaaccttcgccccgcaatgctggggttcaagcagttctcctgctttagcctcctgagtagctgggattacaggcatgcgtcaccatgcctggataatttttgtatttttatataaagatgaggtttcaccatgctggccaggctggtcttgaactcctgacctcaagtaatccacccaccttagcctcccaaagtgctgagattacaggtgtgtgccaccgcacccggctgatggctcattttttaacaccctgagtttaaggtggctgtgagcccacctagagatttcccaggggcagttaggtctatccttgcaaaacacaaacttgttataatagttttggactatttttaaatactttagtgcaaacactatgtgatccacctgcctcggcctcccaaagtgctgggattacaggtgtgagccaccacgcctggcccagataactctctgaaccagcatctcaagctttggccattaggaaagtctaaagtaagtatcttcagatcaacatgttatttgagagtgcagttgtgatgtccttgttcagttactgcaggagaagggtacttgcttctttaccctttctttgaccttttagatgtatttgtttctacacgcattctgtggctttctgtgtatatttcaaagatgtagatatgatctattatttcaaatcatatccttgaagttcagcagtgctatctctaggtataaaagtacttgtagtaagggatcatcaatgtattctagtatacagacctagaatagctgtagaataaaaattgagttatattaataacctgtaaaatagtcacagataaaatggtgaagagatcaaaattaatcttaaaaaagcataagccaaaaatgcagatatcatagggtcaaaaatagtgatattcatgaaagttatgattaattatttaatcccaaggacacagtatactttaaaaatatatttcaggttcacaattgactagctattttatgtggcagaataccagctttgcatatttattaaaattattcataactgcatagcagcctagttgaactgttgagtccttgttcctttgtccaatatgttaccttgtccatttatcatagcactgtaatagaaatttgtctaaattttaggatgatccgtggaatatcttcagtgtcagcatgtcttaaatattttattctttccgttttgcctaatatgatctttttacataggtttagaagatatctccatggggaaaaaaatgcagtttttttaaggaataaattttagacagaagtctttgttcaaaacgaaaagttattatatatcattaatatttatgtgtcaaaatatttctcttacataaaaatctggacaagatgtgaatgctttttgtggaagaatggaagtttgtgttcttcatgcagattttgagataactatgtttgctttgagtattatttgttgagaatttaatgcattgctgtggtcattcaatttaacagtgtatttgggtggtgggttctggagtcagacttcctttagttcaaatcctgagcccaccacttagtgtttatgttgtttaactttctgagcaccagttatctcatctgtaaaattagatgataatagtgttcttcttggagggttgttaggaaagagtgtatgagataatgcatataagagcacttagaacgtgaccaggtgtggtggctcatgcctgtaatcccagcactttgggaggctgaggcaggtgggatcacctgaggtgaggagtttgagactagcctggccaacatgacgaaaccccatctctactgaaaatacaaaaattagcccagcgtgacagcatgcgcctgtaatcccagctactcaggagactgaagcaggagaattgcttaaacctgggaggctgaggttgcagtgaactgagatcgtgccactgcattccagcctgggcgacagagtgagaatctgtctcagaaaaaaagaagaaagaaagaaaaaagaactgagtcagacacataataagcattcaataaatactaggtgctgtcagtgttaataatagtatatcatggaatgcctcagcaagcataggctagagttttatcaagaatatatggtaaagagaagtttatttccggtattatgtctctaaactgctaaagacttcattagaagatgatgttaggaaagaaaagttgtacaactctttagctagaatattaattaaattatagtagagttcaaagaagtctcagataatctagtttaatgacctctctttgcgtaggtaaaaagtgtagttcccataggtcaagtgaccactgcaggatcacccatctgggactgcagactctaacccaggtctcctggttcaaagcctagtactcggcctgttttgaaacactcatttattagcaagaagcattcatcaatgttgtcttagatgcagcaattattttgggaaataagcagtacatgaaattttaggcagtatgtaacacttccttgcttctctgggtttggtgtcctagtgacttttaagcctccagaaatatctttccacatacctaagagtcacacagaaagtgattgactgtcgcagagctagagccatcatcagtgcgtgtgagcagctctccctgaattcctcattgggacgatagtggtcgttttggtatgggtacagaaaatggaatatccgtggagtgatctgtaatttccctcaagacctcataaacttctaaaattaacataaagcctttcttccttataaaatagagtcatgtgttaaaggagatgcattagatgcttctgtgcagtatattttagtaggttctataaaatttgcaataaaggaaaggtcagtgttggtaccataaacagtgttcgtggagtcatatttaaccctagtcccttctgtgactcctggagtgtagagtaattgaactactcttctttgaaaatgcccctgtacccgtcactgcccaagaaagaccccactactacccagcactcttttcttagaggcactacctgctcctggctctgggacccacctgtcaccaaagggcagtctgaaaagagggtggatttcatctcatttacagcatgggagtggaagcttcccttctggctcagccacagttttgtagttgaggtgaaagtgaaaagactgtcgtcacactgatctgtggggtatgcagagcagagtcctccttctgtattttggtgatcacatgtgaaactaagagagtgcaagggtgacctctgcatactgacgacacatgtagttgtactgcgcggcgagtggctattcatgtgacctttctggctgtaggcgtagcttcccagcctgcagaggctcctgcactgtataatggcagagataatggccctgggcttgttccacagagcagttttcaagcttaattgaagaatatttttaacccattatcaagagcattaggaggaaattttcgaagagtcttgcttgatacagctctttcaattgaagaaagtagactcccaagtaagcaaattacaaccttaaatagtaatccatctttatttgcaatcccttcatctttccaggataaagactcctctcttcactctgaaagcatgaaaaggggcagatccagacagagcatcacacatgcttcttcctcctggtgtacaggagcacgtagggccctttgtttagaacaggatgcctttgaatggactgccttgaaaaaatttttcagaacgatcctaaccatgtctgccaggctctcatggcgcatacagatctggttggaagatatttaaaggtgttcaggcaacgtgaagggaaagcacccatctgagacaccatgaatgggcttttctttacgtcattatttctagctcctttctgtttctacgctgagcaaatttgctctcatcctttcaaacttagagggtttttttttttttttaaagattgctgagagatgcccccgaaattatgattaccacagccagtttctcactcagtcatggactatagtcaaatttaatcttatctttaacttcacagaatagttaatgttatcacacgcttgatttcttggattattttgtcttttacttttaaaatggcaggagaaaaataacccgatttttttctgtaattaaaataagtctgtatgaattagcatatgagtgatcagataatatctaaccagttgaagtttggaagttcctttcgtttaaacaaaaatagaatttcagcaccattttcatttattgattcttcttttcctgtatttcacagtttttaaaaatgtgtttgaagtcaccaaaaatatacttctaatgctgtgactaaatttgccacaattaagacacccaagagtccatcagggttaaagtaggctacaatatgtttataaggacaggcaaaaggtgtcagtgtaattttattaggaaagtgaaaaagagaagtctatgggcagtcaggaacaagctgagttatttaccaaaaatatatggtaacttctcttttaggtgtgtagtgtgtatctcaaagaaacacatgttagttcacaaggatttatgattttttgattaatcagaaatccattcaaaaaatttaccagtatttctcaaagagaagtgctgtctgtagacaccatgggcacatgaagtaaaataatctgtgaaaattctttgtcttgtaaaaataggagtgccaatctgatcaatgtattgtgttataccagctgtgtgggtgttacagaatgaattttggtctcaattttgtaacttacagaaaagctataattgcagtctctcctgcccacttgtatggtcaactaattttaaccatctctaaaaggcacttgcaaaaagggaaaaatgcccaattcttgggtgcatgggcaaaatatacatatagaaatgatagttcatgaggaccagatattctgaaaaccttctcaccatggtagactagatgcagaatgagtcagagaaatgtattttataactatattgctgaacttgtaagagtagaggaaaatcctcaaggggcagaaagaccttataataatttgaaaccaaagaaatgtgctaaaggagaccaggactgtctcaatagcaatgcccatgtaaggaactcagaacttaaccactatggaaaaagatgactaggcctggggtttggttgcagttggaggacgaaactctttcacaaagctagcacattcaaaggggctaccccctcagagaaagtcagagctgaaaaaattagcctaccaagaaaggaagcagatgggaaaatgtgtctgcttttgccattgctctacatcaaggaaaaatagtagtcatcatagtcatcttctctcctctcctaaccatttgtgactataagcttaatgttggatgggcatgcagtataagtatacgctacttgccaggtcatggaaactacatttaaaaaatgtagataatttgtttccaaattggtggaactctgtggcatttggtagagataagcataaatctggagcaaagcattaacaaaatcgtgtcctaaggattcctacagattcaactgatatgaagtcatcataaatacttacacacacacacacacacacacacacacacacacacacacacgcactctctacatatcacacatacactctcagggaagcaatgaaaaattaccaaacagggaataacataagccaaaatttgcaagactcagcagaaacaagaaacacagatctacatcccccatgccttataacattggggtgcagaatactgcatatagaaaaatacatgtgagctatatagagaaaaacgttgagcaaagagtcagcaaccatcaaaaacaaccagaaagatctgaaaaataatagaataacaagaaatgaaaaatataatcattgcaattaaaatttcagtagataggttaaaagggtattacacataaatgaagagagagtaagtgggccaggaacagtggctcacacctgtaatcccagcactttgggaggtttgcagtgggtggatcacttgaggccaggagttcgaggacagcctagccaacatggtgaaaccccatctctactaaaaatacaaaaattagctgggcgtagtggtacgtgcctgtaattccagctactaggaggctgaggtgggaggatcactttgagcccaggaagtggaagttgcagtgagcctagatggtgccattgcacttcagcctgagtgacagaacgagagccttcctcaaaaaaaaaaaaaaaaaaagagagttcaagaataaatgaactggaaactcatgaaaaagataacacaaaacacagagtaacgagatgaaaaacagtaaagagagagtaagacatagggatgacaaattgaaaagatttaacatatgttgattgaagatccactatattaaaatactgaaaatgagagaagttaagaattgggaaaggtttgagattttaccttccttccaagctcataaattagcttcccacagtttcatggatgctgtttgaagacacaacattcctgggtcaaacacaaaggactttatttctcaccgcacaacaggtagcgtgaactttatgttcaagccaattccccctgctccccaagtcccatggggatgatgtggccctgatgcacactgggcgtgcagtgagtttgggtcatgcccaaagacacctgagcttcggaagcccaagccttttaaaatggtctgtaagcaaatgtgctctttaccttggagggagacattatctttagtattatttatcgtagtagacagtattaccttactagacagtaaacaaatctgctgtctgctccagagagacactatctctatcttccaaatatccttgaatagttttttctgaactgatgctgtcagggcctctgctcacaaaatatgcaaaagtttgtgagtcccatggagaattatttcccactagtggagaaacaatttaagactgagacgtttcagaacgctagaacattggaatcctctgatacagtttacactttgtataccaagcagcactaatacatatatagttagacctatcatggtggacaccaaaaacaaaagaggagacattaaaaacaaccagtaagaaaagagttcaaattgacaagctaattctgcagttatttggaagagtgaagggtcagaaataacaaaaaccctcctgaggaagaaccaaagtagtagagatgggctgtcttgccttagagacattaaggtctgttataaagctataataacgaagacagcctggtattagggtgccagtgtagttacagacaaagagaccaatggaacaggataaaaagcccataaataatctcatgcatatatgcacacttgacttacaatggaaggagtattgcagatcagtggggagagactgaactaatcaataaatcatgcagttacaagatcatacatgtggagaaacaaaatgaaaccagatcctgaagtacacaaaaaatcggttccaggtatattgaatatttgtatttttaaatcaccaacagaaaggttttaaaggaaaggaaaacagtagaactttcaaagaactaaaaaaaaaaaaaaaaaaaaaagaatataacctcagagtagagaagggtttcttaccccaaactcaaggaaacacagattgtaaaggaaagattaataaattcaactacattaaaatgaactttctctttatcaaaggataccattaataagttgaaaagatgcaagccacaactgagaaaagtggtctgcaacacacacattgctgacagccgattagtatctaaaacatttaagaaagataaattgataaaaggtatgaacaagcatttcaaagaaaggaaaacatgacttgctaatatacatgaaaaatggtcaacttcagttgtaattagagagctagaaattaaaaccatgtgacagcattttatatgtaccaggttggcaaaattaacatttggaacaatacagtttgtgggcaaggatacggagccacagaaactctgatggtctcaatctaattccctgcaaagaccaaggcagacatgtatagtctaagttctctagggttttatcaaacataagaagaagctgatttaacaaaaatcttatctgttcttcttaacgagcaccaaaatatttttattatttatttattttagagatggggtctcactctgtcacccaggttagaggtcagtggcgcgatctcagcttactgcaacctccacctcccgggttcaagcagttctcttgcctcagcctcctgagtagctgggattacaggtgcctgccaccacgctcggttaatttttgtatttttagtagagacggggtttcaccatgttatccaggctggtctcgaactcctgatctccggtgatctgcctgcatcagcctcccaaagtgctgggattacaggcatgagcccctgtgcccgtccacaccaaaatattttcaagccaaattgttctctggtcaaaccttgaatattgagatagatgtgctttatattttcaaggggaaataaatacctgcagagaaaaatccactgcatcccagatggataccagttttgtttatcttcatcccaatttccaaggttagataattcaaaagagaaccttaaggaatagccctcttagatatattctgcttttatttctattgcaaatggaaattgacaaattgacatacaaaatgaaaaattaaaacacaaaatatgtagtgattggaataaaggaaaaggcacaaactgctaaaattctccatgtttgagagagaaatcaagcaactgagccctgttatcccctagaagaatcccccggggcatcaagttgcatcttgtcatgaaccaatgagacaggattacagaattttttattatttttttttgagacagattctcgctctgttccccaggctggagtgcagtcgtgtgatcttggctcactgcaacctccgcctcccagtttcaagcaattcttgtgcctcagcctcccgagtagctgggatcacaagtgtgcaccacatctggctaatttttgtatttttagtagagatcgggtttcaccatgttggccaggcttgtctcgaattcctggcctcaagtgatctgcccgcctcagcctcccaaagtgctgggattacgggcgtgagccaccgtgcctggccctttggattacagaatttgacgataatgggttcaaagctgtctggaggcataacctccggggcagctgaacaagattataggaaaggaataataaaatattctgaagtctgtctatgcaaacaaacacagatgtctactctggaagaataaaatgtaccctagaattgcttttttttttttctagtatgattgagatgttatggtaatattaaaaatgaaaaaaaaaaatcccaaaagtctaacctagaataactgcactgatcatattgccttgttctttaaattcttagtatccaaataactttcagtatttagtgagacatattcgtacatactcttactaccagacagcctatttattaaacattcttaattcttgaactaaactgaatggtcaagtaagttacctaattagccagggaagctaaaggaagtactaggagttaccatcttagggaaaaatttccacacttggatttgaatacttgtgaaactcggtagcagtgaactagatctgaatcaatatctctgcctgcaagtcatataacctctatgagaggttaatgtggctcctgtttgactctgtgttctccatcagctaagcatgtgcatgtgtcattcatattttgttttcagcttgttacactgacaggaaaatctctgcggaataaagaaccagttttctcagcctctaaagctatactgtatttgcatatttccaagatttaaagagaacagtgttttccttgtgtggacggttcttctatttgtactgtactggaaaacactgacagctaccaaactgtctctcattttgttcctgctcattactaattttgttgattcaatagtggaagtggggaattttttaattagatggcatatttcaaaaccattttcttaaaaaccctgaataaaatgtccgacttttgttaaagccactttgctttgtgcattacatgttgtgtttatgaaaggattaatatatataagccgattctgttaggtagataagaccttctagtttagctctgttaattccatacatgattgtgcatatgcttgtgcatacttggttggtcaaggatggaaaggaatagcgaagctaactgagaatcacttgtttaaatacattgattttatacaatctcactttgcaggccctggttgacaccttaaaataaaatagaattctttagctggtgttctctttattttgtacgtaaggtaatccccttaacaaacaagcaaacaaaaacttaatctcatttgtaatactaacaattggaaacaacagaatgccctgtgagatttgattgattaagtaaataacaatgcaacaatatgattgaatcctaggcagccatttcaagttgcgatgtataagatggtttaatgactttgagaattttcataacatactataaatttgaaaagccgagagtctatatcccaaggcaaatctgtatggaaacaaaaaaaaagctttgaaggatacatgtcaaatattaatagttttcttaagtggtaggattgtatgtgggttttttctctctttatgctttccagtactttgtaatttttctctaattattatgtgcaacctaatttatttttttctaacaacatgtaaatttcaataatttattattttggctaaaaacatagaaatgttttaataaactttcataatgagaaatatattaagaaaaaaatcacatttcttgtatttttattatcacagtagtattcaatataattacaggcaggcctcaaagatatctcagctccagaacacagcagtaaggcaaatagtgcaataaagcaagtcacagtgcatgtaacagttacatttatactgtactaagatatattgggcgtgcaatagcattgtatctaaaagaaatagtggacatacctcaatttaaaatatgtgctgctaaagatgctgacgtggaaatacaaagtaaacacctactgttggaaaaatggcacccaaaagcttgcttgacgtagggttgccacaaactttcagtatctccaaagcataagaaaacaaggtatgcctgtattataggcatatgctttaaatgcatatataattaacaattttatgaatatgaattatataataagcaattatattactgcatacatatgcaaattgtatataatatataattatcaaacagttattgtatatcacatactctgctaagctctttatacaagttttcaggcaggcagaaaacataatcatcgccactttgtaggtcagcaaactgaggatttgatcaagtgctttgccctcagtagtgttaacctctaagtgacagatcccagctttgacctggagcctaagtcccaagcccgtgctcttaagcattgcccttttgtcttttactttatttaattgttgtcaaatattagcagtggttttgcctttatccctttcttgtcttccatttctcattgcagaagaagatgcaaaattcatttgagagagaattataaagattgtcacaattgaattgaagcaagtgatatttttaaatatctattgactaattattagattgcatttcacttattttattgaatgatacagaatgcatttctctctctctctctctcttttttttttttttttttttaagggacaaagtctttgttgcccagcactccaggcacattcgtggctcactgcagcctcgatttcctgggctcaagtgatcctcccacctcagcctcctgagtagctagggctacaggcacgtgccaccacacccacctgtttttcaaaaaaaaatttttgtagaaatgaggtctcactatgttgcccaggctggtctcaaactcctagcctcaagtgatcctcccaccttggcttccaggagcgctcggattataggcatgagccactatgctgggcccatttctctatttagaaaggaaaaggtgcacttgggctgtgttaaaggttgtgattcttaaattcacactaaatcatttcctttttttttttttttgtttttgtttttgagatggagtctcactctgtcactcaggctggaatacagtggtgcagtctgcctcactgcaacctccacctcccgggttcaagcgattcttgtgcctcagcctcccaagtagttgggattacaggcacacgccaccatgcccagccaatttttgtatttttagtaaagacagggtttcaccatgttgctcgggctggtctcaaactcctgacctcaagtgatccacccacctcagcctcccaaagtgctgggattacaagcatgagccaccacacctggccaatttcctttttttttttttttttttgcaaatttaggtgtaggcaacaaaccaaatatggcacacatttgtgtttcagggtcacaccatatgagcggtggcacacacttgtaatcccaatgctttgggaggccgaggtgagctgatcacctgaggtcagtagttcgagaccagcccagccaacatggtgaaaccccatttctacaaaaaatacaaaaattagctgggcgtgatggtgtgcgcgtgtaatcccagctactcaggatgctaaagcaagagaatcgcttgagcccgggaggcagaggttgcagtgagccaggatcacaccattgcactccagcctgggtgacaagagcaaaactccatctcaaaaaaaaatgaaaaagaagtcacagttaccctcttactgtaggcacttagggttacttgggggtgtatggagaaacaggcattattaatgtagagcctttacttgtgtgtttataaatctagggattagctctggtgtcacattgggcatcagtgaaattctgtgaaattcctttgataattcaatctcccctctccccaattttcgtaccatttctagaaagcatatgccacttattaatgcacaggtagtatgctcttgtccgatattatcttctttctgctcttatgaaatctagtacagctggcttcaatcaaatcataatacaaattgcatactgaaataaaaaataatactcagtgtttgtagccagagaccccttttggccctaagtatttagcttatatgtatttttaggcacaagtattacttgttgcagaattttcaaccaaggagtgaatgaatatttaagaaaaaaaaatctcgattgtttcagttcatgctctcagtcaaagcacatcccggcacatttatactcatccatcctgtgtgggcgaggagggaaagccgtgttactaccatgtgaaacttgcagtggtttttatttttaccctctgcacacacacaacagagtattgttttgtgagaagaattatgtgtaggagttttagagatctatttgtatcctagctctttcctaattgtatatccttagggatgtcactgaactgttctgtatatttcatcaactttaaaatggagatagtgttaatagcctgttgtaacacagaaacttgtttattaaaagtaggtaacatatgtcggagttacacagacttgaagcctgcttcttccctttctttgcttgcctcatgagcactgttagagcctttggaaagatacttcttttccaatggtgatgcaaagtttagtggtttgtctcttggctttacttgtatttttttccctagatttttttagctctcccttgtatatttttctgttctctatgtaaagaaagattcattaaaaattaattaggccaggcattgtggctcacgcatgtaatctcggcactttgggaggctgaggcaagcagatcacttgagcctaagagtttcaaaccagcctgggcaacagagcgagaccccatctctttaaaaaaaaaaatgtagccaggcatggtggtgcacctgtagtccctgctacttgggaggctgagatgggaggatcatttcagccctggaggttgaggctgcagtgagccgtgatcacaccactgcactccagcctgggtggcagagtcagatcctgtctcaaaaacaaataaataaaataagatttttagttttgtatctaatacattcaaataaacttatacatttgccatgtttatgagttcttttttaattgaagtgtaatttacatacatttgtacagaccgtgtgtgtgtgtgtgtttgtgtgtatataatatagttccctgagttttgacaaacgtgtataaccagtataccagtttaggtatggaacattccgatcatcctggaaagtttgggaaatgtttttttccacttaagaatggctcatttctccagattctcgggttttttttttttttttttttgctttggggcaggtgaatcatctcttgttatcagcgcccctcctgtagcttctgagctacagtctttctcaatcagcctccttttactgatgacatgcttcttgaagaggaaaaagtttgctttctttttctatgagaattttccagtttttcgttttgttttgtttattatcttcctagcatctctcttcctcatttccaggtgatgctggcaatctattttacagtttagcacaacctttagactctaaagaggtcatttaaaggtgctttccaataagaagcattttagtgttgtctctgaaatgtttttactctccccctgcaccactcagaatttacatagtttttgcgtacataaatgtgctctctcctcccccaaatttagtaaaatgtaaaagtctgagttactgtcaattttgagatatttaggaaatttaactcaataccaaaccagccatttctttgaagtagaaataaatatttcatttacttactttattttgttttcctcttggcaaacacatagtgttacattagtttaaactatgtctgttattttaagtcagttatttgttattttttaaaggcttcattaggtataaaagctatctgtaagtcaagcttttaaagtactattgagatttgtcagccataattcaatttttattctttgaatcaagacctaaactagtacctttagagtaatattgcaaatgagcactacttattagaactgtttttgaaagtatgcaaagtgtgtttgttctaccttgccttgtatatttacacctcttcgattttgctttatgaggagcaaaagaaactgtcactatttgctgtaaattgaagcttttaataactaagtcttttctacaacatttgtcagctttgaatattctgtcagtggaaaataaaaatagcagggaaacccagcagtggtgacactgagaatttatctgcttatgctacactaaggtaaaaaaataaaatcttcaagggtgagcatttgacatttttctttcaaacaaagtacatttgaactgacacttccttgaataaattttagatgaaaagttggcaaaataaatgaataagtttcatcattaaacacagaacaccttttaacctagaaacaagagaataaagaggttgcttcatatcattgattcaatcctgtatgccttgtttgacatgagcttgaaaaataagctttataaatacataaaaaggaacatcatagctcagtagtaaaaacgttgatgcatatggcatttaaagttttaaactatttcatagtaaaaattcatgtgcagatcatcttgaatatgtgacaataaaaattaatttatctaataaagatgattcaagtaaatcaaatctaaattccatactccacatttttgttcgtaaattgtgtgcatccgttataaatattaaaaacatgaatgaaatatacattatgaaaaactcctgctttctctttttggataaaaacattgaaagtttttcagccaggtgcagtggctcacgcctgtaatcccagcactttgggaggccaaggcaggcagatcacgaggtcaggagatcaagaccatcctggttaacacggtgaaacctcatctctgctaaaaataaaaaaaaaagtagccgggtgtggtggcgggcgcctgtagtcccagctactcaggaggctgaggcaggagaatggcgtgaacccaggaggcggagcttgcagtgagccgagattgtgccactgtattccagcctgggagacagagggagattctgtctcacaaaaaaaaaaaaaaaaaaagcttttcaggactccttattagtgctgacttccagttttagttagatctgcttcttgttcttctgcctctttcttttctttgcctgtctacttgtaagtctcttctcaaaagatgcctttatcattgtctttatgaataacagtgaacatttatggaggacctactgtgtggcaggtttgataaatgtaacaataggtcagcgctattttgaggaggaagaaaaatgttgttggaagtgtgcttaactatgctactgtataatcttcacttaaacttctgttataatagaaaggtgattaatgagaccccatgaacctgcctcctcctgtcaaccttttgacgtgtctgcaaatatacagaattttaaaaataacctctcagtgagctagagatagtctcagcttttacagaatggacatgcctgcatcttttaatttagctttctgttagcgtgattccattcttacagattgagcctgagggaaagagagaattattgtcaaaataaatgagataattacatgtgtgtaattttacaaagcgctctacaactgtgtttgtcagtgatgagaaatgcctagttctaaaagttccttgggaaggagtggaatttgaagagttttagatggcaagatgtgtttacttttggttttaaacaaaagtcctagtgtagtgttagggcctggtttttcacagtgataaattgggactttattgctgtatgaatggtggggttttttcccccaaaaattaaatctccttatgtctcttatgaaatctcatttcaaacaagattacaggagtcatttctggtaaaatttggacattaacacacattagtgatttgtgaagatggttgaattttttgtacggagaatttttatactaaattcagtaaatagttctgttgtgccgtgtgccccctagaaaaatcacgtgcctataaagaacttaatagggaaaattgaagataatgattttcctctttggcagttttgtcgctgatttgcaaggtagtaacagggcatttgagttcattttctgttttgtgtgtgccccttccatattgcaaagttacaatttttatttgcttttgtctttttttagtagtctgatttcgagtacctcttaggagttacaaagctgtcaggtacaatatttctcttttaaagactgataagattttcccctttgaatatgctttttctttttaattgtgttacttgatttggataaataagctactccaattgtttggataatgaaataagatgcatatctctgagaaggagactgatttaattcctcgttttcatacatgctgaatatgccttcgtgattcataagagccatttctaatctgcattttgttagggtatttgtcttgcttctaaataaagagaatgaaaacctttttaagttaagactgcattgatggttcaaaaaataaattaaaataaagatgagattgtttaaatctttgattaataagcaagctcataaagttcttgtgaattttaagggaaatagttaaatggatttttcctaaccatttaaaagtctcagaacggaatcattttatagagtatctactggaaagaggaaagtgaatataccacagaagtctttctttataaataaatgaaatcctaaagtcatctgctaatgacttttatactaatgcttttatagttgtgacttgggtaaactgtttaacattttacagcccacggtttcctgttcttaatagtaaagcaaagctatttatttatttatttatttatttatttatttatttaaagtatcttggttttcaacaataaactgtgaaagctggcagctctttgttctaaatcttctgaatatagtccaggtacatttaattttctggaaagcagtgctttcaagtagaatagtgaataattgaatttcccatttgattttagaaaaaaaatgaattcccattgtttactttagccatctgttcatctcccttcttcactgttgtccccttcctgccctttcaaacaagccatagacttggctaactgtagactacagcttctcctcctctctctcaaatgtggaggctcgtagcaaactttgacctatcttcgtaggcaatgtgaaggagaaaagcaataagctctctgcccagagtcagcacattagcatttgagaaatcaggttatctgactttggttgattgagctgcctttgaactgccttagtttccccaaaatgatcattctttgtgagatggaagacaaaagtgattcaaagacacttcattcagaagaaagcacgtaacgctaggtgtggaggctagtgcctgtaatcccagcactttaggaagtggaggcaggaggatggcttgagcccaggagttcaagaccagcctaggcaacatagtgagacctagtctcttaaaaaaaaaaaaaaattttttttttttttaaattagccaggcacaatggctcatgactgtagtctcagctacttgggaggctgaggtaggaggattgcttaaacccagcaggtcaaggctgcagtgagccctgagcaggccaccacactccagcctgggtgacagagcaaaaccttgtctcaaagaaaaacaagaaaaagaagaaagcacacagtttagcagtcatcccaattcctgcctatgtgccagtcaaagaatagtcagatgccaaagagctcatgtggtggtggagttttttttaaatagctttattgagataaaattcacatcccatacaattcactcattcaaaatgtgcacttcagtagctttttatatattcatacagttagcattcatccctacagtcaattatagaacattttataatccccccagaagatgccacaacccttagcatcaccgccaacttctcttcccccagcccttggcaaccactcatctactctctgtctctctacatttgcctgttctggacatttcatataaatggagtcataccatatgttagtacttaattcctttttatgtctgaataacatcatactatatggttttaccatgtttctttgtccattcacaaattgatggatatttgggttattctggctattatgagtaatgcttctgtgaacatttccgtacaagtttttgcatggacatacgttttcatttgtcttgggcgtgtacctaggagtggaattgccgggtcaaatggtaactatgtttaaccgtttgaggagcagccagactcttttccaaagcacctgcaaccactttacatacctatccacaatgtgtgaaagttccagtacgggctgggcgcggtggctcacaccagtaatcccaacactttgggaggccgaggcgtgtagatcacgaggtcaggagattgaggctatcctggccaacatggtgaaactccatctctacttaaaatataaaaaatgagctgggtgcattggcacgcatatgttagctactcaggaggctgaggcaggagaatcgcttgaacctgggaggcggaggttgcagtgagccgagatcacaccactgcactccagcctggagacagagagagactccatctcaaaaaaaaaaaaaaaagttgcagtacctccacatcctggccaacacatgttaccatctgacattttggttccagccccatttcacacccactggtatgaaatgctatctcattgtggttttggtttgcgtgttgattccagcctcatttcacaccagtgtgatgtctcgttgtggttttgatttgcatttccctaacggctttgatgctggacatcttatccatgtgcttactcacatattttaatattattagttacaatgccttgcaagctaatgcttgccaccatggtatctttgagactgttactcagaagtattgactgacatgtgccatgtagtaacccctggagctggaaggagcttgaggccctgcctcggtgacatacagggtaggaggaaggaaaaaaacactttaaatatatgaaataaagtgttcggggagctacgatggaagtgtgtgcggggaccaatgggaacatcagggtggaagggtttgattctgctggagagaagggacttgatcggggcaaaagagtcagagaggaggtgatggttcatctgtaaacaatgatgtttcagtcattgaaccaagaaggaggataccaggatgaataaaccacggctcctgactgtacggatagtgagcaggggctgttttgagtcttgattcttgacagttaagatgtttgaggccacagttgaacacagcgttcctgacctggtgtctttctcctttactgaaaccctcccaaatggggaacgggctttctcctatcactcagaaggggtgggatatcacaaaacaccagaatgagagctgtgcccagtggttccagaaactgctttcttgctgttgcttttgttgtagttgtggtttactgttttgaatgcacatttatatatgtatgtgtgtgtgtgtgtgtgtgtgtgtgtgtatatatatatacacatatatgtatatacacatatatatacacatatatgtatatacacatatatatacacatatatgtatatacacatatatatacacatatatgtatatacacatatatatacacatatgtgtatatacacatatatatacatatatgtgtatatacatatatgtatatacacatatatgtatatatacgtatatattttaaaaccttctagacaaaatgtgacttgtttttgttgttttttttgtgacagagtctcgctctgtcgtccaggctggagtgcagtggcgtgatctcggcttactgcaacctccgcctcccgagttcaagtgattctcctgcctcagcctcccaagtagttgggattacaggtgtgcgccacacgcctggctaatttttgtgtttttagtagagatgaggttttgccatgttgcccagcctggtcctgaactcctgagctcaagcgatccgcccgcctcagcttcccaaagtgctgggattacagcgtgagccaccgcacccagccacattgtgacttgtaatctttgatttatgagagatgaagtgactatcctaggtctgttgcatacatgaaagaaattttttcttttggaaaagtttattttccaatgaaatgtttggattttcaggatttttcattattatgattcattctttttctgatatcttctatgacattttggaggaaaagatgagcttttgggaaacatgcaaacaaacaaaaccacctttggtactaaatctcacctagaatgaatacttctgcattttaaaaactctccaagatatggtttaaaagatgagagtagaagtgaccttcaccaaccttgctagcccaaatccttatttatgtttacgaaatttgcaactctgacatgatattttagaaagccatataaaatgattttgcccattggttatggtgtttaatggcttaaggaaaaatatatttgtatcttgaaacttctggacccattccaacaagactgctttttcccccctttaagatatatgaggaagcgtgttgagaaatcagagctattaaatattatcatacaatttccttgatttcattttcttgcagataaaattagaccaggaatatagggttttctggaatgctttcatgaaaaaataggtgattgcagaaatgccatgaaataattaaatctcaattatttgtactggtgttttcttaaatgtaatttaacctgtcacaatacacatttttgcttatcagatcacttttattaataggattgagaaaatgttcactcttacttcctcctgctatgaatattgctctcctgttcaccataaatattccctttccttttcttctttctgcagatccatttagcgggcaaaatcagaacactgcgctatgtgtggcagttaatgccacaggtctgggagacccagagcctggtttctgttctagagtcactactttttagctgtatgaccttgagcaagacctttaagttctcttagggctcaatttcctcttccgtaacatgtaaagtctgttatagcacatatatccaagcactactttgaagaataataagatagtgcagaaaaacacacacagccaggtatctggcacgtgggaaatgccactcacgtaatgtgtaatcaccgtatttgtggttatgtctccttagggtaggaaaggggagtgtttaaattcagatccctcagactatcgagaaacatgtttgttgtggagatgactcactttgaaaacatgaacttcctatataatttgtaagtcattttcattggggagcatagtagtgagttgtagataggaattgcctcagcttatagttattgacagctttgcaggtgccaaatacagctctagggactatataatcactcttcagtaaccataggggattggttctaggacccccccccaccaccctctgcccaccttacaataccaaaatctgcagatgcttaagtccctgaaataaaatggtgtatttgcatgtaacctatgcacatcctcccctatacttgaaatcatctctggattacttgtaatacccaatatgatgtcaacgttatgtaaatagttgttacactgtattggttagagaataatgacaagtttttttaaaaaaaaaaatcttcacttgttcagtacagacgcagccatccattgttttttctttgagtattttttttatttggagttgactgggcttgcagacatgaagggctgaatatacttgcattctctactttagccttaacagcgaccctttaaggcaggtgctcttagtatgcgcatttggagaaccatgttccaagtctgttatgtagatttggaaactgagacacagaaaagttagctaactttcccaagatcacagagttaataaaggcagataggtaactctatgggctgttttgcatactgctcactttatgttatgtgagtgagagtgaatatgaaatacaaggtgtttgtcattttaattcttggaaggaggagaagtaaggcaataagagttccaatatacttgtttctaacctaattttgtatgtaatatataatttatatattttaagtcatgcattcattattataaataaagcttctgcccacaaagtactaagttaataatctagccaattttttaatgtatgagcattatttatgtactgaaaataacttttacatcttcaaagtatctactaggaatcattgaagcaaagggtagctatcatttttaaggcaatgatggtatttcatgtctcagtaacagatcacatcttccatgctcttctataaattgttatttatgtgtttgaagtcatccagacaaatccatatcacccccatagctgggcattactgagttcatatactgtattatgattattaaataaactagttctgtacagattcacaactgtccttcaaggtgatatctctacatagccgtgctgttttacaaatcccatcattatgaaaatattaattttttttgtctcctaagtaaagtaagcagtaaacacttgtacttatcaaaaaggacttgttaacatttcacctcttaaaattaacattttaattataagcattggtagttttttgttttgacttgttatttaaagaataagcatgaaattttactgtacataaattatacttcaataaacctggcttttagaaggcaaaggaatgcataactattggaaaggttgagactggcgaagaagtatgcataaattcaaaacggaatttacaaggattttgtttgatgcggtggttagtcttttggaaataggtttaagattagtgcttttacatacataatatatgatttcagggtccatttagagaatatttatctgtatgactagaagagaatgttacaaattgaattttaagaataatgctctaattttacataacgccaagcatgatgtttctttgtttacctaccatattaaaagacatgccatcctggatatcattaatggccaaaaaacttaagacgaaagtggctcttcccccagcatgcagcagacagtctatgaaaaatcactgataggaaaggttagagactcaaaaatctatcactggtaatagattcctattgctaaccagagtccaaggtgagaagctggcattggtgcagtttctgcctgcaagatgccctctgtgggtctccgcagagcagcacgttgtttttctacagcttctctggattatcctgtttggttttgcatacatttattaccatgtcccttgcctcttttcctcctccctacctgcctgccttagctcatctcactgtttttttcagtaacgttattacagagaaagtggatttcagtattcctctctatcaggtgatgcgtcaggtgacagagaaaatcagaatcagactgaaatcagactgctgcctgttatcaattccatctctgtttccatatcctaaaaaaatcaagagcagcaggatgtttttataaacctgtaataccaagtttatgaaagttagctgaatcttagattgtcagcgctaaaaggaatcctgtgggacacttttcacacttggagcagccagcttgtcagagggtcctgggccaggttccaggccctgctgcccgctctgctacatggatcaggtttctgatgccttaccctgctcagagccaaactgtacaacccagcccgtgccttcctgctctcctgcctggatgggaagtcggtctgctgtgaaagtgggcacgactgctactggatgtgaacctgggatgaatatccctgggtagtagcagaagttgaagaattacccaggctttcaggctccaagtcacattctgggaaggcaggggctgttgttggcaatggaaatctggcctgagagtttcagagagccaggttcattaatgggcccacccaagccctggctgtgtgcttgtcctaataaagatgtacttacaacaaccaattccatatgcagatgtgagtgtgggtgtgtgaataacctttttaatttttttttttttttttgagataaagtctcaccctgttgcccacgctggagtgcagtggcacagtctcggcttactgcaacctccgcctcttgggttcatacgagtcttctgcctcagcctcccgagtagctgggactacaggtgcctgtcaccacgcccggttaattttttgtatttttagtagagatgggtttccaccatgttggccaggctgaaactttttaaagtcttcaatctgctttgaggaaacaaacaacctgaaaacataaccaattagttggtggactgtagtgttgtcaggtgattccatttgtgatcctagagcctgagtgtttattttatttcattttaagttccagggtacatgggcaggaagtgcaggtttgttacataggtaaacgtgtgccatggtggactgctgcacctgtcaacccatcacctgagtattaagcacaacatgcattagctagttttcctgacgtagagcctgactttaatggtggccatggtgggaacaatgatactacaagccttcttccctaataataatgctgtgggaggacccattgttcaattccattctttcagtcgcagcattgcctcagaacctgtttcatgtttatgacaggcccttggctaagggattcagtggtgcctgaagacagggagcttcataaatagatgtaagctcaaagcatggtgaatcaggctgtgctatgagagcttgtaacaggggacccaacagccagctgaacccctgaagaggggcaggagctaaccaggtgaaggaatgagaaggcaggtaccatccgggtgtgagcctggaaggcattcccagcagagaaaagcacacatgcgaaggccctgtggcagcagggggtaaggcccatttgagaaattgactatgcttggagtagtcaccagtggtcccagggaaggtcagaatgcaagcaggggctaccttattccaggcccagtggcccatgttcaggatttttatcctctagtagcaaatgtgaaagggcaggggtgtgatcagattgactttttgaaaagattgctttagactctgtgcatagaatgaggtggagaggccggttgctaggctatttcaggagccagatgagagacagtggaaactcagaccagggggatgatgaagaggttaacaaagttacttagggttgagaatttggcagcacctaagtgatgattagataagaggaggtgtgaaatatcaagggttgtttctcggggttatgctcccaccacaggcaaaataaatacaggatctaaaattaaaaatgcaattctaaatgaccagagtccagcatttatcctctttctctccctctccttccttctttctccttttccttccctctcttcccctgtcataatttttctgattttctggtttaaactcaggcagaaagattgggtacttctaaagaaactttggaaactttggcccataactttgtagatacccaatgctagatcggttcccattaatatgaaatggaattttgatatgaaacctttctaaaatatattgtctcatttatattaaaaagcatacaacttctgagcatttatttgaagctcgctggtgagataaaacatgagctggctgggttgtttctaggtgctaaaccaaatgtccgcttgaattgcggtgttgctgtaaatatttccaggcacagacagatagatgcaataggaaaaacctgaacaaattcttaggatgccaatattgtcacaaagtctccatgcagaatgaagttgtttgacaaagtgtttccctggtgatttggctgcagatgaaaatgtctttggcaataaaatttcatgcccgagtctcagctctgtgctctcatcagtcaacaaatgacatatcaaggatcccttttgctgtattagttaatatgttggcagaaatatgtgaaacattgttattcccctccagttctgtgcatagatttgtttctacctttaaacccgcattaattgtaccaaaatattttgccagctataatttaatactaatcaataggattgccttagaacagagataaaaggttctttattacaagggttctcttacttcaccagtattagaagatataatagtaagggctgctgttttgccatcgtttgaaaatggtttgagggaaatttaaggattggtaaggcaattagtagtgaagcatattttaattatagtaactggataagctgctttcagctttatggattaatacgttattgtttaataggccggagtcacgtgtgattttgatcacacttctcactgtagccacagttttattagcagtggtgttttataacttaataatttatacataatgagttcagaagttccatttacatgatatccaagaaataatttaccccatacattaccactcgtcaacaggaaagaagtccttcaggatcacaacgaaataactgtccgagattgttttgcattaaaggatacttttaataatgagatcattttacactgcattatgttatttctgttgatgccaagtctgggttttacaaagtcatttaaaacacaggaggaagatgaatcacaataatttcacacatatttaataagcatgaattatccactgaagtctacatccattctttaagttgtgaaaaccataaggtgtttgagttaatgctctgttgtagaattttctcgtctagcgcggccctcctccgtgcaccccaccattcccgccaggcctcctcgcatttcagaagctgttatatggacgagattgagctgtgtgtattttaatgacacgtgtgtcatggtttagcttagggtttgcaaagcctctgtatatgctagcctctgggcatccattaccatctccgagaacacagtctcatctcatccaaaacgaacctctcaaagagccccctgtgaggacaccttggggcccctgtccttgtgcggaagcaaagaaactaacactcggtgattgactactttacagcagatgccgtgctagtttatacttgtcattttcctaaggattttttttgaactcataaacccactggggtttcagttctgcaaagtcttttgaggccacgatgtgtgatattgcagaatcttttggcggggatgatctgcgtaagacacaaggatgttaaaaggtactacacacatgcgcgcgaaaaaaaggcattacgttcaaatgagcttggaaaccttggcgagactgttttctgatatgcagttgtacatcatgagtgtccagggagccgacccagcttgcagcatttcccaaacttaattgaccatagaaccctttttggaagagtagcttaacttcaagttctttgcctataaaatatataaatctaaatcaaaatatatgaaaaagtacatcgctacaatcttctggccaccactcaaattttatcagggcagaaaagacaaggtatgttcaggtgatttacaagctggaaagtaccataaaaatgcaacagatgatgatttttttctcctttggtctttttggaaacagtgtggaagaaatgatgtgcccatgctttaattgttcagagtctagggatgcgggtactgttctttgtgttcctttattcttcctatccaactctcctctctgctaggaaaatcactttttttttttttgaggatccatattactaattgcagaaaattgccgttagtcagcgcttggtcttgagttctcattttaagtggctttactagtcatgtttacgcggtcatctaaatgctcactcttataatgcctagaatggcttctcttcataatggggccctatgattatctgtgtgttccctctgttttccatgctctgcttttccagcatggcctaaggtttactaaaagaacaaaactaaaaaacagggagtcttgtgtcttacacagatcatccccgcctaaggattctccagtatcacacatcatggcctgaaaagacttcgcagaactgaaactccagtgggtttatgagttaaaaaaaaaaaaaaaatccttaggaaaatgacaagtataaactagcacggcgtccactcttaagggagtcaggatgggggagcaaagttcactgcagattccccgctgcacaggttggtagatggcaggcccctgcgtaaaccccattttggtccaacctcctgatccctcctgtctaactagtttacactcacagtggcatgttcatgaatgtttactgaattaacagataactgtggatatcataaaagtgctctttttatttcatgtgggggcaagattgaatttcttcatggtttgatttggtgcagttgaaactgcttatggtggcttggagagcagtggcctcagctagctaatttgttaataatgtggtttatctgtaatgctttggttgcaggaaataaaggaacatgttccactcaatacaagcatagccgtttttttattattcattcatttattcagccaatatttatagtgcctgtttcttacaaaagggaataaaatacagaatccctgtcctcatgcagtttggagtctagtggggagacaaacagtgaacagatggctgtgtattgtgcccaatggtgggtgataagaatgtgaggggtaggggatgtgagggaaggagattgcgcagttatagcggatcaaagaagacctcagagacctaaaggatgtgcagaaatttagagaaagaatgtttcagacagtgggactggcaagtgcacccaccctgccccccagggataagcagcttcacacaggagagagctaggagacagatcagataggaggtctcctgcaccatttgaaggagtttggcctttgttcacaaggagacccgaaagcctgggtgggttttaagcaaaagagtgacaagatcagagtaattttttcaaaatgatcactgctacaaggaggtaaaaagggaagcgcagaaaacaggaggcaactgcaatcatccaggcaagagctgaaagtggcttggcccagagtgccaaccacagacaggatgagaagtcgtaaaatgctaggtatttattcgaagcgggagagggacagagtttggcaaagaattggatgtaggttgggagagaaggagaggagtcagggctcactttatattttagctgagcgacttgaagaatgatgttggcattactaagatgggggaatattgagagtgaacagatttgaaggagggggcagtttggggatagttaaaggtgagctgcctccagatatctaagtggagatattcagtaggcaggtggctctaggcatctggaggcaggattgagatcttggctggagatagagatgtgttgttggttgataatgatgagtctggaagagatcacttagcaagtgagtataaaaagaagagaagtacttcatacaccaagcctggaggcaccagcagcaagagaagagactagcacaggaaactgaggaggagcagccagtcatgaagaaaaccgagagggcgcagtgtcctggaaaccaagggagttgagtatctccagaagataaacgttgttcgctttgcccactgctgttgatgactggagtaacattaagagggagaggttgcctttggagttgaggatgtggaggtcctagcaaggccaggagctggctttggtgacgaaatggggctagaagcttacccgtgatgggtacaacatggataagcccttgaagagtttattccaagtgaaggcaaataaattgcaattgctggaagaggatgtagggttaaggaatggtgtttttaagaaaggcagtagcacaatgtgtcttttgtaattgcagttggctaacagagtggggacaatgaggtaggagataggaccagttgctgggacagtatcattttgcagagaaaagggattgggatcttgaatgccagtggagggactggccttggccagagtcccagcgacaggggaaaaggcagaatgtatagtagcagcatggtaggctgctaagggtgtggggaccagacagaagttctctttggagtgtttcggttttctcagtgaaatacgaagcagggttatcagctagctgagagggaggatggaggagaaagtattatcatattagagttttgcagagagaggaaaggatatgaaatagttggttagcagagggatagagaatggactgaagaagaaaagtagaaagatgataattcaagaggtgataactcaagaaaattgaagtttctcttctcattgctgcatcaggagaatttggtttggatattggcaaaagcagccaatattccattgcacatgtataccacaatttgtgtatttcatttgcctatattgggcatgattgttatttccagtaggaggctgttacgaatacagctgctgtgaacattcatttatggacgtccgttttcttcccagaagcagaatggctgggtcatagaataggtatataataacttggtaagaaactgccaaacaattttctgaagtagttgttctgtaaaagtaaccaggcaaatgtttcagccctgaagatagaaaatgagctataataaatgaaaagtagaaatttacaagttagaaatttagatagaatttctatcactatagaaagtcagcttctgtcgtttctacttagccacagctaagtcttagcaaatcttaggaacatcaccgaacatccatggactcaatttccttaggtaattgaggtaactgggtgacctgtaaggtcccttccagaccccacattctttgatttttggtggaattgtgccaaatggtaatggatagaaagacacctctgtgtacatttttatcccatgggagttgagcagcatttaatatactggacacagtaagaaaaaatctagaacataagatgcagaggcaaaaggatgaggctgctacaaagtatatacttttgtgtgaaaatcacatattctttcaaaaaaccattgtaaggtgatacaggactctactcgtgtgtaaaaagttatatacctatgaatagctccaattctgttttaattataacaaataccgggagatgcatttggatggtttgaggaaaaaaaggttgcgcatccactgtttggaatcttgtggcttgttttgaagccagcgtaacaaaacatttgcctctattacttttgcagtactgctgggcaagtgttttgtctgcctgggctctctctagccaggagagaagaaatttctgtttcctcccaccagacagagtcggtagccccagggccatctttgcgctagctctggtctgtaaatgtatctaaataagccttgctataaatctttctctgttaatcttctagctgttcccaaacttcagcactgcctggtgaaggtgtacttcgccaaagactgaggagtcatggttcacttggtggaagctgtctgataaatagaggatgctggaaaagacagattgaacgtcagtgtgagatcgtgcactgccgtaatctgtctttcaggttaatgagaattaggaattgggaggggaaaaccagttggagatagctccgaaccaggtggtgatcagtggtggaggtagatgtccaatcggtctcggtcacccttcggggtccaggggttgtgagatcctgacccacccagggcaggacaaatgccctctgcttgtcactgcctttttggaagggactctgaggagtgtgagcattgaaaagtacacagaagcccatggaatcgtggagttaagacagtggaggtcacttaggccaaactcttgacctgggtggagtccttttcacggcctccctgagctggttgtcgtctggcccctgcttgaatacccccagtgacctgggactcaccacctcaacatagtcactgtataggactcaggcattccagaacattccttgaggactcagtctcaccacaccagtgctgaataacctttcttccatgataagaagaaagactaaagctagcttggggtaacagctctggatgtttttttttcctctccccaggtggggatgggtgttggacacaataagcattttatttctgttttttcttggaggcacaaattaacattttttcctacccaggggccatcataccctaagctgtgctgatttttaaattggtctatagagacaactcgtttcccatgttcggctgatgctctccatagctacccaaaagtccatttatttgtaactctaaagcaatgactcccagccacagcaatttcacacacacccccactcccgctggggacacttggcgctctctggagacactttggttcccacagctggtgtgggggtgctattgatatccagtgggtaacagccgggggtgctgataaagaccctacagttcacaggacagccccccaaaacaaagaatgatttgacccagaacatctcagtgccaaggctgagaaactctagtctaaaggtaccataaatagccaaccagtaggaccatctgcatttatatttgtcttcagggtttttttttaaattttgttgtttgagatgggatctcactcaggctggagtgcagtggcatgatcttggctcactgcaacctctgcctcccaggcttcagagatcctcccatctcagcctccctaggaggtaggacgtgtacagatgtgcaccaccacacccagctatttttttttgtattcttggtagagacgaggttttgccatgttgctcagtctggtctcaaacccctgagctcaagtgatatgcccatctcggcctctcaaagtgcttggattacaggtgtgagccaccacactcggcctgtctttagggttcttacagaagagtttgtgtagaagcaagcagtttgctgtagaaagaattcgtggaaaatcaggtgttgtggggcatggtggttgtgataggatgcaggggcactgcagtttgccagctttcaaccataactttcctcacagattggtggatatctttgaatcataattaggagcttttttttaaaaggtctctcgggttttgtaagacacgtccaacttattactaataaaccaaggaggtatctgttaccttcaattagaggagaagacagcacggagtcccaatcaaagagttttaaaaggccttgttttttcaatagcttattcatccagtttaagaaagcaatttctttgctgtagtttatggagaattctaaatctggtaaatcgtttattgcttcataggggtttgctttggttgatctcatgtatgtaccagggaagaccaaaaatattttttttgaaaaaacatgtgaggtcatgttttttctccttgactttagaagacaaagataatgatgcaagtgttgctatatggtggtgagatgatgacagacagaggcactgggtcattcccacacccgctttctggggtagggcccatgctgagagaggaggtggaagagcttgtcagtcaaggcagcagctaatttcactgagctccaggactctacggactcttccagaatcaatcacatttgccatgaacatcaggtccccttgtcccccatccccatgaccgagaccaatccaaacttgaaaatggatgaaatcaacatttctggggtgccccctctgtgctggccttatctgtggcttggtacaagatcctagaatgggaacaagaggtgtgcactccttagggacaaagaagttggggcaaggaaggagtcctgggcctaccatgtgctgtcacttggcaacataagaccagcagtataaacaaaggactgtgggattctgaattgtcccaccaggtaaaatcctctttttcttttctggcttgtaagcataatgattgagtgacacttttcacttttaaaatgaaaatggcaaaacttaaatgagggagtttttgttaagtcgtggtggcccagttggagtttaaagatgttctagggcacagtacagggatcctcctccaattgtgtgattattttttcccccatggtaaaagtcacgccgtgtttcccctccttgtgaggctcatggaaacacacagccgaggttctgatggtggccaccgctggacaagcgcactctctgagatgtggccatgtccctgccgtgctaacaggccccagtgccagtgcgccctgggcttatttgtggcttaaatcatctcagcaccctgaattcttccctctggagacacgctcggaaccgtccccccaattgatgacattgcagctgtcatgcaagagcttgccttcacatctctcctgtggaacgtgacagttttctctgtgatggccaaattaattattagaaatggtttgctagcagacagttggatgctgattacgattggaaccttagggaccctggaacccaaatgtgttgatgtttgttgttgctgagaaaaatgaaaaaccataaaataagaaagaaatgtttttaaactgaaaacaatgcagattaagccaggaaacttttggactgagttaactgagatctgagtgaaatctacccaaacccttgctcgcagtgagaaggtttagagaagtggttaattagttgctactttctgttagagaggggattgagcttggctatttctatgtaaagcaaaaagactggcattgattaaattggagatgacatttgggaggtgttctcagaatatctaagtttgattatctaatttgccttcatactgtgtcctgggtttgtgaagcctttctagcaagtaccacccaggaagaaatattttcaattaaatggatcatgaccactgcagaaggaatcatgaaacgcacctgtagcgtggggtcatggtgtgaacaaagctgccaggctcacaaagagacagtctgggagtcggctgtgctaatgccagctttgagcatcatttcactccttcccatcaacagttccattaatgagatacagagatgaaggcaggcagatacttcatggagctgtgtgacgcaagattgatgctgtcaccagctctcattggaacgaataagaaagaggccgacagacccttgatcattagaagggctgataatctattgtgagtttgtcaaaagaggaggaagaagatcaaatattagtggagaaagaacacagagtaaagaacacgatggaaacttcctaatcattttgtgtagttatgaaatgggtagctttatttagcaacacatatgatatgatacaggcaatattccaagcatgcattctagagtaatctttaataaataagtaaacaaaggccagggcggtggcttgcacctgttgtaatcccagcactttgagaggccgatgcaggaggatcacttgagcccaggagtttgagaccagcctgagcaacatggtgagaagccgcctttcaaaaaataaaaaaaaaaatttaaaaactttaaaaagtaaacaaagagcatccataaatacttttttggggattccgtgggattttttaatagtcatttttttctcaaagagagttaagtaatttataatttcttgttaaatgagggtggctgttataacagtataaaaaataagttttgtctaatgttgcagctcaatcgttattcatcatacaggactgtctggtggcagacacagaaatttccccttagtgtcacctgtggatgcagcaggtcagtgagttcccccacttcctttagagacacgtgaaccactctaaatactgtcatttctcagggaaaatttacacagaggtaatgacagatacataaattccattgttccagagcagaacaagtatggttgagggaggaatgatgttataagaaactgctttacagtccctgagattcttttccaattacatttagggttgaattttcagatactttttgttgcatccaaggaaggaattttaggggaattatatttattaaatctcatttttctttgcttcatccagcttttccttgatacttttaattcttaccatgcagtaattcagtgacctcaattctccctcccctgagccagaaaggaaagccctctgtgtttaaacagactcagagcctcctgcctgtcctagttctgcagaaaggaagctgcacctttacagagcccctcttggcacaggtagagattggcagttcggtcctgttcaaaaggttaaggagggtaggggccggttcagcagcataaacatctgatactcaagtagggtctcccaaacagcagcatcgatatcacctggtaacttgtcagaaatgcagagtctgaggccccaccccagacccaccgcatcagaatctgcatgtgcacagggtccccaggcaattcctatgcacactgaagtgtggagagctctgcaggtctagcaggctcccaggcagactccaagctgatagacacaggaacacagcctgagtttcactccatggcagcggtgttgatagtgctgtggccaagagtgatgcatttgaggaatatatgaggaatggaggacagtgaggagggatgaaaatgacctgaacacacaagcaaagctgtaaaagtgaaaaatctctcttcatggaccttgctgcttgtgtggttgagggagaatttttttcccaccgttggagaagaaattcattctacattgattgactggaaggtcaaacaatgaacgaaaagtaagaattaatttaaaaaaaggagagagagagggaggcaaaaacttaattataaaccaaggttctcatgttcggctaaactacagggcactttgccccatattttttccctgtaagttcacatttcttataaaacaactacaaagtaaaaaaatcgtatgtgtcatataaaacaattatttgtgtctcttgttgagaaaaaatatacagcatgcattaacaaatgcctttcctttctcatgtagttgtttattgagtttaaagtgtaaaatttcttgcagtttgtttattctaactaataagtgaacttgacacctcactttcacagaaagttaaatgatgtggtcagtgatgtttttaagatttatatcgaaagaaattaagtattaggtacacgacttaaattgattagaaggtaaatcgaatctactgagaagtgtgagcatataagtatgttagcacgtggtatgaataatgtgttctgatatggaggaagatgacatagtctttgattttataatgcgctgatattcttacagaaggtcaaagcaaatcaaagtgttgcaagaatgttcaaaactatccaccctaacttctaggatcatgttctccaaactgctaattaatgaaaagtcagcttcatatattgagatgtttaatcaattggcagattgttgtcaataaatatgtgtcgtaagtggtttgtaatagacaggctaatgaagtaccctctgtgagtgtcagagctatttggaaaaatctctctcccttctgggcggtttgccatacgttattagtctccctctaactcaaggaagagtgcccttcaacatcgctggtctcgcctctggatggaggagctggagaagcagaaagtaaatttcattttctactagcagttagtcaagcaacaggaggcggaaagaagggtggctactgataatattaatgatcatcagagaagccaacatttcttaggcagttgcttctatatgtgctggactccgcagtcagtaccataattcggttacttcttttttttttttttttttttgtattgagatggagtttcactcttgttgcccaggccggagggcaatggcgcaatcttggctcactgcaatctctgcctctcagattcaagcgattctcctgcctcagcctcctgagtagctgggattacaggcatgcaccaccatccatgcctggctgattttttgtatttagtagagacagggtttcaccattttggttaggctggtctcgaactcctaacctcaagtgatccacctgcctcggtctcccaaagtgctgggattacaggtgtgagccaccatgcctggccaataattgttacttcttaatcttcactctatgagaaagattctgcaacctctcagatccttcattacaaacatttttgtcatgccactacaatgctgaaatagatcttgtagctaacataacctactctacacgtaattgttttaaaagtcattataattccccaactataacataatgaagaaataaagggaatagaattgactgttgagtacattcaatatataagttacttgtttctggctataacggagggaagtaatagacatttgcatctgtgcatagaaatcctgcgaatctaacagctgtaactgcagactgatagcgaagtgatgttctagctactcacactagaactggtcgtcctgtcagtgaagtgatattataaattggtgaatacttcttagaaaagttccccaaattcagtctcacctcatttgcacaggaatatcagtatacattcttactggccagaaaatgctttgcattcacatataaaacagatttaggttctaggcacaaatatttgtaaacaggattttcgtttccacgactacccactgggacatcgagaaggtatgcagcctgggagaccactcccaatgctccaggcctggcttattcatgaaagacatctggcatccaaaccttcattcaataaatactagtagaatcccccatacatgagatcgatcatgaactgccctatagatttccaaaagtctacagtgaagcgttgccaccccatgagaccaggccactaggattttcatttctccttttcagatgtggcaactgaagcttcagtagtttccccaaagacaaagagctaggaggtagaggagttgggattcagactctgatctgtctgaccccagaatctctgcatttaacccactgttccatcctccccagtgcatccagacaggccaacattgccacagaagagcccgagtaggcttactggatcattttttagaattgtgcttatgaaaaggaaaaggattgatcaggcatggtggcgcattcccataatcccagcactttgggaggccaagagttcaagaccagcctgggcaacatagggagaatctgtgtctataaaacataaaaaaacaagttagccaggtgtggtggcatgcacctgtggccccagctcctcaggaggcctaggtgggaggatcacttgatcccaggagttcaagaccagcccagacaacatagggagaccctgtctctacaaaaaatttaaaataacaaattagctggacgtggtggcatgcacctttagtcccagctattcaggaggcgagatgggaggatcacttaagcctgggaggatgaggctgcactgagtcctgatcgcatcattggcactccagcctgggcaacggagtgagaccttgtctcaaaaaaaaaaaaagaaaaaaggaaaaggattggttgaaatgcactgagcgcccatcccatctcttgccagctgtaataccatgccccagtgttttgtgtatgttaccgaatgttcacaacagccctgcagtgtagttagttgtgagtaatcccttttcacaaacaggaagcctgagtctgagccctttccccagtcaaccagcctatgagaagaactggattgatttcaatcttgtgttgacttcaaagcccaacctcttgctcctactccttagaccagaatgggccctcaagaggatgggtgtgtataacctgttgatgccattcacccacctcgtcttgatttccgtccactttctttctcattacctgataagtaaggtgagcaaataatttattggccaggcaaagacatttttgagactgacaggggacacttccaccaggacattgatgtgggtcactcagtgatgcctgtttcagggccttgaagcaggtagcagccttaccaagtcatggttgatgcttctgtacagagttggaaacgtgtcgtgggtttcccgatcagaacgcactggggaccctgccgtcacaggaacaccgctttgcttctttcagtgaatgcatgattatcttgaggatggtgagatttttctgttgagatcttttctagtttaaaaagtccccactgttttcgtgaggcagggataggtgagcctccggccatcatgagagtgggtaggggcgggcctggtgaagacaaaccagaccccacgagacagaagctcttcccagttggtgactgggagagagtctgcttcccaagtccagtctggctcacttcctctcaggagcaggacaagagaaggcttccttcagcttacatgaaaagcttgcagtaaaagagtacaagtgacggattctgcctgaatttccccaagtttctgcacttgtctttgtttattatattaataaatactatgcagctaatgttcccatctggcagggcagagaaaagagcataaaaatgaagttgtggctacatcacttaaatactaatgaaggtgatacccacttggcatggtggaaaggtgggtctttattttagagttcttaattaagaactgcaaagtgactaatattaattaggaagccagctgtagccttcagtttcatggtatatttcttcttaggaacctgtgacgggagtcagtctgaactttttttaatcaatcagcccatgagcaattacctattaaatataccttgtgtgcatgggaccagactatgtggacagagatttgtaagattctgtctttgccttcagaatctccacctaatcaaagagtgtgcacagatagagagccagtatttcagagagagaggtcaaagcattttcacaacactatgagtgaataagagaagtgtcgcattatgggggtcagggagcttttcaaactacactggtgcccttcctgctctggggttgcagtagtgagctagtgtaagtgatgggagggtatcatacccctgggagtctggggcacaagggtggttacggaccacctggcaggctgaaagctggagttcagagggaggattgacagtcatgggcagaaatagttgggatggctagaactgggctctcaggaggagggatcatatttccaaaaggtgaggagtgatgggcagccacagaggtggaaggaaagaggttagggcagtgggaccagaaagggaagtaactggcattgagctgggatgtctactccagcccttcagctctcagtcggtctaccagccattacattattgatattgttgactctgttcacacttacagacacacacacacatgtgcaagcttggcctcctgcagggacctgataccctgagctagagggcggggaagtggtcaaagaggggactcaatacactatgtgtagttgacatgaccacccagcacgtcataaaattgtacctagaacaatacctagttatgggtaatccctttttacaaacagaagactgaatgtgagcccttagactgagaagcagaactgggtttcatactcattttgacttcagagcccaaggtctaagatctaaggagccaggagcaagagctcaaaaagaagcaccttaaaacctatgttttaatgtctcttgacactgatgtattaatatccactgaattctagtttcttgaatctcttgtaactggagaagggttttatgaagataagttgtaatgaggggccaacaaacatgaaaaaatactcgacagcactaatcattagagaaatgcaagttaaaaccacagtgagatactatctcacaccagtcagaatggctgttattaaaatgtcaaaaaacaacatgctggcgaggctgcagagaacacggaatggttatatactgctggtgggaatatgagttagttcaatcactgtgaaaagcagtttggagattactggaacttaaaacagaattaccattcaacccagcaatcccattggtgggtatatatctaaaagaaatcattctcccataaagacacatacactcgtgtgtttgttgcagcactattcacaatagcaaaggcatggaatcaacctgggtgcccatcggtgctggatttgatgaaaagaatgtgatgcatatataccactgaatactacacagccataaaagaatgagattacatcctttgcagcaacatatggagctggaggccattatcctaagcgaattaacacagaaacagaaaaccagattactgcatgttctcacctataagtgggagctaaacattggtcttcatggacaaaaaaatggcaaccatagaaactgagggctactagaggcaggtgggagagagggagcaaggtttgaaaaactattgaaaaactattctcagtacatggtcaatgggttcattagtaccccaaactcagcatcacacattttgtccaggtgacaaatctctacatggaccccctgaatctaaaatgaaagttgggggaaaaaaaaaagattagaatgtactttttcttgatttacacagtgtgttaattattacagtttttttcaagttgagttgtagtctcacatgcagctctctcctaatttcatacttagacattcagatcattgaattgtatctgcaaaattgcagttcttttaaattagcttgccagagcgctgtgggtcctgttcaggggccctgaggccaggcagtctgtgactctgcttgctccttgataaactttcatgagtagcatttattttaaatcatccaagaacacctcaagggcaaggatccttaaccttgatcctgggccgtggtgattcacaaaggcttatcctttgtagatttaggctcatctttcagggagctcagtttgatatgcttttctctcctcgaactctgccattcaacattttttttcccatatctattctcactgagtgctaattttagttcaggttgcacctgtgtgtatgtgtgtgtgtaaaccctctgtagccctagtttatagcctttttcaataaaatcacatatccagagaaattgtttttccacatgagcactttttcagagtgttttccagaactctgcctgctgttctaaagtcaacatcagttgccctctttagaacgcttccctaatgcaatggttctgaaatccctgaatatattgttacaagcacagttctcttcagaaaaagaaaccttggaaatggtggatctatgcttttgtttttcattttggagcttggagaagtttgttgacctcacgtcatcatcagcctccagttgaatctgttaaacagccaatgtgaatagtatctatataaaaacacaaagtaagcacagaaacactttttcaggggaggtattttgtcatattgaaacagcacctgtattggggttttaaaattttaatttttgtgggcatttagtaggtatgtatatttatggggtacatgagttgttttgatacaggcatgcagtacaaaataatcagagcatggagaatggagtatccattccctcaagcaaggcacctgtattgttataatgtttttcctttaataagttcagttctcaaatttatttctaaaaaactatagcagtattctaaatgaaaactaggtttaatttgctatcaataaaattacatacatagtcattgatatggtttggctgtgtccccacccaagtctcatcttgaattgtagctcccataatccccatgtgtcgtgggagggacccagtgggaggtaactgaatcatgggtggcaggtttttcccatgctgttcttgtgatagtgaataagtctcatgagatctgatggttttataaagaggggttccccagcacaagctttcttgcctgccgccatgtaagatgtgcctttgctcctactccaccttccaccgtgattgtgaggcttccccaatcatgtggaactgtgagttcattaaacctctttttcctgataaattacccagtgttgggtatgtctttcttagcagtgtgagaacagactaatacagtcattaaaattgacaacttgcatcagtgtacacatagaatcttctcatacaacacctttgggaaccactactggaaggaaatgttacatttcagggactgaggctgggtacgggaaacagagccagtgtccatagtgttaatattcgtaggggcctcagatttaattttacctgtaagtttttcttacaccagaaattttcagccttagcactcttgatgttttgggccaggatgtcctgtgcagggtggcatgttcagtggcatccctgatctccacctgctagatgccaataacacacccccacaggcgcccaaggtgtgacaattgacaaccaaaaatatccctagacattgccaaatatcccctggcagaggcagaattgcacaggttactactgtgcctgtgtcacaaataagtcacacataagtcattttgttgctttaattcttctgtgtgtccttggtcttaaactgttacttggttaagtacgcagattgaaaaaacactgcaagggaattttttagagtctctctgcacctattctggtttcaggactgcccagtttgcattgttgttcaaaatggaaagaagagagggaggaattttttacaaaataaaattcactaccatttttgagacttttttttttttttgagatggagtctcgctctgttgcccaggctggagtgcagtggcgcgatctcagctgactgcaagctccgcctcctgggttcacaccattctcctgcctcagcctcccaagtagctgggactacaggcacccatcaccacacccagctaattttttgtgtttttagtagagacggggtttcaccgtgttagccatgatggtcttgatctcctgacttcatgatccgcccgcctcggcctcccaaagtgctgggattacaggcatgagcgagacttttttttttttttttaacattttgtacatatgccagtaactcccctcccgcaaaaatggaagattgtcttgacctctcgtgagacctgctgaggccacatctggttcccccactgtagaggtgagttaggtctccccactgaatgtcagttcccaaagaaatctcatgtgtaaatgaaagagcagatcctccctcccctcctcactgttttttgcttatatgtagatgtgattcctttcaagaaaactccgtgagaaattacttcactatcatccactattgacatcaacagcagcctacattttttcaagatacttaaagtgcattttcgcttttaactttcacaacactttaatgttgctggttaatattattgatccctacttttttatgagaaaaactgaacctcagataggttaaataacctgctcaaagccacaccactgacattgctattctgataaagcagaatatttgaagcagtttcccccaaaacagagcaatgttcacgttaattatgaaacatagcatgaattcataggtagcctgtcaataattatgagtatgtggtatactgatgtcataatttttatataaatgtataaacctgttggcaccctgtgattgttactggtttgtttttttaagtaccttggatgaaaacttgaaagaaatatacgaaaatagaagcagaagttatgtttaagtgggatacttctgcagttttcttttgaactcccttgtgaatttctaaatgggttgcaatatatttttacttctttggaaaatgaaatttgtaagttaaaagtgaagggagatagatatagctaacataactgccaaagttgctttttctctgtaactctagctaagaaatgaccatattctgtccatgtgtccataagtctaggctcaggagtctttcagagtttatttgatgtaccattgagctgagggctctgtcctgccaccttttgttcaaggaaacacacgaggcacttccttagggaacccagtgaagatacctactgatgggaagcaggacagttgattcattccctctgtttctgttttaatgctacactggggtgagattaagtggtacctcccaagagaaagagcagggaacccgatgtgcctagattggttcactgtgaatcacagcagttgttcccgttgacatcacagaggggacattgatggtagatcatgtcaccatcagctctccctagtgaagactcctatctggaaccacgtggagaagactgtgaggtgaaaacatgctactctctgtcacatactgccaggtagatgcttgctgctggcagaaggcatagaatattttgtaaactacgtgagtattctatcaagtaatatttttctgaagcaggcttccatctgtcttgccattcatttttaatttcttagcacttcatagtagacgtgttttgagtattttggtcagaattgtaaacattgtcctctaagggaatcattctcaatgaggtgctaagtacctgatgttcagtcctcataactactctattaggtagcaggtggaatgcccattttatttataatttttttaaagttctgggatacacgtgcagaacacacaggtttgttacataggtatacatgtgccatggtgatttgccacacctatgaaccatcatctaggttttaagccccacatgcattaggtatttgtactaatgttctccctttccttgtcccctaccccaccacgggccccagtgtgtgagttcccctccctgtgtctttgtgttctcatcattcaactaccacttatgagtgatagcatgtggtgtctggttttctgtttctgtgttagtttgctgagaatgatggcttccagcttcatccatgtccctgcaaaggactttaactcattcttttttatgggtgtatatagtattccatggtgtgtatgtgccctattttctttatccagtctatcatcaaagggcatttgggttggttccaagtctttgctgttgtaaatagtgctgcagtaaatatacgtgtgcatgtgtctttatagtagaatgatttataatcctttgggtatatacccagtaatgggattgctgagtcaaatggtatttttggttctagatccttgaggaatcgccacactgacttccacaatggttaaactaatttacactcccaccaacagtgtagtagtgtgcctatttctccacagccttgccagcatctgttgttccctgacttttaaataattgccattgtaactggtctgagatggtatctcattgtggttttgatttgcattctctaatgaccagtggtgatgagcttttcttcatgtttgttggctgcataaatgtcttcttttgagaagtgtctgttcatatcctttgcccactttttggtagggttgttttcttcttgtaaatttacttaagttccttgtagattctagataatagacctttgtcagatgggtagattgcaaaaattttctcccatttgaaggttgcctgttcattctgatggtagtttcttttgctgtgcagaagctctttagtttaattagatcccatttgtctattttggcttttgttgccattgcttttggtgttttagtcatgaagtctttgcccatgcctatgtcctgaatggaattgcctaggttttcttctagggattttatggttttgggttttacatttaagtctgtaatccatcttgagttaacttttgtataaggtgtaaggaaggggtctggtttctgttttctgcatatggctagccagttttcacagcaccattaatgaaatagggaatcctttccccatggcttttgtcaggtttgtcgaaggtcagatggttgtaggtgtgcggtgttatttctgaggtctctgttctgttctattggtctatatatctgttttgataccagtaccatgctgttttggttactgtagccttgtagtatagtttgaagtcaggtagcatgatgcctccagctttgttctttttgcttaggattgtcttggctatatgggctcttttttggttccatgtgaaaggtaaagtagtttttttctaattctgtgaagaaaggcaatggtagcttgatgggaatagcattgaatctatagattactttgggcagtatggccattttcatgatattgattcttcccatccatgagcatggaatgttcttccatttctttgtgtcctctcttattttcttgagcagtggtttgtagttctccttgaagagttccttcacatcccttgtaaggtggattcctaggtattttattctctttgtagcaattgtgaatgggagctcactcatgatttcactctctgcttatctattattagtgtataggaatgcttgtgatttttgcacattgattttgtatcttgagactttgctgaagttgcttatcagcttaatgagttttggggatgagacaataaggttttctaaatatgcaatcacgtcatctgcaaacagagacaatttgacttcctctcttcctagttgaatactttccttctcttgcctgattgccctggccagagcttccaatactataggagtggtgagagagggcatctttgtcttgtgccatttttcaaagggaatacccgttcagtatgatattggctagagtttgtcataaacagatctttttgagatatgtgctattaatacctagtttattgagagtttttagcatgatgggatgttgaattttatcaaaggccttttctgcatctatggagataatcatgtggtgtttgtccttgattcagttaatgtgatggattacttttattgatttgcgtatgctgaaccagccttgcatcccaggggtgaagcctacttgaccttggtggatacgctttttgatgtgctgctggattcagtttgccagtattttattgaggattttcacctgttgatcttcatcaggaatattggcctgaaattttctttttttgttgtctctctgacagtttttggtattagcatgatgctggcctcataaaatgagttgaggaggagtccctctttttctattatttggaatcatttcagaaggaatgatattagctctttttgtctctggtagaatttggctgtgaatccatctggtcctggggttttttttttttttttttttttttggttggtaggctattaattactgcctcaatttcagaatttgttattggtctcttcagagatttggcttcttcctgctttagtcttgggagggggtgtgtgtccaggaatttatccgtttcttctagattttctagttttagtagaggtgtttatagtattctgatggtagtttgtatttctgtgggatcaggggtgatatcccctttttattttgtctatttgattcttctctttttctttgttagtctagctagtggtctattttgctaatcttctcaaaaaaccaactcctgggtttactggtttttttaaagggtttttcctgtctctgactccttcagttctggtctgatcttatttcttgtcttctgctagcttttgaatttgtatgctcttgcttctctagttcttttccttgtaacgttggggtgttgatttcagatctttccagcttactgatgtgggcatttagtgctataaatttccctctaaacactgctttagctacatcccagagattctgatatgtcgtctctttgttctcattggtttcagagaacttacttttttctgccttaatttcgttatttacccaggagtctttctggagcaggttcagtttccatgtagttgtgcagttttgagtgtttcttaatcccaagttctaatttgattgcactgtggtctgacagactgttacgatttcattcttttgcacatgctgaggagcgttttagttcaaattgtgtggttgattttagaataagtgccctgtggcattgagaagaatgtatattctgttgatttggagtgaagagttctgtagatgtctattaggtgcacttaatccagagctgagttcaagtcctgaatatccttcttaattttcggtcttgttgatctgtctagtatggacagtggggtgttaaagtctcccactactattgtgtgggagtctaagtctctttgtaggtctctcagaacttgttttatgtatctctgtgctcctgtattgggtgcatttatatttaggatagtttgctcttcttgttgcattgatccctttaccattatgtaatgcccttctttgtcttttttgatgttttttagtttaaagtctgttttgtcagtgactagaattgcaacccctgcttttttttttctctccatttgcttagtaaatattcttccattcctttattttgagcctttgtttgtctttgcacgtgagatgggtctcctgaatacagcacaccaatgggtcttgactttttatccactttgccagtctgtgtcttttaactggggcatttagcctatttacacttaaggttaatattgttatgtgtgaatttgatcccatcgtgatgctagctggttattttgcacattagttgatgcagtttcttcatagtgtccttggtctttatattttgttatatttttgcagtggctgttacaaatttttcctttccatatttagtgcttcctcaggagctcttgtaaggcagggaatgcccattttagatatgagtaaatgaggctcagacctgttcacgattcttgcctcggtggctctgcatggtgatctattccttagtgagtcctcttgaatttggggtaagtctatttattgtctgtcatctaaggcagcttgctttttgtcttctggtgcatatcaaaaagtggctgtttcctcttttaaaagcttatttttaatttttgtgggtacacagtaggtgtatgtatttatggggaatatgagatactgtggctcaggcatgcaatgtgtaataatcacatcttggtatattgggtatctatccttttgagcatttgtctttgttacaaacaatccattgatactcttatttttaagtgtaaattattgattacaattctcttgtggtggggggactatagtgcctcatttaattattgttcattctatttttttttttaaccattaaccattgctacttttcctcccagccccctactaccccttccagcctccggtcaccatccttctcctctctatctccatgagttcaattgctttgatttttagatcccacaagttagtaagaacatggactacctggttcttgatttaacatctacaacattttcagattatttttgcttgtttacagtttttatatgttatacctaatttgaaatttagatattggtgaattaactgctaagcatgattatttccattaagtacgggggagctttgcttacctactttgtacttcttgttcctaaatgttagggttatatagctcatctcagcactaacattattccttacccatgttttgaacttttatttttctggcgttaatgctattgcccacaatccctgcgagtacccctgaatccgacccagtagttttgccttgtaacctccaattcccaaggaatatagcctggcaatagattgtttcatgtatttttacacacatgtgatcttcatatccatcagtagttagtcttctgcactcaccagaagcaagatgtcatgtctggggaaaggtttgttttttttgttttttttttttttaaagagctgtagacattttaataaaagtttcttctcagcttttctctgatgcatatcaggaggaaagtatagtaacagagaatatagcattactgcaacatgcctgtctgaatacatttcagttcattgagctagatttccctgaaaagggaacattcccagccaagtctgccctaaaatcacaaccaaggtggcaagcccagattcttgatgtctgccagtgtcatttttgtaatattttattctccagcacagtggcaaccaggatcagagctaatagtctaatcaaaacgaaagatgcccaggctcagatggggatgggatgaagccctacaccaagttagagtggtgaagtccactagtgtttctgaacaaggtgccgactcttggcatgaacccacacagtctctgaaccattgtgctggtcatgaccactgaggcgtggcaggaaggtggtctctgtggagactcacagcctgcttacaagcaattccaggagcaggaagcacagagacatatggaaattccactctcatgcttaatatacaacgtgcaaaatgaatttttcatattggcttttttaaaaaatggaagagttccagctttgcctcactggtgtgccttttggagttagtgtcctttaaagcagccagagggggaataactgtaatgtaagcagagtggtgtttgcaagtgagagctgggggagaggcgatgatgattttggaaacattattctgggtgttgaattgaacaaagagttattactgaaggaaaaaatacccagaaatgcattgttaatgctctctcagatttgggcctggagaaccatactgtgaactgagtggaagataaatagagaggaaaatagcaaattaaggggacaaataaccagggggaagaggaggggggaaggttgcctgctggcatcaggagaggagaatatataaccagtgtctgatgcatttccttaagaatcagtgtgtttgcaaattgctccattgcatcttagcagaatctaatctgggtaacgaagagctgactagcgaacatagttggatgaattccccaagtactcctgaaatataacagagcaaggaacagtataatgaaaaataacagagagagtagctggaggcttaacttatgatcagtgttcattacaacaaatgacattttcactgcagagttaccgtaagattattgactcttacgtaatatggttcccatctgaacagattcgagaacagcttagcctgtgaatgggagagctgcagaggactgaagatatactcagtccccttattcatgttttcagttagtccttgggagctgcctgttcaggaccatggacagagcaaaaagagtttgcaccttcctccaggcagaatcttggtgattgtctttggcaatgactggcatggtcatgtgtaatattcagtgaaaaccaggctcagaaagtgactaaacttgttggtagtttcatatccaaggcctcctccttatgttctctgccatttgctattttcctcaagcatacatattgcaacatttaaaaaatatatatctctttggaaagaaacagtgttttgtctaaaacgttgggcacacaaccataaggcatattgcaactctatggcttcaaccacatttgaatggacaaccccagttctgagcgtagtgtggcattgccttggtttattgagcacctgtttgatacctgctgagcactctgtatttctgttattttgtcctcccaacaaccctattgagttatgtgctattattatcagtcctgttttatggaggataaagcacttttatcagagaggttaggtaacttgtctaagggtacccagctgccaagaatcacgaatgaatttcaaagtcatttctaccagtctgctgtacattataactttcacacaggtgctgaacataaagagagattcattcatattcattctctctcactctctctcgctctctggaaaagcagcctggatagtaagtctatccagaagccttgctttcacccagtattcatgagtcataccagcgttgcttgctgtgtattttaaaagttaactctatacaggtgtctcccatgagaaagggtttactgtcactattagctggaggtgcagatgtcagcccccagtacatgggagttagaagcagagcaagagaacacaaagaggccagtgggtgaggggctgtcttgttgcagggaaagaagcaaagtggtatttggaaacaaatcaacagttgtcaaaagaataatgaagacatctatgggaactcagtagtagcgtcttcggatctcaccttttctttagttttcagttgtgtatttctaaattttatgggaaaaaaattcctcaacaaagaatggggaagttaaaaaatacagttagccctattataaccaggggatttctaagcagtttattgccttgtttataaaagcctgattgggacgtccctcctcctggccactgcagcctattctggagacttccctgcagcccgtcttccctggcaatgggcccagaggctagacgtagtgtggccactcgagaaggatcacagctgagtgaggaagtctggtccaccctggaaacggcaaactcatgaatgcacccaagctgtagtcactgctgcttgagcccccagggagggcctcatggataatgcactctagccagccgggcgctggggacctttggctcttaaagctgcttttatgtttttgtgctttgggggaagagaaggactgaacatattttctccaaccaagtagcatttacgggcttcaggagttattcattttggcttaaaaacctttccaatatcacaactattacaaataaggacattgggaaaatctctaggtaaacgggactctagataacagatttcctgtgtgtatccttccttactcgaaaccagcagtttccagcctttttggcaccaggcaccagttttgtagaagacagtttttccatggaccagcagggttgcggggagatggttttgggatgtgtcaagcactttacattatagtgtgccttatttctattattattacattgtaatgtataatgaaataaatatacagtacaccataatacacaatcagtgggagccctgagcttattttcctgcaactagacagtcccatctgggggtgatgggaaatagtgacggatcatcaggcattagattctcataaggagcgtgcaacctagatctctcgcatgtgcaatggggagcagctgtaaataaaaatgaagctttgcttcctcgcctgccactcaccacctactatgcagcccagcttctaacaggctgcggttaggtacctgtccacggcccaagggttggccacccgttttctaaagtattaaaagtaaccaagtgccaggatgacaggaaaggggccgtcagcctttaaaatgtctttcatctaagtacaagaaggtggctcaactccaccatattcagcttgtctatatctgctgtgcagtagcatagccaccaactataggtggctcctgagctgttgaactgtagcttgtctgacggacagtgtgctctaactctaaaatactcaccagagttcaaagacatagtactcaaaaaatcattaaatttatgtaataaatttactaaattattcatcatcaaattacagataacatagatcatgaatcatttttaaattgatgacatgttgaaatgatattttggctatattgggttaaataaaatatgatattaaaattaattccatccagtcttttttacttttataatgcagctatgagaaaatttaaagctacattcatggctcaaattatattttggacagcgctattctgcagagatatgtggaatatggaatgtgtctctgcaaattggacgtactaatgtgtgtttaagaagattttagaaacagcttatgagaagagaacttaactcactcgaggtattcagtgagcaaatactaaataaaagagggcttgttttacctttttggggagatatgttggatggaaatcttcttggatgatcgtttttcagggaagaatacttttccatgagaatattgttggggtagtaggagacgattgttacagaacatggttggttgacatttgaaaataaccatggtgcacactttcctttggaatgttccatccagtgtcgtcgtacggggcccgggaggtgcttggctttgcagacacctgctcctctgccatctccaccccacgcttttacttccacctcgctttcaccagctgtatttagcatgctctagcaccttccaggggtgttttgtgggtgagattcttagatgaaacactttggattcttggatgctaggggctgttatgacaagcttcggctcttccctccccacccacagccacagttttgcttgcagcctacggggcctgttgggggcatgaagcagctaaggctctcccctagccagaggcagctcctaggtgaggcagtgccagggtcccactcaattccttgctgatgcatggaatcttctcatagatcatagacatctttatttttaagctttttgcacttgcagaccatacatttttctgagattcttaaaaatctgattttaggctgggcaccgtggctcacacctgtaatcccagaaggtctgaggaggaggaggtctcaggccaaggcaggaggatcatttgaggccaggagttctatattagcctgggcaatatagcaaggccctatctctacaaaatatttaaaaatcagccagacatgatgatgcacacctgtagtcccagcactttgggaggctgagacaggaggatctattgagtccaggagtttgaggctgcagtgagctatgatggcaccgcagccagggcaacagatcaagaccctgtccctaaactaggaggaaatggatgaaaattattaagtctgctgaatctacccagggctacaagtatttttttaaactttaaactcttcattctttttcaggattttttttttccaaaaaactcaaaaatgtgaaagtgaaaaaagaggagatggagttcaaagtctcatctcctgttgagctctcggagatgccgtctccattatcccattgccaggtgttcacttgctcctaaataccactttgctctttctgcacaccagcagaaatgagatgctgtgtttgtggatagtatttgccacttcaaagagaacacggcttacatggggaagtttgtctttgccagggaagtgggaaaaggtaccagatgcagcttctccgagctgcttctgcctaaagctcacctggtgagagccgcatggataatgcacatgtaggtagtaggtagctgggtattttctggcgttgattcctaaggatttttaaaatatcattactctacttgtttttgtttttaaacagacatggggtattgctatgtttcccaggctaatcttgaactcctaggctcaaaggatcctcctgcctcaggctccgaaagtgctgagattataggcatgggccaccacacctggtctgctccataagtggaacgtcattcaccttccagaaaatccatgggcgatggaggaggggaaaataatacagtgctgtctaaaatctcatgatactggccgggtgtggtggctcacgcctgtaatcccggcactttgggaggccaaggcgggtggatggcttgagtccaagagttcaagactagcgtgggaaacaaggcaaaactccatctctacaagaaatgcaaaaatgagccgggtgtggtggtatgtgcctgtaatcccagctacttgggaggcagaggttgcagtgagctgataatgttccaatgcactccagctgggtgacagagcaagactctgtctcaaaaaaactcacgataattatagattatcatgccataatctaaccagagcacagaaggaatcttagaggtacaagccctgtagagtttcacgtaacatgatttggttaaggggtaaatatgttaatattaaagtgatttgctctacagggttcctgggcaaagcatgttaagttccattcagatgcccaaccctgaccaggctgaatcctttgcctggagtgctttatctttgtgaggtctggcacattccaacagagcacctgctcagtgtgtgatatctgccgtggatatgagatggggagtagcagtgctcaggccagatagttaccacccctgtttagatccacacacctcctttttctgtttggggaaatgcaaatcaccctgctagtggattaatcccaaagccttctgaattccaattcaccattctctgccctgcactctgacacctataggcctgaacttagattaaacgtgatgtccagctttccactgacatggtgtattagtccattctcacactgctataaagacatacctgagactgcgtaatttatatagaagaggtttaactggctcatggttctgcaggaggtacaggaagcatggcggcttatgcttctggggaggtctcaggaaacttagaatcatggtggaaggcaaaggaggcaggcacacatggcagagccagaacgaaagagcacaagggcgtcaatgctgcatgcttttcaacaaccagatctcgcgagaactcactcactatcacgagaacagcaccaaggggatagtgctgaaccattcatgagaaaccgcccccatgatccaaccacctccaacactgaggactacaattctacatgagatttggtgggaacacagatccaaactatagcacacggccatgtgtcacctgctgtggtgaaatcatcaggtcacctgggcagagagaaactgagagggagggacagtgccaagagcagatggccaacagccacaaatagggagaggaggaggaatatcagtggtgatactaataccactatgtatggtatgcttctaccgtttgtccttatcgtaaaacaagagaaagcaaaggcttctctctagatactggcattccttttcatgggacaccagatctgtgtaatgtcactacctctagagccacaggacaatgtgtgctccacatggtttccttcacgtgatattgcttaaggcttcaatgacttagtatatacaacgtggcagagaagcttcctgtgtgcacactacaggaatcctgccctggtgatgaccagcctaatgactcagaggtcatgaacgaccctcatctgcccatgtaggagcctcgtgaggccagaaagactctaacccttccatgataataaaaattcattctgattttttttccaacaaagggaagaaaacactacttttatgttaattttagctgggcctggtgagttgtacctgtaatcccagctactcaggagtctgagatcacttgaggtcagaagtttgacactaacctgggcaatatagcaagatcccatctataaaaatagtttaaaatatatatataatgttaattttaaccaaattctcttataaattactatcttcaactagttcttatcaacattaaaaatcattaacattctataaaagtcctttgtatcttaaaggaatttagtagaatcaccctggtcacggtactgtacaaaagtgtccgcaagaggacaatggcctggctcccagaaggcctcacgaagtggcgctgcagcacctttactgagtgcctggtcttccctttagccttagaagccctgcaagctggcaaggtgtgcctgtaatcccagcaccttgggaggctgaggcaggaggatcacttgaagccaggtgtttatgaaaaaaaattaggcatggtggcatgtgcttgtgccagctactcaggaggctgaggcaggaggatcacttgagctcaagaggtggaggctacggtgagccatgatcgcaccactgcactccagcctgggcaacagagtgagaccctgtctcaaaaaggcaagaaaaatgaaaccctgcagccaactgaggaaaaaacataagaagttgttggaggaaccggagttccaccacagaggataactgcccccaaagacgggaacacttgcctcggtctgcacagcacagatcccttcagtagacagctccaggtgggaagctgatggtagtcacctgatgagcgtggaattgaggacatcaggaagtgatgcttggctcagatgttcagtcactccatatttttggggtgacagttgtgtatgaggcaccaggcactggagaaacaaaagtgatgttggcctagtccctgtctcagaggcactaatgatccagttgggatccatgtatttggatatttgtaatacttcctagtaagtacagctatacacactttcattaagtcaatcaacaaacatttctagtgtgtcccagggacactgaacaagacagataaggttctggtgctctaggaatgaaccttctatcaggggaggcaggaaacagacatcaaataaataactagatggtgacgagtggtatgatggaaatgaacgtagtcaaagatagaaagtgtgggcaaagatggcctggctcgggaactcacatttgcagtagaccagagtggtgacgtattcatcaagaccagcattgctttgattacaaggaacacaaggcctaagagggagggggattattttgatgattttacactaaacatcatccagcaatacagctgacttcaggcattgggacccacacaatgtccttaggcccagtctctctccgtccctcactcctgctttgtctgctggcttctcccccaagcaggctctctcgccacagtgctaggacaaggtaccagcagatctgggctcatccttcctacttcaagtaaaacagaaaagaaaggacttttcttcccacgcggtttgagctcccatgtgaggcctgtttttctcgctggctcttgttggccccgtgcttgtgtgtaaaccagttacggcacccagggtgacaggacaccctgatggacctaagactgagtcatgttgacactaacatcagggaagcacagccagaccccggagtctgaacacctgcagtcacatcacggtatttaaactctgggccttgtttccccacctgtcaaatgggaatgggggtagcgcctgtctcagggggaccttgagatgagcattccaggcagagtgaatagtgatgggaaacagaagcccctaaggagttgggatcaggggcatggagggtcgcggcagaaggtataggaggggagctggccagaagctggaccgtgcaggtgtggatcgcgtgtgccgggtgggcggtgctgtgttgttttctgtgattcctcctaggcacacagtcccgccagggcatccacagaactcacagccgctggtccctactgcctgcattttctcccccgttttcagtgctgactctgatgggcaggttctctctccagctttgctgatatccctggtctgcttatagtcgaggcgcactggtctgggagttaaggctggtgttattttgggtgacttttcatgtttctgcttcgatctattctgtgttgatttttattacttaacacccaggggaaaaccttatttccccatacgttcaagttttggggtggtgcctcactcttgccccgaccagagtcatccccagctagttctgtgttggcagggcataaaatctgaagcaggtcatgttaatatatgggccaaagtgatcattggtgactgtatcatatcatcctccagctagaggacattttaagaggtccattagatgattactatttaggttctgagagctagattcaagttagtgcattttcatagtagtggttttgaagagtaatttttaaatgggtaaattgcccatacaaaaataattcctaacttacttccttatatttatgaataggtttgtgtatcgttgtattacaagcacatacatatacagttggatgtctctttttagtctctgcagatgccaagtactaaaatgattctttcttttcataaataaaagaaatccactccaggtatgaagtctatcagggaagtaacttaccattgcccttggactgatttccttttgcctttgagtttattctggaaattgcaacatttagcactttgcagtttaatttaaaaggattacctattttcttaaatgcttaagcagggaagcaaggtgcagttattgatttttctctgcctgtattctgtgaaagctccttccccagggaacatacctcctgaactgcatgcctgctggtgacagcttggacctctgatacataaccaaagaccttacctaatatccttgcatctgctccgggaatttttattaagtaaaagcatcattagagtagacaggatgatgaagtttaatgagcatcttttttgcatgatattgttagttttgctctgccagaatcctcatttctcccctccagtggggcagatcgtgagtctagaatatatggctgttttgaaatctgccttatatattatagcctatttttcatatagcttgctatctgtcttaagccaactacacatttcgttgtggctgtttatatagatgccatttgtgcatgtatgtttatactttctttctccactatgttgggaacagaaagcaggttataatggagaagaatgtgacagacacacgctgccattcgtaaattgcatggaaccatctcttggaggtttgatctcaaaaagaaaaaaaaacatttccttttgaattaatgagacttctcacaggaattagggtaactgttaattttttttctttaggactcagcaatttacatgctcaggttctgtcaccagcccctgatagccgccggctaggagaaataaagctattacaagtgcttattaataatctcggcttcacactttgtccacagatctatttgcagagattttaaatttagcatcctaccggaagattacagattagaagcaaaattatttttctccattattttcactggccatatcctgagattttaaaattggttcttttcttggtctgtatgaggacttgccatggaaacacccaaaacaacagtagggatacatatgacacgagcaaacgacttcagaacagcatattgcacctctcatatacctggcattctgaaagacaatatttacatagcacacaatgtgtttctagcagtgcctggagtgtatagactacaaaagaagttaagcctgcactccctgccctgcagaaaatggtagacttcttaagaaaacaaaaccaagatgggagatgaggtaacttagtgctttcagagtttgaactttggagtcattgcctgggtttatcggagcctcaagctgctaagcctcaatttcctcatctgacaaataatgatcataataggagcttcctcgctgggttgttgcgacagtgaataatgaatgcacgttagctgcattggaaatgttgtgctgtgatcacggcactctgctgatgttttgaggtaacatgccaaggtcaggagtcactttatgtatcatcaaggacttagtgatgagatcctgatacatcccgtagggctttgtgatggcagaatggagaaggggaggaggaagctgtgaaagtcttcaaggcctcaaaatatggacagaggagatctcagttgcagaggggacctaagcaggcattcctggcagtaataacacagataagcaacaacaacaaaaacaagccaaaaggaatgttggctgtcaggaaaggcttatctcaggcctcagattgagtgagccattttttcatttttcaatgggtgagcccaaggcaacctgattaccagttcacctgccagggagataatgagcgaatactccccttttccagttccgatggcagaggttctggaaagatataggactctgaggctactcagctaataggtggcagaactcacactcactccatctttcctgcactctgccctgcctgcctcaagcccagccttaccttgcacacgcctgttagtgcagaaagagaggacattaggcgagccagattccccagccacatgcgctgtggctgctccatgccaggtgccaggctaggtaccccatccaggggccagaggttgctgtttttcatccatgcaccaggaagagttcagacatcctgtgtaggacacactgggaagggaagtcacctgcatcgggaaaaccaagaagggaaccattataatatttgaatggccatgtgacatgggcctgattaaagaagaaaaaaggagtggatgatggaaataaatgaggtaccataaaacagctaattaatgagttatgggccctttgaggagctgatgaaaactgtggtccctttctgccgaaatatacatatacaactttacttagagtttcagacacttctagggtcctaggctaagaacttctactgtagaggaaactaaattcctatcagacctgattaatatggtgaccaaaaacaaaaagaggagaatgtcaaaataacttagcatttgctcctgaagttctggagacatggagggacagacctgtggaaggtggggtgagggactcttccctgccttttggggattcatagccaaagtgtcccagtgggctgatgaggacttggagagcagctgctcggagacaatcattaaagttataaaattagatggaaagaagacacaaagacagacaggaccaaagaggtgtccagagagaaaacaagaaccaggatgacatcctagagccaagcgaggacatttttaagaatgaatggctccgcggggtggggtcttccttgctgctgcagcaaagggatatgagacccttggatctgacataagactcaatttttccaaaaataaagatgcccatattaaataaaatccacctatcagccaggcgctgtgggttacacctgtgatcccagcactttgggagtgtgaggtgagaggattgcttgaaccccagagtttgaaaccagcctagcaacatagtgagaccccatctctacaataagattttaaaataagctgggcatggtgatctgcacctgtagccccagctacttgggaggctgaggcaggaggatcgcttgagcacagcggtcaatgctgcagtgagctgtgatcatgccactgcattcctgggtgacagagcaagaccctgtctcaaaaaccacccccccctaaaaaaaaaaaaacacgtgtcagtaatagaaaatcatgcataatatatctgcttaatcaaaaaaaaagttgcaaaatttattctgagtacagtggactggaattttttgctgtgcaatcttagctgtccaggcggtagtggtcagttgcacggagcttgaagcggcctgtctgcaggctgttttaacagcacgtcaccgaagtcaccagcctgccaacccaggcagtctccaggatcatttccccatgatccttctagaagtgggcttcagcaggggttcctggggtggcagctcagggcagcgcccactcccacgttggcatttgggcttcacagtgagatcaagagcccttgtgagcctagcagactggttcactcatctcccaccactgagagcgtcgcaggcatctcatctttgaaaccatcttcagtgacagaagcctgttcatcagactctcaagagcaactgatcctcttgtgtcacttcagagtgcggtttctcgtttttttcccacttcttaatcatctcccaattctcctctccaaatcccggctatcaggggagagatgctctagggttccatgtcaaagggtttcctccagttcctgggctaagcattttacccaccagccactgcagccccatgggtgaccttgggccaggctccctttatcactctccagctgtcatagccgagtggcagtgcccgccgaagctttcccagaaagatctacaccaaaggcacaggctggcagtgcagattccgggcagcacgagggcatggcagcagcctgcaagaggtggaaggagttggccctggtagcctgcgtcagagaagcttcctaagaggttagaagcggcagctgtcattctgaaatgcctactgtgtgcccaagggacaagagcgtttccctaatttaatcttctcccaagctctccatggtagctgggaatcttcatcttcctcttgcatatggagacatcagactgtgggaggtgagggaggttccccagggcacacatcgttcagggctgagtagggtgtcgaaggcagaggtggctgtgagtcccagagactgttctccaggaatccctggtgcaggatgtggtgggctcctgtagggccagacaggtaccacatgagcagagagctgcagtggccctgagggcacatgctgtctaggaggggacagtggtgcccgggtttgagggatggttggcgtttcccaggtgaaggagatggagaagctttgttcaccaaggccctgggggaaaagtacaagttacaagaggtcaggacaaaagttttttgccaatcctggcacttccccgcatggccctgcatggtatgccacactctttcctctcaggaactgcaaggaataggttgtctttcaatggcactgactgttctgtcctctgtagtcagtcactgctataaattcaatccaggtacatgcaaaacacaagccacgagtgttagcttcagaggatggtgggacagggaccagccagttcgtagtagcaaggggacagtttgcaaagctgtttgcacttcctctcgtagaaacaacacccatttttcctttgggacacaccttgcctctctgcgtcttggttctttcatttttccatctttttaatttatcccagaaactcattttccctattgaaattaagcagaatcctcacggacaggccaccctgtcaggcccagagaggctcacctactatgttagttctctattgctctaacacattaccaagaacttagtagttgaaaacaaaacgaatgtattacctgacagttctggaggtcagaagtctgaaaccagtgttgctaggttgcctcttgcaggagattctagggaagagcatttccttgcttttctggcttacacagaccacctgtgttccttggttcatagcccctttccccatcttcagagactgcagtgtaacatcttcaaatctctttcactttgaccccctgcctgtttttatttttgattgattgttaaggtcttgccctatggccaggctggaatgcagtggtgtgatcacggctcactgcagcctcaaactcccaggctcaagcgatcctcccaatgcagcctcccaagtaagtagctgggactacaggtgtgctccaccacacctggctaatttttttttttttactttactttttgtagagatagggtctccctgtatggcccaggctggtcgtgaacgcctggcctcaagcaatcctcccgccttggcctcctgaagtgctgggattacagatgtgtacccctgcagctggtccctcctgctgctttcttataaggacccttttgatgacactgagcccacgggatcatccaggattctcttcccagctcaaggttcttaactaagtcatgcctgcagagtccccactgccatggaaaataacagtcacaggtttcagggatcagatgtggccatctttgggagctgtgattctgtctaccacacttacttgcccagttgaggccccgtggctcgtaactggcagagccaggaatggaacaccagactttggagcttgttgtgactgcaccgccactgccatagccacatccctgtgaaaacggccacttatggccgcttagtaaaacgccagctctcatctgcccacacagctggaggagttaaaggatcgtgcggcggacagcagcgtcatccagccctgccgatgactcactgaggaagtgggccatgcatttagctctgtcttagttgctttcttcaaaaaggattaaaacctttgttccagaggtgtttggggatttagtgttgatagaaaataccctgttattttgcaggggaaacagccctaaagaaggaaggtaatcatataattatcttgatttaatcactcttgactgtaactccatgtctgtcctacttttcaataagcattcgctgactgcttccagtaggtttgccatggtgctgggcttaccgaaacaccctgcaaggaagacaaacgacatctctagcttacagataaagaaactgaggcacggagagggaggcaaacattgctgatcatttgcccagagtcatcagctaataaacgtcaaaagcaggatttgagcagcaagttcagggccactggctcccacctggccctttgtagtgacttgttctgcagccccaggatgttcagacacacacagtgggatctgaatataaaaaggcagagactgaaacagtggaacattccagttcgctccgaaaaaggagaagagccctgcagcttttgcaaccccttctgaaatcgcttgcctggatccccatcgtcagggccaagctgaacacccacctcagcccttcccgcattcaacacttgactcgaagcagggccttgtcaattcctctcaattcctactgctcctctccctctgctgacctcttatcattgccaagactctttccttacactcgggtattgctaggtttccatgggcatgaacagtggagtcatctttctgtcaacttttagaatccttacagtttggaggccaggtgcgtggctcacgcctgtaatcccagcctttccaaggtgggtggatcgtttgaggtcaggagtttgagaccagcatgtccaacgtggcgaaaccccctctctactaaaaatacaaaaattaggcaggcatggtggtacacacttgtaattccagctacttgggagactgaggcacgagaatcacttgaactcgggaggcagaagctgcagtgaactgagatactgccactgcactccagcctgggtgacagagcaagactccatctgaaaaaataataataataatccttaaagtttgaaactatctttgaataaaaatgtacatacgtatttttttgctctgtgcggataaggggtttgggaaacagaggaaagatctctgaggctggaaggaagctgtgtgtgtagctgaagctacctaggccgtaggtgcctgtgtgaagacacagagtcagacccttgcttcctgccaggtgaggggagcttggagacctgatgcctccagggtttattactctgcagtgctaagcccttgagcattgagtcagtggccctgagtagatcaacatctgaggacaagggcaggtgctgttagaggagtacgcatgtttcggagcttggaggatgaggaatagaatggagggatctactttgagcatttcctctgcctatctgttgtgtctgggagagatgccgaggaggaggaacacgggttgagtccacatggctaatgcagggtggtccttaacttcgacacctgcagagccccttttgtcatgtaaggtaacatactcccaggtttcaggacttgaacacaggtatctttggaaattgggggcagcaacagagacaaggttggacccgctgaactttactccctatctaaaccagtggtctcccacctgggacacaggacccaggacccccaggtgcccatggcctcgtcttcagggggacccgtgacccttttaaaagtgtaggttgggggagcccctataggttgaaaaatgcgctttcatggagcagatttttttttttctgagacagagtctcactctgttgccaggctggagtgcagtggtgtgatcttagctcactgcaccctctgcctcccaggttcaagtaattctgctgcctcagcctcctgagtagctgggactacaggcatgcaccactatgcgcagctaattttttcttttttttagtagagatggggtttcaccatgttggccaggatggtctccatctcttgacctcgtgatctgcctgccttaccctcccgaagttcagattctcttaaggagttgtttcttcttctgtggcttcagaggaggcacagccgggctggtcaggacagggctactgtctccattacacaagcaaaaaggcctccaaactaattcctagagatgtggaaagccaatttgcaggctcttatgttctctgtctaggacatatggaaacttcttgatgcaaaagaatggcctccccttttcctggagtgcaatcccagcacctggctggatgtgcacgctccggctcgtaggtctgtctctggccagctctgaaccctgtgttctacactccgtgagagtgaccgccgatggaacctgcttgtaccgcctccaaggcaacacttggaagactggaatagttagaatacagtatggcctttcaaaaccatagtgtccagctttcctggatcacaaaatcaactgggcagttccatctgccagcccttcccctctgcctgtcagccatggtggagatgtcatcaagaacactagtattggacgccaggcacagtggctcatccctgtaatcccactttgggaggccaaggcaggaggattgcttggggccaggagtgtaacaccagcctgggcaacctagtgagaccccatgtctattaaaataatttttttgttggggcatggtggctcacgcctgaatctcagcactttgggaggccaaggtgggtggatcactggaagtcaagagttcaagaccagcctggccaacatggtgaaaccccattgctactaaaaatatgaaattagctgggcatggtggtgcatgcctgtaagcccagttactcaggaggctgaggcaggagaattgcttgaacctgggaggcagaggttgcagtgagccaagatcacaccactgcactccagcctgggcaacacaataggactccatctcaaaaaaaaaaaaatatatatatatatgatatataatagataatatagtatattttatatgatatatatgatatattatctatatgtatcatatattatctatgatacatataatatacagataatatatgatatagataatatatgatatatatcatatatatcatattatctatcatatatatcatataatagatattatatatgatatatatattttttttaattagctaggcatggtggcatatatctgtagtccagctactcaggaggctgagccatgagatcgcttgagcccaggagtttgaggctgcagtgagctatgatcatacactgccctccagcctggggagcagagtgacagagtgagacactcaggaaaaaaaaaaaaatgccggacgccagtatatgctaaacagcccaagatgccagcatccagagagtgtgcatattccttgtgtggatgctggagctgggccacctggtacagggacgtcaggctctgtgccaaccctcattcacagcaactgcgggctgtggagccgggtatgcccttgctgcagaggacctgagacacccaccaggctctcttggagacacagttatatcaataaaaggagttaagtttgagctgtatttattttagggtggcttttaatttggtttaatcagaattactcataaattatcgattaattaccttctgctgttcagttaaatcctctcagccacggagccagcttcgctgcgcaatgaatgccatccaccgtaattatagggcactttgtcagcatttaatcagcggtacttattaatgtggcattgatgtgtggtggccagccccacgctatccatcatgggtgagcagccagcacagatttggacaccattgctctctgtcccattagccagcccctgggctttcgggccaagcatcatgctcgcttttcactaaatggacactctgtctcttccattcaatcccatttttatcactgtcgacttaaacactcataagcttttgaacttcagtccagaacggctgagcagggcctgaccacttctcccagtgagtgtgaaatcccaagagactggtccgtgatcggacatcatggcatggcgtgcatgtgtaagagaattttatattcaacacagcgtagcacccagagaacacagaagtgatcttttggttttctttggcttactgaatatttttggagattcttctattcctgaaagctcttccagtgaaagctatcttgtgttggcaaaatagatctgatagtgtcctttctctgtctttgcagcctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaa

SEQ ID NO: 13975 - DNA, 5740 bp, Human
gcctcaagtgatcctcctgcctcagtctcccaaagtgctgggattacaggcgtgagccactcactgcacctagcctatatttgaattttaaatagtgattccacaccttaacctaaccataatgggaattggattagagaatggtgggaatttcagacaagttggtgagggtgagaagtaagggaagagaaacgttatggaacctctcacataaaaagtgcacagtggcctacccctatatggatgtgagactgctcctgataggaaatatccccaaaccccttgtttgcagtccacggccccagtctcaactccaccaaatcatgatgcttcccctgagatcatgattgcgttgcccagtttcctctctgaccagacctgattctacagacaaaagccaacctcctcacttcgattcccctggatcctttcctcctcttcacatctacagccgctcttctaacttcttactcccgttgcaattccagatattccagagacaggatatctccaaggcactccagggccccaaataacaaaccttatttgttttccacctcacacaatctgaactcttctgcctgccctttgaaacccttcgcgaacacctccaaccttatttcttgctcctcctcaatacagcctgttctggttggcacagcctcacctcttacctttgccacgatgctactcctgctgcgtcactcagttctgcatggtgagtctcctccatccactgtgatctggaaccacgtcattgtcagtggaggttgaatacaactggaattttttatgggattctaacagacctgtccctgataatggcgtgcccctaatttccgttctttactgactactcattggctgtatcactctagttgcacaaatgatctctatctccctctatgcatgcctactaggtccagggaagtaatatagtgtttgtaactaggagtggtaaagatgatggctaattggagagagtaagctcaagctaaaagcattcaaattcaattttttttttttttttgagacaaggtctagctctcttgcccaggctggagtacagtggcatgatcacagctcgctgcagcttcaaactcctggactcaaatgatcctcccacctcagcctccggagtagctgggactgcaggtgctcaccactatgcccagctaattttttttaaaaaaaaaattgtggagacagaggtctttctatgttgttcaggctggtcttgaactcctgggctcaagtgattctcccatcttggcctcccaaaatgctgggattacagacatgagccaccgtgcccagctcaaattcaaaaattttaagacattatgggacaaagaaaattcacctgtccatccaaataatgtaatgtgcaataaatctgcaaccactgcttaagcttgtcttgaagtttttctgttttgcaggactcttcctgagcagtacattttcttctcttctaacagagttagaatttattgcttacaactctttcagaaaatggcagtaattagaaatggagtctgaggagggggatttgctcaaaatacgagtatcgtttctttaccatttttctttagcaatgtattctgtaatcataaatgagctacatgaagatctgagcacagcctggaaatattgcatgtttaatatcagcctcctttcccttcttcagaattaaactctggatccttcctagacttggccagttccaagtcacgacttcgtcagatacactcttgctgtaagaagcagtaaagttcagtggttatgatcacagacctagagctggtctatctgggtttaaagccagactctatagctttctggatgtggctgtctgtttaaccttgggcaagctaggtgacctctgtttgcctcagtttcctcatttgtgaagtgcggataataatagtacctacctcatgtcatcgttttaaggattaaatgaattaacacatttaaaatataagaagtttgaaaagctcttggactccggctgcagcgtcagcctccctcgggcctcggcagcggcggcggctcgctcgcctcagccccagcgcccctcggctaccctcggaccaggcccgcagcgccgcccgccctcggccgccccgacgccggcctgggccgcggtcgcagccccgggctcgcgtaggcgccgaacgctcccggcccgcccactacgggcccaggctagaggcgccgccgccaccggcccgcggagcccggatgctggcccggaggaagccgatgctgccggcgctcaccatcaaccctaccatcgccgagggcccgtccccaaccagcgagggcgcctccgaggcaaacctggtggacctgcagaagaagctggaggagctggaacttgacgagcagcagaagcggctggaagcctttctcacccagaaagccaaggtcggcgaactcaaagacgatgacttcgaaaggacctcagagctggacgcgggcaacggcggggtggtcaccaaagtccagcacagaccctcgggcctcatcatggccaggaagctgatccaccttgagatcaagccggccatccggaaccagatcatccgcgagcaccaggtcctgcacgagtgcaactcaccgtacatcgtgggcttctacggggccttctactgtgacagggagatcagcatctgcatggagcacatggatggcggctccctggaccaggggctgaaagaggccaagaggattcccgaggacatcctggggaaagtcagcattgcggttctccggggcttggcgtacctccgagagaagcaccagatcatgcaccgaaatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggtcatctggagcatggacctgtccctggtggagctggccatcgaaaggtaccccatccccccgcccgacgccaaggagctggaggccatctttggccagcccgtggtcgacagggaagaaggagagcctcacagcatctcctcttggccagggtcccccgggcgccccaacagcggttacgggatggacagcctgcccgccatggccatcttcgaactgctggactatattgtgaaagagccgcctcctaagctgcccaacggtgtgttcacccccgacttccaggagtttgtcaataaatgcctcatcaaaaacccaacggagcgggcggacctaaagatgctcacaaaccacgccttcatcaagcggtccgaggtgaaagaagcggattttgcctgctagttgtgtaaaaccctggggctgaaccagcccggcacacccacgcgcaccgccgtgtaacagtggccaggctccccgcgtcccgctggtgacctgcccaccgtccctgtccacgccccgcccttccagctgaggacaggctggcgcctccacccaccctcctgcctcacccctgcggagagcaccgtggcggggcgacaactgcgcacgcaggaacgggggtctcctctcctgctggtccctgccggcgtgcctctagggacgggcgacgctgctgtgtgtggtctcagagcctctgcttccttaggttacaaaacaaaacagggagagaaaaaccaaaaaaaaaaaaagaagtttgaaaagttgggaaacactgggtaaacttatttttaaacagtgtattagtcagcttttcaaataatatggtcagtatctttttcttcaacccttggacaaccccctatttaagacaatgagtccaggccaggcacggtggctcacacctgtaatcccagcactttgggaggccaaggaaggccaactgcttgagcccaggagttggagaccaccccaggcaacatagcaaaatcttgtctctaccaaaaagataaaaatacaaacaattagccaggtatggcagcccacacctgtggtcccagctacttgggaggctgagcagggagaatcacatgagccctggaagctgaggctgcagtgagcagtgatcatgccactgcactccaacctgggtgacagagcaaaaccctgtcttaaaaaaaaaataaaataaaataaagcaatgaatccgattttaatctttaaaaagtataataaatacactaaaaagtgtccaaaaattctggaaatataggaaaaatatatatatttaatctgaagtaagctttttttcacattaacaaatggattaattacttcaaatttagagatatttcacctgaaaagatgtcctggggttaaaaaagttgaacatattggctgggtgcggtggctgacacctataatcccagcactttgggaggccgagcgggagtggatcacttgaggtcaggagttcaagaccagcctggccaatatggtgaaaccccgtctctactaaaaatgcaaaaattagccggacttggtggtgcatgcctgtaatcccagctacttgggaggctgaggcgggagaattgcctgaaacctggagacagaggttgcagtgagctgcgatctcgccattgcactccagcctgggtgacaagagcgaaactccatctcaaaaaaaaatttttttcaattgaacatactatttgaaaagttaaatgacatgcaatttaaaagtctgtttatcctttttcccaacttttcagataccatgtgcttagcacggtgactggcacttagtaagcattgttgcaaatgtcattttcctatgactcattgtcccttcactttatgaggagggtcccctcctctgcctggaccattgtccagtctaacgtatcccactttggaaactcttaaagtagcatgtctccaaagagctgcgtcggctaacactattcctcactgtcatgggaggtgaagtgatatgtatagaaataatgtttgtctcagctcaggctactgtagggtctcactgttgcccaagctggagtgcagcagaactatcatagctcactgcagcctcgaatcctgggctcaagtgattcccccacctcagcctcctgagtaaccaggactataggcacgtgccaccacacccaagtaattttttattttactttttgctgagacagggtcttgccatgttacccaggctggtctcaaattcctggcctcaaatgatcctcctgtctcagcctcccaaattgctgggattacaggcatgagccattgcactggcctcttcttataaagacactaattctatcataagggccctatcctcatgacctcatctaaacccaattttctcccaaaggcccatctccaaataccatcacactggggttacgtatttggtgggaggagcaattaatctcatagtaatattatatacctgcccaaaaaggtaggggagcaacttaaagtgatactggaaaccaaagatcttatatgataaatagccaggaaacttaatggtactagatgcataaagacaccaaatgaatgcttaccacttattttccccaataatttctgtattgttttttgttttttgtgttgttgttgttgttgttgttgttgagacggagtctcactctgtcatccaggctggagtgcaatggtgcgatctgggctcactgcaacctccgcctcccaggttcaagtgattctcctgcctcagccg

SEQ ID NO: 13976 - DNA, 15677 bp, Human
  misc_feature (1)...(15677): n = A,T,C or G
ctctcgaactcccgacctcaggtgatctgcccgcctcggcctcccaaagtgttgggattacagaagtgagccacagcgcccggcccatattattcttattgagttaatctctgcccatccccacagtgccatgggcacatttagggacttgccaatggatgaatgcgaagaaacttggaaattaatttttagacatcagttcagttccattcattgagtgcctactatatgctagggactttggtaggccttgaaataaaaacattcaagactcaatccctactcccacgcccaggccaaacacacttacaattacagtattatggggataggactcggataagtgtgcaggtctattgggagaacataaaagggggcattttgaagagaagaggcttctacaaaacgtcattattttacactggttgaattgttagatttttttaattgttagattttaaattaaatattggacgggagcagtggctcacacctgtaatcccaacactttaggaggccaaggcaggaggatcccttgagcccaggaggttgaggctgcagtgaactatgattatgccactgcactccagcctgggcgacagagcgagaccttgtctaaaaataagataagaaaataaaaaatgaaattatatgaaaaaggatacatacattagagttaaccgccagctcctattatagttgtgttttgatcaatatagactgcttaaaagggatgacttaatgaataattcctcctactaaacgctgttttaaatgtctaaacttttcttgagataatatccaatttcctctcccacgttttttttgtttgtttttgcttttgtttttgtttttgcttgagacgaagtcttgctcctgacgcccaggctggagtgcaatggtgcgatctgggccgactgcaacctccgcctcccgggttcaagcgattcacctgcctcagcctcccaagagctgggactacaggcgtgcgccatcacgcccggctaatttttgtatttttagtagagatagggtttcaccatgctggccaggctggtctcaaactactgacctcagatcatctgtccgcctcggcctcctaaagtgctgagattacaggggtgagccaccgcccccggggcccttgcccacgtttttataaacaaaatatgaggtgggaggattgcttgagcccaggagatcaaaactgcagtgagccatcatcgcgccactgcactccagcctgggagacagagcgaaacgctgtctcaaaaaaagaaaaaagaaacaaggaaggaaagtgtcccccgaatgaataaatatgagcagataattacttctagtttacataaaatgccctcttttaagagaggaactttttgatcatttttattactattcttttaatcttagatgtttatttttcaggaggaaaaaaacaaacttttccatagtagcagtattaaaacaaagatgaatatgttgtcaagaggcatctgaacaatctccaacagtgccgagtcgcatttcccctttcctctccgatgcatttgagactttaatgcttactatatttatttaagcgttttgttctgagaccccaaactaatttgcacagttgaagcaggaaatagaatgggtggaaacatgcgggtgtctgtattagcattatgcatctcatatgcgaataggaatgctctaaaaattcaatacagtatacatgcgtgtgcatcgtcatgcaaaataagtctctattggccttatatttgaacgcgcgaatgcagctcctaaaagttaaaaacaactcctaggctgaatcgcgcgatagaacgaaagcggctttaaacccagagactacagtttccggcatgcttcgacgccacacgtgattagcggcaactagaactacatttcccggcgtgccctggtctcacgtgtgatttgctgcggaacgaactacatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaagggttggctcgggaccccgggcgagggtgtgggggagccagggccgggtgaggacgtccggcgggggcgaggcggggtcaggagaggcgacttggggattcttgtatctcgggtggaggcttgggacagaaacggtccgagtgggcatagcgatttacagatttaaggcgcttgagcgtaattaatctcgtgtgagactccacggtggtgggaagacagccaggaagcaatgtgcaaattaagccagactcggcttaggtctcttgcctgaaatcacttcgatgttggaccaaacggaccccactgggttcctgccactccgccacactcagatggtacaagaacccccagctgagcccacggcggtgtggggaggggtttccaccgtccgctctggcaggaacctatgcaggaaagagggagctgctactgaccatttctggaggtccagacaaggaacgtgagttgtaagtgacggagccgacggaagttccgagcccggccccatacctttaccagctgcttggccttgcacttaaccagctctcaaccctcagttttctcatcagcaaattgggtataatatttatagccctgcttcaaagggttgttggttctctcaaataagatgatatatttaagtgacttacaagtcttattagccagtagcaacaaatcgcttacccaaagaagttttacaggttacatgtgtgagccagccccaggcatgtagtcacagtgtgtgtcagagggcacagttgcttcctctcagtcaccaacagaaatcatatggaaattttcagagacccatgaacagccaaagcattataaatgctttggtaacatggattttgcatataagcatttatgtattttttttcctgacattagattactttacttctaattccccttcagtgccgtggctggatgtgcgtggcacagaggctggtgttctctgcagtccagcgcatacatgccttgctgttctattgggtggtagacaacaccgctgaaggatatttgtagtctcttggctatttctgatcactccagtcccgttagtatttgaagcattgctatcactaaatggaatagtacagacctgtcctggagaaagcctctccgccaatgataatgatatgaaaagctactgatagaagcttccacttcttttatactttcccataggttagaaaagaagctgctaaggaagatactgtaaagaacaaaaagcattttcttttttttttttttttttttgagacggagtgtcactctgtcacccaggctggagtgcagtggcgctatctcggctcactgcaagctccgcctcccgggttcactccattctcctgcttcagcctcccgagtagctgggactacaggcgcccaccaccacgcccatctaattttttgtattttttagcagagacggtttttcaccatgttagccaggatggtctcgaatgcctgctttgtgatccacccgcctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctttttggtgtattttttgacatttttacacataggagaatttaagaggacaactgagggccgggtgcggtggctcacacctgtaatcccagcactttgggaggccgaggtgggcggatcacgaggtcaggagatcgagaccatcctggctaacacggtgaaaccccgtctctactaaaaatacaaaaaaattagccgggcgtggtggtgggcgcctgtaatcccagctactccggaggctgaagcaggagaatggcgtgaacccggggggcggagcttgcagtgagcccagatagcgcctgggcactccagcctgggcgacagagtgagactccgtctcaaaaaaaaaaaaaaaaaaaagaggaaaactgaataaatgaatgagagactgcttgtttgcaaggaatcaaactagactttgattggttgttcactccagtaaaaactcaaatgcctaccatacatgagtgtggagtagctggagtaaacatactttcaggagccagactttgtgggtttaaatcccagctttgccacttactgtgtgatcttagacaagttacttaacctctctgagccttgggttcatcatctataaaacagaactaataaaagtacctactttacaggattattatgagattaaatactgtatatgaaaagcacttaggccaggcgcggttgctcatgcctgtaatcctagcactttgggaggccgaggcaggtagatcattaagtcgggagttccagaccagactggccaagatggtgaaaccccgtctctactaaaaatacaaaaattagccaggcacggtggccggtgcctgtagtcccagctactcgggagactaaggcagagagttgcttgaacccgggaggcggaggttgctgtgaaccaagattgtactactgcacgccagcctgtctcaaaaaaaaaaaaaaagaaagaaagaaaagcacttagggctgagcacagtggctcatgcctctaatcccagcactttgggaggccaaggcgggtggatcatgaggtcaggagttcgagaccagcctggtcaacatggtgaaaccacgtctctactaaaaatacaaaaattagccggacatggtggtgcacgcctataatcccaactactcgggaggctgaggcaggaaaatcacttgaacctgggaggcagaggtttcagtgagccgagatcgcgccagtgcactgcagcctgggtaacagagtgagaccctgctacaaaaaaaaagaaaagaacacttagaacagaatcaggcacgtgatgagtgttctggtagtgctagaagtgatgattgtgattctagttattacctaccaggagttctgctcagctctggagccatacatacttgagatgcagggatagatgtaatttccttacggttatttgtcatttgccaaatattttattcttttcagcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcaggtaagaaactctagccatgtataaaacggcctatgcagtacagcatccatcatgattactttcactgcacagacaattgccatttgtctggctttttaagcatttgttcaacagatatttactgagcactttctatgtgccagacatggtgctgagtcctggggataaagatgaatgaggccaggcacggtgggcagatcacctgagctcaggagtttgagaccagcctggccaacatggcgaaagtccatctctactgaaaatacaaaaactagctgagcatggtggcaggcacctgtaatcccagatacttgggaggctgaggcgggagaattgcttgaacctgggaggtggaggttgcagtgagctgagattgtgccactgcactccagcctgggcgacagaacgagactctgtctcaaaaaaaaaaaaaaatagatgaatgagacatgggcccagttctcaactaactcatggacagacagcaactgaaatgcagcctggcagggagctcagtgctgcaggctgcagtccagctgttgaggtctggatcctggctctaccatttactaaccaggtgaccttgtgcaaattacataacttctcagtgccttgttgacataataattatagaacctgtcccctaagattgttgtaaagataatatagtacatatcaaaccagggtttctcaatgacactgctgacatttggggctggagttgtgaagaggatgctttgtgtatgataggacgtttagtagcatcctagatgttacgaacctccccccacaactgtgataaccaagaataaatgactccagatattgtcagatgtctcctggggggcaaaattgctcccacttgagaaccactgatatgaagtgtttagatcttacctggcacatagttaaggactcaataattgttacctgtccctgccatcatcatcatcacaggagatagaaaggggactaacattggtgaccaaggatcaagaagtgtcttgagaggggattagttttagggagggacttaaaaaaaaaaaagtgtcctgaagtgtgccacaaaattgaggaagtcatcctacagcagtggccctaccagccacctttgtgctcaggcctaagggacagcaatcgatggctacagctctgccagttaaagaagggaccaatccccaagcacagagaaatgctggcacaaatgaccgttttcgtataaaaaacaggacacacctggacacacagaaaccagaaagggaagtgtgattggattccttgtaggtgtgaccacacattgggtttaaatggctttttctatggaagaatacagagccgttgcacacagagataaagatgaaagagggtcaggcacggtggcttatgcctgtaatcccagcactttgggagaccgaggtgggcagatcacttgaagtcaggagtttgagaccagcctggccaacatggtgaaagcccgtctctactaaaaataccaaaattagctggtcatggtggtgggcacctgtaatcccagctacttgcaaggctgaggcaggagaatcgcttgaactcgggcagtggaggttgcagtgagccaagatcgtgccactgcactccagcctgggcaacagagtgagactctgtctcaaaaaaaaaaaaaatgaaagaagagggaaaatcaaggtcctggatggatattgaccctcctgtgaatccttgagataagatgcttctttcccattgaaattaatctagatcctcaagaggtctgtgtgtgctgggggaggaggtgaaaacagcacttcaggttgttctgtgactggcattttctcccatgtgtcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccaggtaaagcctcctccacaacctgcaacaatgttcatccagcctctgccccccgccccagcaccttcttagcttccatacttgccatagcaatttctttgttttaatcttaatttttaaataattcttaaattacaactaagatttttcatcttctcattctcacctagagtaatttttcaaccctcgtcacgaagcagaattacctgtggatttttttttttttttttttttttttttgagacacagtcttactctgtcgcccaggctggagtgcagtggtgcaatctcagctcactgcagtctccacctcccgggttcaagcaattctcctgtctcagcgtcccaggtagctggaattacaggtgcacaccaacacgcctggctaattttggtatttttagtagagacagcgtttcatcatgttggccaggctgctcctgagttcaagtgatccacctgcctcagcctcccaaagtgctgagattataggcgtgagccaccgtgcccggccagattttttttttaatacaaatgcctgggatccaccctaaacctagttaggtggacgctggggtcagggatgccctgctagagaatgtagcgttggagtagatggcttcacatcccagcgctgtcaccacgactttgagccagtagcttagcttctctccttgtgttttctctctagtaagattgggataggccaggtgcagtggctcacgcctgtaatctcagcactttgggaggccgaggcgggcagatcacgaggtcaggagatcgagaccatcctggctaacatggtaaaaccccatctctactaaaaatacaaaaaattagccgggcctggtggtgtgcacctgtacctgtagtcccagctactcgggatgctgaggcagaagaatcgcctgaacccaggaggtggagcttgcagtgagccgagatcgcaccactgcactccagcctgggtgacagagagagactccatctcaaaaagaaaaaaaagattgggataaaaacagtatgttttcattcaaagaaaatttctctttgagacagggtcttgctttgtcacccagtgcagtggcatgatcatagctcactgcatcctcgacttcctgggctcaagccatcctcccacctcaacctctcaggtagctgagactgtaggcttgcaccaccacactgcgctattttttctttttttttttttttaatttttgtaggccaggtgcagtggcttatacctgtaatcctagcattttgggaggccaaggtgagcagattgcctgagttcaggagtttgatgtggtaaaaccctatctctacaaaaattagctaggtgtggtggcgtgtgcctgtagttccagctactcaggaaactgaggcggaaggatcacttgagcccaggtggtcaaggcttcagtgagccatgactataccacaccaacctgggcaacaaagcaagaccctgtctcaaaaataaataaataaataaataaagccaggcgtggtggctcacacctataatcctagaactttgggaggccggggcgggcagatcacgatgtcaagagatcaagaccatcctggcaaacatggtgaaaccccgtctttactaaaaatacagccgggcacggtggcttaacgcctgtaatcccagcactttgggaggctgaggagggtggatcacaaggtcaagagttcaagaccagcttggccaagatggtgaaatcccgtctctactaaaaatataaaaattagccaggcgtggcggcaagcacctgtaatcccagctactcaggaggctgaggcaggagaatcacttgacctgggagggggaggtagcagtgagcagagatcacgccactgcattttagcctgggagacagagcaagactctgtctcaaaaaacaaaaaaattacaaaaattagctgggcgtgatggcgtgtgcctgtagtcccagctactcaggatgctgaggcaggagaatagcttgaacccaggaggcggaggttgcggtgagccgagatcacgtcattgcactccaacctggtgacagagcaagactcagtctcaaaaaaaataattaattaatgttttatagagaggaggtcttcacaggttgcctaggctggtcttgaactcctgggctcaggcagtcctcccaccctggcctcccaaagtgctgggattattgatatgagcctctgtgcttgacccaaaacatatttattgagccccatcctgtgcctgtcatggttctatgcactgggtgtgcagtggcgaacaagccagacacagtctctgctctaacggtacttgtattctgatgaagggaggcagaaagcaacaggaaagcatatcagacagtggtatgcagagagtgatggaggctactctagactggaacacggaggaaggcctctttgaggaaatgatttcttggtgttttttgttttggtttggtttggtttgagacagggtctagctctgtcacccaggctggagtgcagtagtgcaatctcagctcactgcaccatctgcctgctgggctcaagcgatcctcccacctcagccttccaagtagctgggaccacaggcgtactccaccatgcctggtgaatttttatatttttggtaaagacagggtttcaccatgttgcccaggctggtcttaaactcctgagctcaagcagtcctcctacctcagcctcccagagtgctgggattataggtgtaagccactacacccgacccttcttcccaattttaacactaaaagaaaattagaaaaattggccaggcacggtggctcacacctgtaatcccagcactttgggaggccgaggcgggtggatcacaagatcaggagatcgagaccatcctggctaacacggtgaaaccccgtctctactaaaaatacaaaaaattagccaagcgtggtggcaggcacctgtagtaccagctgctcaggaggctgaggcaggagaatggcgtgaacccaggaggcggagcttgcagtgagccgagatcgtgccactgcactccagcctgggtgacagagcgagactctgtctcaaaaaaaaaaaaaattagaaaaattacatgcttttctcttgactgtctgccaactatcatagtaggtaactttgggaaatggatgcattgagttctgaaatggatgtatttgagaggtagaacaccgtgtttagaaagtccttgtaggccgggcgcagtagctcacacctgtaatcccagcactttgggaggccaaggcgggtggatcacctgaggtcaggagttcaagaccagcctggccaacatgacaaaaccccgtctctactaaaaatacaaaaattagctgggcttggtagcacatgcctgtaatcccagctactagggaggctgaggcaggaaaattgcttgaacccaggaggcggaggttgcagtgagccgagatcacaccatcgcactccagcctgggcaacagagcagactccgtctcaaaaaaaaaaaagaaagtcagaaagtccctgtagatttctaagcgtctgtgtttgtttgttagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaaggtaggactctctgcaggcagagtcactctgagaattcagggctgatggaggcgtcccttgggaggacactatttgtgatgtagccagggccactgaagccgcggctgctgggatgcgggacgggcacgtttctctcttgcccggccagttattctggcgagttgttcatgtggctgtgtggtcacaccacgtctgatctctgtctcgtgtctcctttgcagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggacttcttcctgttggtgttgtaagaaaaggcccatgcttgtccgggcacagtggcttacgcctgttaatgccagtactttgggaggccgaggcaggtggatcacctgaggtcaggagttcgagaccagcctgaccaacatggcgaaaccccatctctactaaaaatacaaaaattagcctggcatggtggtgggaggctgaagcaagagaatcacttgaacccaggaggtggaggttgcgtgagctaagatcgcgccactgcactccagcctgggcgacaagagtgaaactccgtcttaaaaaagcccatggcaggctgggcgcggtggctcacgcctgtaatcccagcactttgggaggccaaggtgggcggatcacaaggtcaggagatcgagaccatcctggcgaacacggtgaaaccccgtctctactaaaaaaaatacaaaaaaattagccaggcgtggtcgtgggcacctgtagtcccagctactcagggggctgaggcaggagaatggcgtgaatccgggaggcggagcttgcagggagccgagatagtgtcactgcactccagcctgggtgacagagcgagactccgtctcaaaaaacaaaaagcccgtggcaattaatggtaaaggaaacccggcatttcagtgtaaagaggtaacataaacggatactgcctcattgcactccccaaaagagagtcaggagagcagcaggagaggcgcacagaaggcccagttctcaggggtttttattcttgctgcagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaggacaggcacgacagtggctcacacctttgatcccagcactttggaggccgatgcaggcggatcacatgaggtcaggagttcaagaccaacctggccaatatggtgaaaccccgtctctactaaaaatacaaaaattagctgggcatgatggcgggtgcctgtaatcccagctactcggtaggcagaggttgcagtgagctgagagcgcaccactgcactccagcctgggtgacagagctagactccgtatctcaagaaaaaaaaaaagttttgttttgtttttttgagacagagtctcactctgtcacctagtctggagtgcagtggcacattctcggctcactgcaacccccacctcccaggttcaagcgattctcctgtttcagcctcctgagcagctgggattacaggcacgtgccaccatgcccggctaatttttgtatttttagtagagacagggttttgtcacattggccaggctggtctcaaactcctgacctcaggtgatccacccacctcagcctcccaaagtgctgggattacaggtgtgagccaccaccccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactaaaattataaaaaattagccgggtgtagtggtacacgcctgtagtcccagttacttgggaggctgaggcatgagaattgcttgaacccaggaagtggaggtggaggtgagccgaaattgtgccact

SEQ ID NO: 13977 - DNA, 9007 bp, Human
tactagggagggtgagacaggagaatagcttgaacctgggaggcggaggttgcagtgagctgagattgcaccactgcactgtagcctgggcaatagagcaatagagtgagactctgtctccaaaaaaaaaaaaaaaaaaaaaaaattagagattcaggcaggaggggcggaaagttgtggattgtgattgtaggggaggatatcagtaccttcaatgcattcaccctggaagaccacatgtttgccccaaagctgctgtcctttataaaagcatatttgaagcttctccttggaaatgacttccagagtcacccaagaaaacacacattattattttgtagtcacaacctgtttctgacccattaaagatgctatgcagcttggttattcaccctatgcactaggtgtggtttcaaatgacttctggctggttccaaaaataaacacacccatagaagatgaagattggccttcaatgaggataaccaaaagaatgtgtcccaagctgtgaaggcaagtttgaaggaagggtgatctgaggaatggcaggtcacctgtaggaaaagaattcttgtatggcaagacttaatatgtagcttccaaaaggaacaacttggaggagtatctttcagaatttgagcactgatagattaaacataaaatcctcatatttcatagttccatctggaatgcatgagagtagagcatctgcttgccaaaatgtgccaatggtcataaaatgccacttcatgcacatgacatagtggtggattttcagggtcatatcctttggagagctaggcttgggtatttctccctcagatcaaccaagggtttcctttttttttttttttcaagcttctagtgggtataaggcattttcacttagtaaacttccttccttcagcatagaagtgacttttggttctttaataagtaaaaaacaggcttgttattttttggcccattctaatttaggatattgtcagcactgattgagctcaatggagctcaatctgtattttttgcattattgcatctcagtactgaaaagattggaagagagagacatgtaatatgacagagtgtggacattggaattagagagatctgtatttgaaccctggctccatcatgtaggagctctgtgaccttgggagacctctcagaggcttagggtccttatctacaaacccttgcagcattttgagaggactgaaggagctggtgcatatgaggtgcctggcactgtgcctggtgcacagtggaggctcagcaagcaggacccatcaccaatgacagagtcacgctgtgcacaggcatggagcacagtgcttcatgcagagtaggtgctcccaaaatttaggtttcttaatgttctgtgaacactgaatactagtagaaacggaggtgggtggcttcctgcagccccataggaagagggtagagttgcctccatctgcctggatggaactgcaaatgggccttgaaccaatggccttgtaagtcctttctcatttcagcttccaggattccctatcacatagtctagtttctagacgggtttccttacatggcttttctcacagagtcttaattgaatatgaactggatgagacacaagcctttcctcatttaggagaaagaggcacatatgtgccccctactctggggacagggcccagctgtcactctagctcaatgtcccatggataagcactgctacaggcaaggttggtcactttgaagccaaaccatgaagctcttacttaaccaatcagcatgttttgtgaggagtcctgacttagcaagaagccagagtaaaacatttaatgaggtataggactcaggtgaagtggctaaataacaaatggaaaaatcagcaaaggaggtaaaaaggaggaatacttgacatggttgccacacccactgctaacagaatataaagccctggaaaggaccaaggcttatcccagggaaaaggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaaggtgaggaggtgggcaccacactgccagcttaatgaactacttatctatatttgacatactaaactgtgaatggatctaagtctgttcacagtaatgctgagaatgataaagacatagattcactggcttaggtatgacatcaagtagtcttagaaaatctgttgtagagccacaaaggaaggatgcaggctggtgttagagtgaagcattagaccaaaatcagtcatagcaatcttatatggcgtcttactccaaaccagaatatctgattttttggtttgattatgataccctggttttgttttcagagcattaccgcattttcaaaaagtatgcacctgaattattttctatgctaagaatttcctaagtaaatcttcaaatatttaaagcctttcaaagctgtagcaaaatatagcatttatggcaacacaagagagctgttgactccagcaatatctacagacacatggaccatcctctagagcagccatgtgtacagatgacaatatggggccatctgttctggaagagaagtagatataagtaaagagtccacagagaattgggactgaatacctggtgtaggtttgggagggatcccagaagaggcaatgtctgagtggggtttgaaggatgagtgggagtttatatccaattgtacaagcccttgattctgggagggaattgactgcccactgttctgtagatctggaaaattagatgccagaaaggggttgtgctatttgaatatcattcatttatttacccagagttggagagtgttaggcacagtgctggggtgggggataatgtactgagtaagacagtctccttccttcaggagctcacagtctaacaggggagatagatgtggaaacaaaatgatcacacaaaggtcataagaagtgttattgattaagtatgtgggttacacaaggggtcttgctagtgggtgagggcattctgggtacagcaagaagctttttgcaaaggcatgaacaagggcaatatgaggggagagtggagagaagttagcaggtggaatgtgttggataaccaagttgttctggcttgcctgggatttttcccattttagcatcccagaaacccctcagtcctaagttaactgggatggttggtcacccaaccgaagggttggatacccagtaacctaattattgcaggaagccagaagcagataagaatagaattcatgatgaattcacattggttgtcctggttttgaaatgatcagttttatgatcaaatcctccttttatctcagagctgaaaatctgaaaggactcaaagctatttgggaggaatgtggctgaaagaaaatagcatttcactttaaggcacaaggcatttcttagtataacccatttcatgattaatcctatccccagatcctgtgcagcaagtctgagaatgccaggctggtggtgcagatcgacaatgccaagctggctgcagatgacttcagaaccaagtaagattttcctaaccatcagagcagtctagtaacggacaggctgaattacaaagtgatgagctccctatcctggaatgtggaagcagaaatttctattgggaggattcttgcattgggttaggattaggttaaatgtcaaagcctcttcaataggtgctcagattctgtgttttaagtttttttttttaatttttttattttgagatggagtctccctctctcatccaggctggagtgcagtgatgcaatcttggctcactgcaacctccgcctcccggattcaagtgattttcctgcctcagccttcctcgtagctgggattacaggcatgcgccagcaggcccagctaatttttatatttttagtggagaccgggttttaccatgttggtcaggctggtcttgaactcctgacctcaagtgatccacccgcctcagcctcccaaactgctgggattacaggcgtgagccactgtgcgcagccctgtgctttaagtttgattgtaagacaccatccattcttactccttttcaacccaacgtctggagtaagtttgaaagtgattttcacattggtctctttgtatacgttagtcactgtcaaccccccaaaaagaagttattaaaccacaaaaacaggaggcaaaatccattgcctttcagagaatcaatcaatacttttaggtatgaccattattacaatcatgagaatcctttgcattttcctgggatcttacattttacaacataattttacatatatcatcttcagtccaaccctataaggtgttagttttgtcttcattttacagttaaggaaatcaagcctcagagagataaaggtatctatctacagtcatttaatgagaatactggctctaactctgaattcagtgtttcttccacaacactagattgcttcttggcaaggctggaaaggatgacaggacaacctggagcaggcttatgaagggcactgattcacttgagatggcaaaagcagcagggcttagttgatagtaacttgtaaacgagagtcttagaacaaacttagtttgtgttagactaaactatccacaggcattccaccaataccttttctgtgtgtctcagtgacaaaataggccttctcactcagtacaggagtattttctcccttaattttttaaattcaaaatatttcaaaatataataaaattgactaagtcagccaagtaaaggccgggaaacaaagactttttttttttggacctcttttgacctctggctgtgtgtgcaggtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggtaagagtcccagcccccaatatcccaatactgagagctctgtgatccccctgaataggataaggtaggatttgatttgctaagcaccctaggcctaacaacattttgctggttgctcaaaacatactttggggcttgttggggaatgagtgacagcttaccttttttacataaaggagtgtggtaagctgacctacttccccttgggaccagacatgtatggctgaaaggtcacacaaatatctttaaactactgtctactgtttgatgctatctattagcttctgaagaggtgccaggtaggttaatgaccaagactggaaggagatagaaaacattcttacactctgtttcacctagataactagaactcaagctagataaatggatagatggatgaatggatggatggatgaactgatggatgggaaaaacgggagaaatgaaataactcaaataatggttgattcagatctcatggctgaatgcaatactacgaaatcagatgcatgtctcaaacattagacgttttcatgatgaaaacatgtgtcatactctagtagtatcccatgaaataaataggaggaatgaaacctggtttctctatatttaagtagcaacaattgtaagccaattatcatgccaggcttatcactgagcaaaggggaaataagaaagaaatgatagaatcttggactgggtagaaatattagcaatcatttaatgaagcagccgtatcatacagatgagggaagggattcagagaagaggccagaatttccagaggtgacagctgggcttcaactcatgtttcctaagctgcaatgcaatcctcttcccattatattgaactgcctcaaagaagttattgaaagacttctttctgtgggtttatttcttcccttttctccattaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcaggtgggcatctaagcacgtggccactcaggacccgaggccccccagggccccggaggcagggtctgatcctttctccccttgggtgtttcagaccgaggagctgaacaagcaggtggtatccagctcggagcagctgcagtcctaccaggcggagatcatcgagctgagacgcacagtcaatgccctggagatcgagctgcaggcccagcacaacctggtgtgtattgttcagacctgctggtgagcgatgggaacttgggaggcagagtcttggggatgcccttggggccacacactcttcttagctcttggagcttgtgagttttttcgaaccccatggaggaaccctataaggagcagctctctgacattcctgatctttcccaccacagcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagtgagtacctggcggacggcacccctgcaagggacaggcactgttctactgtaggataaaacagagactttgaaaatcaagtttcagatgccaatctgtctgtagaggcgagagttttatattacagccgtgggaagtgtaggatatttgttgctaacattatctgggctaaagatactttcttttacaaaagatagtcatgggacttgactccttcctccagtagagattttttggatgttgatggccaaataaatctttctgtcttcaggactgtcttgtcaccacaaaaaggaaaatgaaactgtaacaatgatcactttttctgatttaaacagaactttcaaatccaccgtttcattaattcttgttagaatcatctgaggcaggcagagtgggaatcattatcaccttcttatagatgagcatttgagtgtcaatagggttgatgatcaataactaacagtacagcagttgccagcgaacataatatttttatgaacacagtcttgtggaattttcataatcctgtgtggttggtactaccagtcctaccttacaggtgggaaagctgaggcttagaaggaggaagtgactttcttgtgtgtctagggtcatacaaggaaggctgggattccaccttacatgttctttgctcatttctgccactgtatcagaactctgtagaaggagtgatccaaacaaggcatggcttcctaggacatcagagaacgggttctgcttgtttctgtgtctctttggattgagtctcccttgtttgaatcacccttctcatgctgacagtctaatgcttctgcatcccaggctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagacatgattctcatttgtattcattcttttcaaagtgttgactctctgtgtgcttcttataaagccacttgaaagcagaaggaggactttataggttaatcatctcctaaaaggtcttcatcaccttcattaacattcattaagcacagtgagtcccagcatccacttaggccagcataaaacaagtaggatcactaggacaagaggcctcgtctgaatatgataaacatatttctcatgggaccttactcagtaaaatgcaacggtgagcatctctagacagttccactcattcttttaagtccctagcagggatgacagaagttaatatttattgaacacctaccaaatgccaggaattgtgctactaattttttctcttcctcacagtgaggaagaatcaatggcaggactgaacccagagttcactctctgcttgtcagttacacatgaggtgtgattatgagaggacaaaattgatttcaaacaagcacccagagcttatacatcctcctggggagacacaatgctgttagtgctcaaaacatctctgaaactctcctttgtgaaatactgaataactcaatactaaaaagcaccaccttgccatcttccatatttgagcaatacccaacctattttgaaagtgtttcttttctcacttgaattgtttaaccatgggaactacatatgaatttcgggaccctccccctcaaagttat

SEQ ID NO: 13978 - DNA, 236341 bp, Human
  misc_feature (1)...(236341): n = A,T,C or G
agaacaaatagcatttagtgactgaacagtttggaagacaaaggagagaaaatggctatgttattttaaagcctcagacatggataattaagggagagatggtattcatagtagaaagaggaaagtgaacaagagaatcaatttgagggcagatgataaggtacaatattttggacatgctgaacttgaatgataatgagcttgtatgttgagaacctatgtcccataggtataaggttgggttctggaattcagttatatgcttggtttaaatggcattatctcagtgtttgaaccaagaaccaagcacctcattaaacaatacttttgcatgtgctatcactttacacttcacaaaactttaagagacaggagtcattacttgatgggcaattgatgatgagtgttatagtctgttacaataataaatctgaataatgaaggtcttctatcttctagcccaataaactctcttagaagactttaattgatagaactgcggggttggtagggtcttaaagtcacctagtttaatcagcaacttgatgcacgagttagggatgatgcatcatccttaactcgtggttatccaggctatagtagaacactgatcatggagctggaggcaacccattttaccttctttttttattttttttatttttttttttttttgagatgggctttcagtctcttgccaggctggtgtgcagcagtgacacaatcatagctcattgtagccttctcaagttcaagcaatcctcccacctcagcctctcaagtggctgggactacaggcgcataccaccacactcagctaatttttcaaataattaacctttgactagctcgatcgaagtctgtttcttcgtaattttcatctgtttttcttagttccttccttgaagttctatgaatcaaacaaatcaggtatgactttcaatttgtgatcctagcagacaagaaatgtattcatttgctctaagacaactgaaatcccctttgattggtttcataaaatccccatacaagtttcatagaggtcttaaggtctcccacggtccactcgtttacttcaagtgtggcgccgtgctgccttgggggtcctcaggtcctccgtgctcagtgtcgtaactcctagctatccaaccctgctgtctgttcaaaggtcttgccacctccccaggtgctgctccgtaaagatgagcagtgccccatacaaagcgtttctgatctccctcatttctctgtctggaggaaattctctgtctttttggtgcatctcaagggacccttcctctccctttccccgctggaaaatttacccaatttctttaacgattttagcgtttacgaatacccagaggcatcactggcttcaggtaactttaactttcttctctgcataagttactgaggcaaggaaataccaagggcttggtgacatgttcaaaattggaaaggaaatatagagaaagaaaaaacactaatattccaataaataatcctgccacacacatttaagccttgtggcacatggcagcctttggaatctttgatgactctcctatgtttattccaagataacattgcatgacaaaactttctaatatattttagaatcctgtcagctcccaatttggaattgtttgggggttgtagttacacacatgtttaacttcttgtctgtactttagtcagaccaataatgaagttgctgattgtttcccagatggataatgaattgaactagcccatgcaagtattgacaattgaggattagctcatttgatttatggattcaccacagataaaccacagaggccataatctctagcctctccctggcctgtaaataataaagattttaatgaaggcacatcgtaacaatggtctttcctgtttatccttcaaagaacaacataataaggtggctacccctgtggaattttgtctcttcaatatcagaaggaattcatgaagttcttatttattcacagataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggaggtaagaatgtattttgagttaacacatttatatattgcagctgtgtaaagaagagattgtttaagcatccacaaaataagcaaattatatttgttacaatatgttttcaacagatttttaagaataaacttcctttacaatctcacttcttaatacaaacaatgtattgattaaaggtatagcgtgataggagggaacccaacctaatatatggttaaagaattgtactgatttgaaaaaatactaaaggaagaagatatgattttatagttaacgtttggaaacattggctatgaccatgtgtagcatgtggcattagcaaacaagcataatcatatgacatgtttattgcattttatcttttttggggtggggagttggaggattggaggaaaacatttgttttctctattttgtgactatgagttaatttggttttattttcattttgtgctatgtttttctaatatattttgcctctcttttgataaccctgctttaattatacatgcttccagaatgtcagcactgtactcatcactgaattaggttatggttctttatattcaaatgatttaatgagtaatttgtgcatcaaaacagacgcacaaaatggttgtgaaaattagtcactcgtttcagtcatatttttcataaaatccatttggcaacatctaagaattagaagttatagtctgattaaagaatctaaattaaatttatttcaataaagacaggtaactatgttattcttctgagtgtaagttttatacagattcagtagatatatatactttccatttatttctgtaacttgaaaacttttgtgcttgaatcattacatcataatttctggaaaatcttgtttctatctgaaaaacttgtagacagtttctgcaggggtaagatattttttagagatgtgattgacctttggtttcatagcatttcagtagacagaaatcagataaactggatttatttcggtatgtttccttaatatttatgatcattaatagaatatctggttagcttttaaatagaaatgaatattcagtgccttcaggacttaatttcaactttttgtcctcttgctttatatgtatcctcttgtgaaatctgttcaaaatgccataataaaagcaattcttgttcaaattctgaaatgccagaatccggctttgacatgattcaagtgggaaatccttccttagtttcattcttaaccatagccccagtaaagctgaggtttagctgcattgcctttagacacgtgtactgataagagagtttttaaaaatcactgtagcattaactgatatgtgagttgaatacgttttaaaccaaatgcgtacgaactttacgtcattattgttcaccttaaaataatggctataaacattctaataataagtaactcattaaacttttattacaaaatctccacagttaagcaacaagtgcaatactcatcaagattatccagaaggcttggaataaaccacagcttaataatgaaatcacttttcaattacaggcttggtaaatgcaggactgtgccgttttaaacataatacctatggattggtggatgaacctggggaaaattctgcatttggaggaaattcaaaaataattatttttttctccttggagtgaaatgtcttccacatatacactggcaaatatttaccttgagaaatgtaaaatgatttttttcattatgtcaaaactgagttgtttttattgcttggaattcaagacacctttataaaatagttcctgactttttggccgaaaatcacatattccctttctcctctttctccttcaagaattcagttgatggccaattcagtagcttttcccatcattttaacgattacccttccttttgagaatgtggcttgtctgctctttaggtattataaaaaaaccaaagaaatgactttttgtaattttggcaaacttgttttccacagaggagcagttgagctcttgattcttcttaggtttttttttttttctcttttaatcttacctagttaatacaaaacccaatcatgattagcaaaggcactttctcaaaggcatctcacccaacccctgccggatgacttttatttgtccccatgtcatctttttctcaactctagctggttttcctcctatttagttagagataattgtgattaactagtgtgacctctctttttgatatgccttcatttttgaaaaaaatgatgaaggagaaaaaaaaacctcttaggcctcctcccaaataaatacagagaaaatccatgttcagcaaacaattattgagggactactatgcatcagattctgcattaaatgttcccctaatggaaactcagcctatcataactgaacaaatcattgctgtctctagtagggcccttgctcttttcttcctgcaaagctccccttcttatacatttcctgttttaataaattccattgccatctatctagttgttcagtccaaaaaaatgtgtcattttgacacatttctctcccatatcaaccatgtctaattgatggtttccatattgtattaagtccccaaacttacttactttctttctttctttctttctttctttctttctttctttctttctttctttctttctttctttctttttctttctttctttctctctctctctcttgcttgcttgctttctttctttctttctttctttctttctttctttctttctttctttctttctttctttctttcttgtcttccttccttgcttccttccttcttccttccttctttccttcctttttctttcttttttggtcttatactttaagttctaggatacatgtgcagaacatgcaggtttgttacatagatatacacgtgccatggtggtttgctgcacccatcaacccgtcatctacattaggtatttctcataatgttatccctcccctagccccccaccccctgacaggctctggtgtgtgatgctcccctctctctgtccatgtgttctcattgttcaactcccacttatgaatgagaacatgcgctgtttgtttttctgtttctgtgttggcttgctgagaatgatggttttcagcttcatccatgtccctgcaaaggacatgaactcattcttttttatggctgcatagtgttccatggtgtatatgtaccacattttctttatccagtctatcattgatgggcatttgggttggttccaagtgtttgctattgtgaatagtgctgcaataaacatacatgtgcatgtgtctttatagcagaatgatttataatcctttgggtatatactcagtaatgggattgctgggtgaaatggtatttctggttctagatacttgaggaatcgccacaccgtcttccacaatggtcgaactaatttatactcccaccaacagtgtaaaatcattcctatttgtccacatcctctccagcatctgttgtttcctgactttttaatgatcgccactctaactggtgtgagatggtatctcattgtggtttcgatttgcatttctctaatgaccagtgattatgagcttttttgcatatgtttgttggccacataaatgtcttcttttgaaaagtgtctattcatatcctttgcccactttttgatggggttgtttgttttttatttgtaaatttgtttaagttccgtctagatttgggacattaccctttgtcagatggatagattgcaaaaatattctcccattctgtaggttgactgttcactctaatgatagtttcttttgctgtgcagaagctctttaattagatcccatttgtcaattttggcttttgttgccattgcttttggtgctttagtcatgaagtctttgcccatgcctatgtcctggatggtattgcctaggttttcttctagagtttttatggttttaggtcttacatgtaaatcttaatccatcttgagttaatttttgtatagggtataaggaagaggtccagtttcagttttctgcatatggcttgccagttttcccaacaccatttattaaatagggaatcctttccccatttcttgtttttatcaggtttgtcaaagatcagatggttgtagatgtgtggtgttatttctgaggtgtctgttctgttctattggtctactttatccgttttggcaccagtaccatgctgttttggttactgtagccttatagtatagtttgaagtcaggcagcgtgacacctccagctttgttctttttgcttagcattgtcttggctatatgggctctttttggttccacatgaaatttaaagtagttttttctaattctgtgaagaaagtcaatggtagctggatgggataacattgaatctataaattactttgagcagtatggccaatttcatgatattgattcttcctatccattagcatggaatttttttccattttttgtgtcctctcttattttcttgagcagtggtttgtagttctccttgaagaggtccttcacttcccttttaagtagtatttctaggtattttattctctttgtagcaattgtaaatgggagtccactcatgatttggctctctgtttgtctattattggtgtataggaatgcttgtgatttttgcacattgatgttgtatcctgagactttgctgaagttgcttttcaccttaaggagtttttgggcttagacgatggaattttctaaatatacaatcatgttatctgcaaacagagaccattcaacttcctctcttcttatttgaatactctttatttctttctcttgcctgattgccctggctagaacttctaatactatgttgaataggagtggtgagagagggcatccttgtcttgtgccagttttcaaagggaatgcttccagcttttgcccattcagtatgatattggctgtgggtgtatcataaatagctcttattattttgagatacgttccatcaatacctagtttattgagagtttttagcgtgaagggctgttgaattttatccaaggccttttttgcatctattgagataatcctgtgttttttttcatggttctgtttatgtgatggattatgtttattgatttgtgtatgttgatccagccttgcatcccagggatgaagccgacttgatcgtagtggataagctttctgatgtgctgctggattcaatttgccggtattttattgaggattttcgcatcaacattcatcagggatattggcctgaaatttttttttgttgtgtctctgccaggttttggtatcaggatgatgctggcctcataaaatgagttagggaggagttccactttttccattgtttggaataattttgtaagtaatggtacgagctcctctttgtacctctggtagaattcacctgtgaatctgtctggtcctgggctttttttggttggtagactattaattactgcctcaatttcagaacttgttattggtgtattcagggatttgacttcttcctggtttagcctttggagggtgtatttgtccaggaatttatccatttcttgtagattttctagtttatttgcatggaggtgtttatagtatctctgatggtagtttgtatttctgtgggattagtggtgatatgccctttatcattttttattgtgtctacttgattcttctctcttctcttcttggttagtctggctagtggtctatctattttgtcaattttttaaaaaacagctcctggattcattgatttttttttgaaggatttttcatatttctatcttcttcagttgtgctctgatcttagattatttcttgtcttctgctagcttttgaatttgtttgctcttgcttctctagttcttttaattgtgatgttaaggtgttgattttagatctttcccactttcttctgcaggcatttagtgttacaaatttccctctaaacactgctttagctgtatacacactgttctttctacctgggaaactgttttcctccccatccttagcaagtttctattcattcctcaagtttgcttcttccataatatcatctatgacctttctttcttcctcttcttttctttagagacagggtctccctttgtctatgtcacccaggctggagtagtttggtggtatgatcaaagctcactgctgagctaaagccattttccagcctcagtcttccaagtagctaggactacagatgtgtaccaccatgactcgctaattaaaaaaaacatcttttgtagagatggggtctcattatgttgcccaggctggtctcaaactcctttcctcaagtgatcctcttaccttggctccccaaagtgctgggattaaaagtatgagccaccatgcccagccttatgttctttctaattacaatatattactacctaaattttgtcccaccaagaaaggtggatccacttattaaagatgagggttatcttatgttttcttctaaagatagccattatgagacaacgtgagaattgcacgcagagcagtagaaagcaggcttctggggtgaacttcttgggctgaaaacactaaaacattgtgtagtatccagattatttacatagcttccctaacaaagcaagagttcttgagagcttgcaaaggtgtattctcctagtgcaatgttttgattgtgttccatatatttttttaatccctgtggcactattctgaaaatagtgccattaaatgaaataagcagactgtattagtcagcttgggctactgtaacagaataccataaactgggtggcttaaacaatagaaatttatattcacacaattctggaggctagaagttcaagatcaaaattccagctgctttggtttctggtgagcgctctcctccatgcttgcagacagctgtcttctcatctcatcctcatatagcctttctttggtgtgcataagcagagagagggttggggcaggtggagagagagagagagagggagagagagagaacaagctctctgctctctctccttattaatataaggacactaatcctattggattggtgaccctctcttgtgaacttatttaaccttaattacatcctaatggccctatttccaaaaatagccctaatgggggttagggcttcaacatatggattttaggaggacacacacattcagtctataacacagacattcaacaaataattgttcaataaataaatgagtgaatgaatggataaatgaaagaatggatggatgaatataggattatgtgactctgaaagaggaggcaaggaatgagagctgaagtagtccatggacaaatctagaatctggaattcagacaagtataatccagtcttgcttctgtcactaactgtgtgattctagggaaactactccaattgaatggtccctgctttttatttggtcaatgggtcaataataactgcctcatgataccccattttccatgatgtgattattatgcattgcatgcttctatcaaaatatctcatgaatatatttgcctactatgtatctacaaaaattaaaaataaaaacttaagaaaaaactgccccacgtcattagccgttatataatcagaattgagtagagaaatgtggtagtctcttcaaagaaaatttttaaaagagaaaggtcaaagataacattataaataggggccatctttctgaactttatttaagaataaaaaattgaatatatttcccaagtaaggtactttggaaaatcctttgtttatatgttagagaaataagatacttttgaaaatataatttatagaccaaaatatatggtctggtaaaaataagctatagataccagaaacatcatttgtatgattttctctcaaaccagtatttatccaaccaagagaaactttaaaaataatattagagtttggcagcaattgccacctcacaatgcatgtgacttctctccaacaaaaagatctttaaagacttggaatgtgcttgtctaaaggacttgaaaataattagtgatagaaagctttttctcaggttatgaactttagagttacggattgattaaaattactgagtagaaataactttttagagttctgttggttcaggatgaggtttttctcatgtttccttctaaaagtgcccacaatgtagtaacattgtaactgcatgcggagcagtgggaaacaggcttcttctggagtgagacttcctggtctcaagtcctcctcaggggtcctgtgggcttgagtgatttgggaaactttaattatctgcccctcagtttatttacatgtcacgtaggaataataattgtatctaaccaattagagttgttgtaagggtaaaatgtgacattgtgtgtcaggagcttagcacagagctggcagaagaacccaataaatgttaacaagacaacagcagaagcagcttggctaaaatgcagatctagcatagggttattagggcaaaagccaattattatattttatcgattgatttttataagttattgctctttttccaatttcttgtttcctagaagttcagttatctctggatggtctaattatttgactctgggttggtttgaaatggaagcactgaccgttttctaactaacaatgaaaacgagggttcaggagagatcacaaacttcttgtttacgtgaaagaaaaatttaggtggcttagtttgtaatactctgagataagccattgaaaaaagtaaaaagtttgcttctttaaaatattgccttgtggcacattttctttgctgatctttattatcattggccattacaaaactctgcaagtataagtcagttgttgatgcacctgtcatgtgccagacccggctttgtgttcatctcagccagaattgctccaaattagtttaatcagttaaaatattggctgtgaacttagttttcttctttcgaacatacatacatttacacatagaacataatgacatgagtagagagtgaatatctcttatgctgtgttaaataggtggaaaggaatagtggaaacagattacactggagtcagaaattcattaactaattttgaatcaatgcttgggcaatacattatgttccaacaatgtaatcctaaaatgtgatattacaatgaagatgtgcttccttgtgtcattttaaaaataaatagttctcacacttttaagtttgattttagattctacagtgacaccttacatattgaaacaggcaatctatgttaactaagacaggaatattcattaaaatggcaacaacagcaacattgcacttctaagatacctaacaacggtggtcagcatcaggaggctgacaaataatgtgtgcttgataatgaagaagaatgaaataatttgagattttagacatatgcaacagattttttgtgtttgttttattttttattttttggctttattgaggtataattggcaaataataattgtatacattcaaggtgtacaacgtgatgttttgatatacatatacattgtaaaatgattaccacaatcaagctaattaagatacccatcacctcatgtagttatgtgtgtgtgagtgtgtgtgtgtgtgtgtgtagtgaaaatacttaagatctactcccttagcaaatttcatgtatacaatacattattattaactatagacacaatgctgtatattaggtctccagaatttattcatcttacaagtgccagtttgtaccctttaaccaacatctccccatttcccctacctcctagttcttgggaacaaccattctactctctgttcctatcattttttactttagattccacatataagtgaaatcatgcagtatttgtctttttgtgtttggcttatttcacttagcataatatcctccaggtttgtccacattgtcccaaatggcagggttttcttctttttaaaaagctaaatagtattccattgtgtatgtaccacattttaaaatgattcatccttcgcattcaggttgtttctatattttggctactgttgataatgttgcagtcaatgactatgtgagtgcagacatctcattgagatggcgattttatttactttggaaatatacacagaagtgtgattgctggatcataaaggagttgtattttcaattttttgaggactgtttatactgtattccctaatggctattccagtttaaattcctaccaacagtatataaagagccccttttctccacatcttcgccaataacagtcattctaacagctgagaggtgatatctcattgtggttttttgatttgcgtttccatgatgactagtgatattcagtatcatttcatatacttgatcgctattgtatgtcttctttgaaaaaacatctattcaggtcctttttcccatatttaaattgagttattttattattaatgttttttgctattgagttgcatgagttccttatatatttttggatattggccccttaccagatatatggtttgcaaatattttctcccattccataggttttctttgtttttgttgattgtttcctttgctttgcagaaatttttagttagatatagtcccacatgtttatttttgcttttattgcctatgcttttggggtcatattaaaaaaaattattgccaagaccaatgtcatggagtctttctcctatacttttctctgtaagttttatgatttcaggttgtaggtttaagtctttaatccattttgagttgagttttttgtatggtgtgcgataagtaagggtcaaattttattttttggcgttagatattcagttttctcagcaccatttattgaagagactaccctttctccattgtgtgttgttggcacccttcttgaagatcagttggctgtatatgtgtggctttgtttctcggctttctattcggttccatcagtctatgtgtatgtttttatgccagttgcactagatgtctttgaataacagtatttctcccctaggaccctttaggttggcttgggcacaaaatgaattttgactggtttggcatttatttcagggaaaaagtttaatttatttatgagaaagcaagtgcacttgacgtgttgcatactcttaacactagataactaagaagtgaagtcttaatggttttaaaatgaggaggaagactaccagctatccaaaagattgtctttgatgtgtagttaagaaagagaaatgtaatataataacaaatgtgtattactataaaagcctacattacaaagtatttattaagctttgcaatattgtttttaaaatagtaaatatagtttggatattcaattttatcttgtgagaaattaaaaacagagaaaatgccaagagaagtgaagattagttaatgggaccctgagtttgaacgtcattagtgcccaaggaaatattacagattctcttagaatataatgaaataaaaaaagaaggctgggtgaggtggttcatgcctgtaattccagcactttgggtggctgaggtgggagaatcatttgagcccaggagtttgagaccagcctgggcaacatagtgagaccccatttttacaaaaaataaattaaaaattaggctggcatggtgacacatatgtgtagtcccagctacttgggagactgaggcaggaagattgcttgaacccaggaggtcaaggatgcagtgagccgtattcatcctaatgcattccagcctgggcaacaaagcaagaccctgtctcaaaaaaaaaaaaaaaaaaaaaaggctgcaatcaagtttatagacatttaccctccagaagcaccatggactgtctctggttttggcctgggctcaagagggaccttctttcttatggaaaggtcagctgtcccctttcctacattcacatatgctctgtccataccatgaggcttgcttgccttattctttcttctatgaaagatgtcaatgaagtccagcatgtctattactcttactgctgtttgggcaacctctagtacttccaaagtgaagttggtgaagtggaaaagtctgatgtccaaatttaagaaaatttcctcaagtatgaggagtcttctgttttgctctgtctgccttggtgatcaaccagaatttgaatgtgaatcaatcgtttttcaaaggaatgttgggtgatttgtcttccggttaggaaacctcatataaattgtttatcccaaaacaaaccctcatgagtttctttcttattattaacccccatacttgcatgattattgcttccctctttggccactaagtcaatagtaaaactcacaataaaatattcaggaaagagcctcttttaatagttttgacagttgtctaggatttggcaattatagggacagagattctttatgatgcttaatattctagaatacttaattgagaccactgcatcagaatattctattctctatgctttttccttgaggataaattaagaagcagtgagaagtaataggaaataaccaattcaaatctatcttagaaggataggagttggttcagcttctttgctccctagttgtttcatcaaatgaaggtagcaacatgaagagaatttgttccaataatgataagtaggtagcatgaaaaaatggggagtaggaggggaactgtacactcttccatttgaatgataaataaaaatttttattaatgtagtatcttaacatctcaaagtttatttacattgatagaatcatacaatcattttgataaaatgcttctctttatacataattctgtccaaggtagtgatttttaaaatgaattatttcagctataggcaaattcagtagataaatactatgctcacttttgccctagaacctcttttggtctttcatgatgtaaccgaaactgaagattggtaaaatattgtgtgctttttaagattattttctgcatgttaattagtagaattgtcaagctaaaaaatcacaaagggcaagaattggtcaactatcattagaacaaggaataatataaagagacgtgtgcaaatagacaccaaaaactacgtctttaaagttgatattcgatataagatgttcataaagcacaagaaatttgacagtacctttgtttaaaaaagatgcttgcactgatggacggtaaagcaaacatttcatagaaatagcttatctcactgaagtgctccacagcatagtgtgagctgggtccacatgacctaaggagatctcacaggtatcttctcagaggaatatacatgcctaggaaccagacaatcagcttcaagaacaattgaaagttaattgtattattgttggccatgccacccactgccaatagactacttgcagatccagcccctttacactgttgagcatttattccaccagctttcagacccgacttttattccaccagtagagtgctgctgaagatacagaaaataatttgttgatacttcttaatctaatcctaggaagtcagccatagaatgtcacctgatacagaaacaatgtttctagaacccacactgcacaatcttgtataccatcccctacgacacacacaggcaaatacacatgccttcttgcttttaaatatttatcattttggaatcgaccagtactgtatttgatacctgatgctttctttaggtaagcatataaatctgggtgccttatagttacaccttggcagtaactacaaaaaaaattgtttaaggtccatcaacttctgcctacccccacaaaaaaaaaattaaaaaccaaatcacatcttttctagaaacatcacaggggaattccatgactaatgttatgcaaaacttaaatccactatccctgtatatttctgcaattcactttcttagtctttcagtatctcacacatccagcaggtgctgctttcagactctctcctctcaaaattctcactctcctcataatccagcactctgcatttctgttttttcagtcatacagagacacttattcaatatagtctttttctattctctgggttacccagcgactggatttggctaataaaggaggacctaagagttgatgcaagaagactccttcttcctgggggcacagtgcgcagcagataatgattacagttagcctctgctctgaaatctcttttattcttgccatgcctacacttagggttttcctttcatagaagatgtgtgtgtatgtactttctatggctattggccagtcagttcatgtcacagacccatgggagatggatgctttgtgcctcctaccaactggctgagagtgttgttttcctctgacactgcagctgacctcacaggcttcccaggtgtgcatggcatggcaatgaaacctcactggttggcagccacaggtgtgcatgatttgttttttcttttttcgttgtttagattcttgtggtaagaattcagcaggtgtgtgatgccagcatagaatctccaccctggcacagaggccagctgccctcaaaaaaaggtatttcttgttggtctcgcaacactactggcctgaatccctgttttcctggaagcctcacctaagggaaagactctgactaatgaattaggataaactaatcacagatgaacatgaagcattttttcagatgagtatgagtctccttatgtgaatgtactgtacgggtaggagcaggttacctggctttgaactcaagttttttttttcctagtttgaggtagtattattgcaattatagggatgtaggaaatcctggacctggtttccaaagggatataagccatcctagagtgctgttgttgacatataaatttctgctcacgtgattgagactaaacagtaggagcacagatggagagtgatcctgtgtggagttcttccatcttcctggaatctccccaggaagtcaccaaccctgggacccaaccagttcagtatagggcaagataaatctgaaggtcattccagacctcatctagccttaatgaagggtggggagagattagctacagtaacactgtttgagagaaccagagagcaagagaaggaacgcaattgctgtcagtctaagtcagcagtgtagagctgaagccggttaaccttttccagtcctctctctccattaccttactaaggcttctcttggctaggtcatgatatctaaagaaatagatgcttgatagataaatacctaaagaaacagaaacacacaccttagattactcagttttcctttgtcacagaccctttcccaatttttctctttagagtgtcacttggagtttatttgatgttgtttttacttgcatacacatttacttgcacaggtgggggcttagagggcagggagaccacatactgattttccctctggactcccacacctctctgaatataagcactggtgaggaatgagtcaggaatattgccccagaacatacccatatagtatggatattaaatagaaatacagaagcttgatgccattttgccttcatctccaaaagtaaatctaattgctaattcccttaggtaatagaaatgtaccacaatgccatggtgacacaggtcagagaagcatttgttccaaagagcagcagatgggatctataaatcatacttggggaaaggaggtgtcacatgtgagtatcggatagtcagtagactagtctctgtacctgcatcttaacttttacaacacagatatgtattttaacatgcactcgatatagagtcactagctgaagagaagcgactatactagcccagggaagtaaagattaaacatcatatgaactgttaaaatcagttttacgtctgttatccttttgcaatgctatttcatatccgtctttagctattgctgatgtgttaattagagcatcccttaagactatagttcttctatagtaacaaataaataagataaaacccttacactgagccccaggattgagaagggtcagcggtatgtctaacacttgcctagagcttactttatatccaagtcattatctcctgtaagagacaaggagagataaaaatagatttcttgcccaatggatgatactcaagaagaaaaagaattatcattatgtttaataagagaactgacaagcaatcataattctttccattaagtaaatatgttagaaaacatttattatgaaatgacacattatgcaagccaggaatcaaagatgacatccttgcattaaatacggtagatgccattaaggaaaacagtcaatatgtcaccaagccatggcctgtaaaaattaaattgatttggtaaatgtaagtaagatagatctgtttgctttcatcatcaattttgagtgggtgaacaggtgatgtcaccaacctgggagcgataaagatgcaggaccatctggaaaggcaggtgatgaatgggcaactgcttttggatagtgacagtgctgtggtactttgtcacttgggatgcagtacttaataacttttcaatgccatcataataaatttcactgccttattaatatagaaatggtgagttattaccatgatggtgagtgtaaataacgggagatgcagccgtcaaaagctgattgtttgggcatgtttctttaagcacacagttgactcgtgataatcaacctatgtctataccagtagagtttattgcacttgtcaaaggaaaaagtagtattatttaaaattatatgaagctgtaataaacaagtttaatatattatcagacttttcctgtaagtttccaaacatgaggcagtaaatcatttttgataatgtcttttcatgtaaaataatgtccttatgcagtaataatgtcctttcttaactattaacaaaacagtcgacttctttctatgtgttttaaagggtatttttatttgtacttttcaatcattggaactctgtggaatgaaacccttttgcaaataaagagctaaggcaggaaccttagaacatttcattaacaagctcaaaagttgctgagtacaggccatgtcacacgttcccattttaattgaacagatgtacttaagagtaaaccacagcaaacgcaatacagacaaaattataaacatgtgtcactaagaagcaagcaggaaagagcctctgatgagcatctgtgtgtattttatgaagccaaagactaccacttcataagtttgtcactgatgtctccagtttaatgaggagaaacaaaatatgtagataggtgtaagttgaagatgaattactagatcaatcacttagcaccattcagagtgtctgccattgtgcggtgggaaaataatgagatccgggatgctgttcttatttatatactgcgtgttcagtctcggggtggaatatggaaaacttcctctttcatgtcactgtggtctttatacagtttttcggccaggctgacttttaattctgacattgtctttcaggctgcagtctgccagcctcttaaatgaaatgcctctccaccatttctattactgctgaaaagagagccagcagtctattaacaggcaataaagttcaggaagcccaggactcatttcttgggtcagaggtgaaaattgcatactaaatgaaacaaaggtgtgccttgatcgctcaagaagcagcaccagaaagagcgcacgtgttgttagccagaagtctcccacttaaagggaaaggaataattgtaataatgttggccgatggagttaagtactcagttgagagaaattatatcaatctgacaaatatagccttcacaggagataaagtctctaatgaccttaaatgcatatatttatcatttaattcaacaagcctattcccttgggctttggaccaaatacatttcccctaaagtttagaaattttttagtagcccagagaataatggccatttgtcagagggtttcaaagctaaacacagttggaagcaaaggacaggagggaaaaaaatggctaatagagtctttccaccttagagaatattaatatgaagttttgttgatgcatgagctgcggtattttgtggctgaacagtaggtggcatacagggtagtgaagaaatggggaaattttaatctaagcgattttcatctgatttcattaacttccgaatatgtcatcagcgtacacagaacattaatttgcaaaaaaataggaacactaaatagtcatgaaatgtgctagttaaatgtggaaaaatcaaaaggatcccacagaaatggaagcaaaaggtctaatgtttcctcaggtaaagtgtgtgtgaaacagcaaagccccaagaataaaggggcccttgtgtatggtgggcttttcctcactgttattcttggtctcaacttgatgaagtgtattcgtgatatacacgaagcactgtgactcttgtgtctctctttgtgagactgtccatgcctttgttcctgctgtcagtcagttgttctttctcttgggcagccacattggtaaccgcagtatctacttgcaaatagatttctgtaaaaccatattatccttcaggcctttactcctagcccccacccctctttcctcaacaatctggccattcatgtggcatagctcccttgcttgcttctttgccatatgtctagtggtttgtgtttcagggaggctgtgtgatacactggaatgaaaactgggctgggtgccaggaaccttgaatttttgcacaagtcagacttgggaacttggaaaagtcatttgactttaccctctgaagtctcactcaggtctcttgtagctgtaactctatgagtcttcgaattctgtctcttacacctgctctttagttcttttcatctttatggacatgttctatattgtcatggttttggaggttttaatttattgttgttgttgagaaaagcccaccaacaacaataaacaaaacctccaaaataattacttttaatggcaaaactgcaattacttttacaccaacctaatatattggggcatgttttgagaagaatacaagttaactttaaattacatagaaaatagatacttgttttatcatttctcccgtgtgaaactagtgtctagttgtgttttatatatctgaaatcaaagcacctttgataggtgcatctctctctgcattttatatgttagcagagaaggtggcttaagaccaaagctttgttttaagaggaaagtaaattgtttagagagataattctattcctcgccatctttgaaaagatataggtatgaactgcattctttctcggggtatgactttagttcagcctcaatattgcatttgatcctctcaaatgtagcatggctgtagtggacttttgtcaacaacagcaaaagaggcagtataacacatggaccaagagcaggagttctagagattcatggactgtgttcaaattctctaccactgactagctttgtgaccttaagcaagtacttaaccacttcttgcctcaatttcctcatcttttaaatggtattaacaataggatctacctcatagaatttttgtgaatattaaatatgaatatttcattgtaaagtattgtgaagagcttagagcagggcttggtaaactgtagtgagcacctcaaagcaaactgattttaataatcatcatcaccatcatccttccaaagtcaagggtgctctttttatccttgtgaaggaaggattgtggaattcattcttttaggttagagctcttgaggttggcagagccaccacaccttgaattaaatattgtcccctttctgaataccactgggaagtggccttcactagacctaacatatttgaaacattgattcatgtttaaatggttcttttgctgaagactttagtaagtgtccctaaacagtgcacaggaggaggactaggggttttggcttcgtgtctaattaatttatgttcttgtagtgcggtggagcagggttgagagaggtaagagctgtacatttaaaccttcataaagcgttctccttcatccctaactccatgaaagaaaactctcttccaagagctcccttttaagggttatctcttttacttttttactaccccttaatttggcccccagcactcttgtgtcttgtaaactctgcctcctcaggcttcagccagagtgtaatctagctggttttctctagcatggagaagtatgatctagtttagagaactaggggaagatccgcatgcttttattccagttcattctctttttcagtatggactgacatggcatctttcagaataacctaataacaaatatgcctcatgacagcaagtatcttcccaaggcatcagtgttttgtcttaaatgaagaaggcatactccgcccattaacaagatgttgaccttattccatatgaaataacaaccctggccatcctgtgaatttgcttttttttcccccctgggctcttctccatcaatggcctgttaaatgagaatggctgtgagtcactgagaataatatcataactaaatatattgcgataaagtgtatggaagtatttcagataagtgataatacatctaatctttttgtacagtcatttgtttattcttaaatttttctttaattatggtacctggttgtccagtgagtcctgggactttctgggcagaaatttgaggattcatagattcagactctacagaaaatctattacagcttttcacatctaaagctatgctgttcatcattgcctttgaaccataagaaatgtcaaaaattgtaggagcttttttctttttttttttcttttttttttttggtgtaactttttttttttttttttttttattatactttaagttttagggtctgaggtaccgggttcatctcactagggagtgccagaaaggagcttttttcttacagagaaattccaaaatatatgctactggaaatggagggcaaactgcccaactcacaggatattagaaggggtatacttgaattatgtggttaaggatttatggttgaaagtaacagtagcccaaagttgagtttccctgagtgtaggtagattcttcctcaaggaagaacttgaagggcaagaccagttataggaggctctggtttccctggagtgtagttaactcctttcaattctcctaaccattaagactgaatgttaatgtctgctagcatctgcagtatgaactaaattgtcacaaaactaccacatgctatgattctttacttactcaaactctgctatagcctaaggtctctcttcatgcaggggcttccattgagaacagtgtggatttagtaatacatttaattggaatgtttaataagaagttagagcctttttttaatcttggaaaaggcatcaatcttgagaacaccagatgtgaatatcattttaacaagagaattttcactttgcttgtatcttccaaagcatggagattctcctttgaagatattcattctatagaatattgtcagcaatataaaggtagaagaatagttgagtttgactacagataagccaggttaaaaatacagaaagcacttgatgaaaatcatgagttgttaggattcaaattatagagctccaataaggacccctgaacactgatttttcaggcacattaccaaaggtactatactgaggtggtatatgatgtcacttggtgggcttcactcaagtgttcatttgaagtttgattccttactcacctaccataactgattgatagaaacatagatctccaattgactttagtttctgctccacagatctgttatgaatctcactgagaatctaagatacagttgtaaagtatagttgaagagttttggtttctatgtatagtccaactaagcacctcagagcactgattgccaattgcaatcctctaagttgtgttgagaaaagaaaaataagttatttcaccttcagtttccatgaaataggatgaagttactataatcaggtaaggtgacacttaaaatattaaaacttttgtaaagaaaggcaaaattatgatgtgatatgtgctatagacatagctgaacatgactgtttttaaaccaaattctggtagaatagatttagtagagttggtatgaggctcgaggattagttagttccagttgagaaaaatagatgaaaaagaagtactaattgccacagtaggatgttagaattcattacccacatgggtaagggttaaaaatttagcataaatgagatagtatttctaccatcagctgttcctcaccaagattctgttgctgtggatttgtctgttatccttttgaaagccacttacgtttttaactttgttataagtcttataagtttatgcagttctcctggaaaactttgtctatatttactctttcatgcattaaatagtacctgttaattttcgtgtaggccctaaattcttcctccctaggaggcccttaagcttagcagtttagaaaggagagagactgcctttgggacagttatctttttgtctgcttgtcctagggctcaaaacccttctaccatcttggtcttctgttctataaaaggaaaaggtgattttttttttttttgtggctctaaagaaggcatacagttcttgatgtaataagctggctctcgatacagtatttgaaacagggccactcacaggtagattacaaaaatgtcacaagaaaattatgtagtaatgaaaactggtctatctaagttttaaaaaatgagtgccctagtattttcaggaagaatggaaacctctatttaatataagtcctttggtcattgagatgtgtcagaaccctgccctttattctgaagtgccattgtgttagcgctgaaatgtaaaaataataaacagctgacattttaggcacagactaaacatcaagcaaatgacattacatcaaagctcttgagagagttacaagacgacaatatgccaaaagaagaaaagtgagaaatagtcacaaagtcttctgtttgcagtagtggatttgccagtgccagtgcatttacccatgcttataattagggaggttttgtttgcatgcaaaattgtttttcaagttggatttacataaggcgctggtaaagtgcataaaataacacatggttccaaaattcattcttatttttgttcattattaattaattagtatattaacttcaaagtgtgtgtggtgtgtctaccgtgtttgcaaaatgcccagagaatatagcagtgaaaaatgatagacttcttttcctcacctcttcctttttgcttcctttcttccctttttctgtctttattttctctagttttcattcatttatcttttcttttccttaggcaaatgtcagtgtaactccttttacctaatggttttggttaaattaattatctatctaatatatgtgtcaccttccttcagagcaaatattcataggatttgaccatctgaggcacaattagtctttttttgaggatgcaggtgggaagcacacctgtaattagtccttgcagggcatttgtctatacctgaaattatttgcaggtgttaagcatgtgcttatgaagaagggaactaggtatctgaggtccagaaaaaaaattgcctcttaattttaatattattttctctcttccttatgtcttgatttcttggaaagcaaatgcatctagttttaacttaatgtcctgaatgactgactgcaaacaggaggtagaaatggagctttggctcttttatgtggttcatgtaagtattctctctagctctgaggatctacttatatttgacccttttaggaaaaatgctgtaaggttttccagttttgaggataaaattgctcattaaaatctgtgatgtgtagcactttaatgaatgttagccacattttaaggctattgttatatagctcttagtgttcccaggattcctaataaagagcaaaattatctaaactatttaatgattactagtgggtattggtaagcttttttatgagcttttatgaaagcctcttaaccatatgtcatgtaccatggcataaaaaatagaaacagaaatgcggcaacaaggatctcaatgctctgttgacatcaaatttggcagattttgaaaattctgtgatcatttttctctttatgtgacactactcttgttcattcttcaaaaacatttgccttagcgtggggaattatagataatttgatgcaacaggtttaagttaccattttcataatgaaaagaatagcttagcatgatcctgattttccttggtttcctcccattctcaaaagaagcagaggtattcacatttctttgtctaacagttttataatgtcttaagagattaacagtgagcatgaatgagggcctacggattagacaacaaaaagcctgggacgtccactaccttgcttgcagattttacattttccagcattgctgagcgagtatagaaactaagaaaagataataagtaccagagtctcaaaagtgtttagtgattcaaaaaattcagatgacatgtcagaactgacagactgatggagccgtccgtggcagggcccacttttttgtcttatgttcggctctcatactgagtgaatgcagatgttatcgcggtaccccagacagacagtcagtgaaatgtgacaagctgtcagcaaagttacactacgttgattttgttaaaacatccacaagctttatagtttctttttatacaaaaaactcttacctcatttagtcaagaaaatggaagctgttgaggagatcacttgtgcttttattatccttagaataccttggttttttttctctggggaaattacacttagcaaattaagtagtaatgtaccccaagtcttgaatctcaaagtatctcacagtaattgtttttcttttgatttgttctacaatttttgctcaatttacattgcacctcaacacttggcaaagaatgtttcaagaacagaaggagtgaattttcttcatttaaattaggagtcaagatgagaggttaaaagtctgaagggccactttaaacaaaaaagctttcttaaaagaagcttaggcatggaaaatgaaactgtgaattttgagtaattaaaaactaagacctttgcttttactctttatttttaggcactgaaaattaacattggcaggagaaaaatccccatcaaaaacaaacattcaatcctttcatgaaaatcaattctgttttccatatacggtttagacatttagatttttcttataaaattggaaaaaaaaaagatgatattctagagaatcttcactgctatatggtatttatatctaaaagttagctttgcttattaagtgatcattttttgacatcaatttcaaattcaatttaactcaggaatttataagtcagaacaagtaaaacaatagttaattgagcaaaaatgtaaaaagaacatatacttggaaactgccgtcttaacggtgttgcttttactgataataatgctatcttttaaaccaaagaagacatcagtgatgacatttgactttaacatggcagtttatttttagcctctgggtgcaataattggttgttttttaccccatgtcaaagtgcttctgttgtctataatctatttaattttgaattacaagttgtttggtagaagattactttgcaatcctagtttccacaaattaacctctgtttatacattcacttttgaaaaccaaaggtgaaaggaaaacatgagccacacttgttgtgttcaatttatattgtcaccaaggacattaacatacaatgagaaactgttctgtgattttgcaaaatgaaaagtcaagacagtttgaagatagcatctagcccagtgtttttgtaaaacacagaactaaacaatcaaacaaaattatgcatatggaggaaatgatttagaatatgtttcgctgctaatcgcactcatgctgaagttttaaatttcatctgtctgctcagatctattgtgagccattaagtggcttccttttttcccgacaaattgaatgctgcaactgcaaggagctcttttgttcttttaattcagtcagcatggaaatgattttctcatttcaggcccttttctgtcctctcttcattgtgtcaataaaatagagttgtgcagagctgctctaatcagcttagagtgctaattcattgcgccgggatgctatctgtgtttggctacaggtgggcactctaaggggtcagtctccaggggagtgtaattgtgtgtctcctggggcttgtttgcagaatgacctaaagctgaagccccagctcaggaagggggggaaaaactgaacaaacatatgcccatgcaaacatatacagctgtattttcatggcatccatttacttggttcggcatcctgaggttctagcaacattccttgcattttacctgtcctcagcgttctatgattagccataaaacacgaattcttttaaactttgcacacattttctaaaggtacaagctttttggtatttccaagatacaagttaaaggttaggctaggatttaacctatgggtaatacgaccaaactaaacttaaaaagagaaatagaaactgccaattttgaaaaatatatcattttgtgtcctatgaaagtagcttaatacataaatatggaaatattatgaactagtaaattaagctttatggggactgaggaatttctggcaactttggaagagatataatgattagttttttggaataaagagaaaaactgtaggcattaggtttttgagatttaacatgttcttgggtagcctaggggaatggcagatctttctgggattattgttagtgtgagtcaaaaatatgctgtgaatatgaacttatttactggggtttgagatttttggtgttaggattaaaaatgctataacatcttgtttttattgttttctaacaatattttaattttttactttgatttacattgagattaattccactctcaatggaaaatcttcaggactttataactcacgttgttatgtaataactataagcaggtttgtgaagtagaaagaaaagaagcaataaaagatttcagctatgcgaatctactggttagctatggagggactgaataaatattctttgatttacttaagaaacttgagacttgcctatatattaggaaaaaaagtgtattctgcttatcaacaaaagaactggggggaaatgtcatactatttaaatgatttgagaagaaatttatagttatgttgtgatgaattcaactagcttcacaacatgtcagtttacagtttgtattgttatatatgaagctttgtataaagacagtaattggcttgtggaaatgcaagttcttaaaagatacctaagaaaaaaataaggttatcttcatgattagaagatagtattttattttaattttaaaattatttccctctctaatgttttggctacataccagctggtttggttgatgttataacactactgccttttggaaaagattctgaattttacttagctatttacattacttatttagggttaacttggagtagcatcaggagatgaaggcaaaaatatggcaacttgtataaaaccgatctttttttattgtcctccatttggaaacatttttatgtggggctccaagatagtcagaatttaaattcctcagtctcaattagagtgagttctccattttaattgttattaataattaatgatttttggtataaatgattttatttctaagcaaaaatagtattaacattattttccaaaattgatgaagtagttgattcacttaattttgtgttttaaagtgctttcttcttaattcccgactcattatcctatgattttctttctttccagataactgagttggaggcaattttagcattagctatctcttataaacagccaaatcctttggccatgcttaggcttatgtagcatgaattattcaatgagaaggaaaaaagcagtgttttagcaacttgttttggtgatttttatttttatgaaaataaattgtagcctcgtgggataaatcaacaatgtaacttcccttttggggagaggctctaagtcacatcagcatagttttggtccagacagcaaagctctaaccctcattcagctcaaatgggccaccaaagagagcagagagagataagattgtgtacttgagagggacatttttaatcaagaaattgtcatctcttcttaggtcatctatttccctaattcttttctgcgttgaatagcttcgttgcaagaaaaatgttggtgaaatgatttggtcctgagtcctattgcagaatgctctgagtatgggctcaaatgcctattggacaaaatgaagttggtttgtctttactgtttattatgattgtcacttctaagctttactatgatgtttatgattatttcactccctgaatgaataggatatgaaattagacattaaaaattttagtggtggaataaaattgttggtttggtttttctgctaccactaactcttaaggccatacttttccccccaacaagtttcagaaaaaaaatattgcaaggaatatttatgtgctttgagtttttacgttagacaactccacagttaaactaccacatcagagtcaagaagataatttcatagtaaagttagctaattactgagatagctcctttaatatgtgactcccacttgtagatacctagcccacatatgtcttttctggtgtgagagattgtttttataaaattgttaaaaatgaccggttttaagaaattattaacttccattaatatatttctttaaatctaactcagtgatcttctattagaactcaattattttctgccttacaggaaaatctacttgttttaaatattagtaactacggctatgtaaaatgaaatgtaaaagaaacaaaacgtatcagatttgaatgattctcctttccctgttttagctaaaaaataaaaataaaaacatcacttttacttagttctgtagttggcctccacaaaacaatttctagaataaatgcttatccttcctaaataagaggtcattgttgcagttttccgtgaatcaaagatgaatagggtccatctattatcaattcctcaatcagagaaaaaaggaaattaagttcctaattaggtgaatttggactaaagaggtggggcattgaagggataaggaaaattgagaggtagttgatgccatttcagactaatgataggagaggaaatgaagatgggggtggtaggagttgagcttgaaaggtcagtgaccttattaggacaagagtagtggtagatcttcaaaagcttttacctgcaataggctgacaaggcgtcaggttctggggatggtcaaagattcaaacacttgagaaagagtgtggtaaaaataagattacatattttaataagggatacatttgaatattattaacaaaagaaaaatgaccgttatcagctttgtaattataatttttgctgaatcatttttctatgtactttaaaacattcattttaggtattaactgggtttactttaatgtggaatagataatgcttcttttgagggttagacttcactgttagcataatgaatagttctcttatattaatacctactagaaagatacataaatacattactgtgtagatttatcaccttagatacaaaattgcaattattgactaaaatatctatcatatagatatgcaatacttttttatgtagacaaaactttgatttttccttaataattaaattatccaggtattcattgacaaaaatatgttaagatttgatctttagccacagtccttcagaagttcttcagcaaagggattgtcagaataaagtgggtacatctatattaagaaacaaaagataatttatataaaaaaatcttttcattaatgtgtttttctaaatttttaaaatataaacattgtaaagaatataatgaatgaataattctggtgttcaggaatgtaaatcggattagttagatgagaaaattatgagatttggggcaatttttaagctctttaggttatatgtgggttactagtactataattttatgaaacaacactttttaacatttagtgttctttattgagtagcatgggtgcttcagagatggctttgacctggatatttttatccagaaaacaagagatttttgttttattatgaaagacccccagtaaataaaatatttcagagtctttccactttaattctctctgtggtaaatacacagccatagacctgttattactttaccatccgatagagatataacatgagtcacataagtaattgaaaatgttgtaacagctgcatttataaaaagtaaaaaaaaggtataatttaaataatatatctaaccagaggatccaaaatattgtaatttctaaatgcaaaaactaaatgactgaaatactgtacctattttgtactaaaatctttgaaatctggtatgtatttcacacttataacacctcataatttggactagccacatttcaagcacttagtagctgcatgtggctactggctattgtattctacatagccttggaaaatctcgaagactcaatcttttacagtgtgattcagctcaatgttagttatgacagagaaggaagcactgaaagccactgtggagccatctggcccagcctactcattttataaatgaggacactgaaggtcaagaagggtcagttacttgctcaaggtcacccaactactttgggggtagagcttagaccaggttccaagtctcttcctgaattttaatttatttttagttctgttaaaatatgctgcttttgttggctgcttatgtaaaggtgttgacatgtgaagtgtaagagaataacaagcacaaaaccaactaacaaccaaataaacaaaatagggaattgttcagatagtcttgaaactttgaatgttgaaggaataccactcaggtaaaggattatttgttaagattcttgcataaactgcatatcacttcattagactctatcatatttttataaataaatattgatattataagtagatatattaattgaattgtagccattataaacaatttattttggtatctctctcagccccaaacaggaaaataatggcagggcttgcatttcattttacattgagttactggagtttttaacttggattgttgtgattgaagccttgataggaaaatgactgagtccctgtctcatattcattggcccacagagactcaaagaagaaaagatcgttcattcttctgcatttttctttccttagacaatatctgcaattaagccccacctgacagggctagtaaaatgctgccgattacaatttatctagaaagcatagacgggaaatatacaggtcttcttttacagaattggcagctgatggttattgaacctgagctaacattcccaaatgaaatgaggtggggcaatttgagtcatatgataacaatgttgtcatcctggagaacagtctcggtatgaatcagcacagttctgtgaaaattaaacatgtgaacaccaagcaaatgccacagaacctccttcagttacaggcatgcatacctgtatccataggagggccccccactagagcgtgaagtggcccaatgttcctggagaaagagaggggctgctgtcaccgactagacgaggtttgtaatagtatcgtcctgttttcactctccacagtagaaaatttctactaggctaacaaggcagagggtaatgagaaacatgccaagtttaaaaaaaagaaaaagagcaagaaggaggggtctaacctacgaacaggaaacaaatgtgatcaattactccaagtgtggagctcacagataccttatcttagggctccttaaaataaaagcctgattgttaccaaatgcgtctaagaagtgagggagaaaaacactgggggaggggggaaaggggaggatgagagggaggggaatgggggtgaacatgactttatattgatgtaaaaaaatgcagttccactctggttctcagtctcctgaagtatttagagaagtggttaacaaccaatcatagccttaactgtgcaggcagtaaaacaactcaatatttgaaaaataaaagtacccaaatatgacatgagggcagggggaggtagaccgaaatagtaatgtatcatgctgctgaagatgcagtcattctaaggcatttgttctgttcttcataattatttgactaaaatgttttaaagacagtctgttttttgaaatgattgcaaataaaaggtctatggcaataaatgtgtagaagttattaatcttttctttgactcagaattgaaatattcatttttacattagctgtctggcaaggaagtctacatataaaatgtttacttctcttatgaaataaataataatagtaattacagtgttaataccactcatctttaaaggattgctttgtagttcctgaagaagaacgaggtagaatcccatgaaaaggtgtgagtatattctactcatcctcaaatcaggagggaaatctcatagttaaggctatgagtcaggacctcagggctggtggatcttggctacatattccccaaatttcccataagtgcaatagaattaacactatccctttcttggagatcctgggtcagtaggtgttacaggattatgttatgaggtgtgactataaagtagtaagattgtttttcacactccacacccagaaacagcctctttttacttcagtgaataaaaacatactaatttttctaagggcattcacctcatctggtccttatgcacatgtgtgcacacacagacagaatctgcaatattcccatctttctccactctcacatacactaccactgctttctcagggaacattgacaaatgcatatggaatagagttatttcggttgctagaaatatttttttttaaggctcagtgtcttgctgggaagatgccctgtagataagcagagaaataatcgcccattttcagaggactttgttagaatggtcttgtcatcctgttctgcccatatttttccaattaagttctagcctgttggaatcgaatgtcttcatgggatggcagactgctcaagtaggctattttgcacatattctgtagcatgcttagcaatggggcttgtcagtcagtcaacacgtatttattgggcgtttatgtggcgaaccagacaaatccattccctgagctcttgctcttatgttcacagaggcctgtcatccacacagaatttctaatagaaattttctttttcaaagtgaactcatctacatttgaatcagaagaagggaaggtgagagtaattgaatgcttttgttatgggtcatttcaattcatttaagggtagataacttctcttgtagatatctttcagttaattctaactcctcctcattttttgtcttttatttgtggttagtatgattatgaaagaaacacatgcatatagtaaaattcaagcagtgcagaagtcttttttcccctagtaaatactccgtgtctctctatagtttcaacaatatcttgcatatcattccaaaaagtttacaggaaaatgcatgcacacacacagacattgtgtgtatgcggacaaaaatctttttctttcaaatgtgtacctatatattcacttatttgatttatttttgtagtaatattttggatatctttctctatgtagctaattcttttaaatatttatttaattaactaaacatacctgtctccatccactaactgcccccccatgaagtacaaccaatgtttttattgtgtatcatctctctaaatatatgatatgcatgtagaagcaaatgcatatatgttgtttctcttttttacattagtatagactgagtataccattctgcagtttgcttttttccagttaaccatttgtcttgctgatcattccatatccacatgtagagaacctcctcattctttatcaattattgtatagaattccactgaatggatataccataatttgtttaaaggtttccctattattaaacatttgggttgcttttatttttatttcttttttgctattgcaaacaatgccaaatcaataactgtacatggagcaaaagggcatatgcatttataactatttcaggttctgccaattttccatggctgtgctaaccaaccatggaactatatatggaactatatgctgagagcagcatatagaagtccctatttccccactcttacacaccagcatggtgtgtaactaagtagtgtcttggagtattttaaatttttttttatagtaagagtgaggttaagcatttcttttcatgtagttaaggatcatgtgtaatttttttttattctttaaattgtcattgaagtgcattttttccccctgtggcttgctgacataaaatgacttacccatggtcacatatctagttagctaccgaggcaggactagaattcagctatcgtggttattaatttggtaatttaatatttcttactgtagtacattaagaataatacgttatcatttgaatcctcccaaccttgggttattgttaggatcatatgaaataagttagaatgtgaaacaacattttcaaaattaaaaagagacctgcagaatgtatgatgatggttcatttaattttacaaagaaatcacaagatttaccactttgaaaatatgcagttcataatgaaaacagaataaatagtttgacctggctgcagtctgagagaggtaaggcaattaggttgttatgagccttctggacaagcagagtcctgattttactagcttcgtgctgacatgtatgccttgttttttttccttccctaaagaatggaaaacattgtaccttcacagagtgatggcagtcttgcttcgcttaaaacttcatcaccctctgcatgagcaatttgccttgttcttttaaaagtggggggaggtggaggcagatcatatttgcagtttttttctattagatgtttcaaaataggtggattaaatgaaatttgttcatctgtgtgttattgtttatcagagaaaaattcagaacttttcgataattggctttcattgttttcaccagtgttgactctagatagcacagaggtgtatgcagatatttccttggttactttatcgtgccatgtcgttatgtaaaatcacttcaaggcatttacttttatttatatttcatattggctgggcaaactgtctattaattttgtgtgcacatagcttaaagacattagcccatacacagtaatggctggcctaacttgcatgtacaaaagtggaatttaggagattaacttgcatttgacctacttcagctctcctggtaatgaggggtgcaggagcacagaattaatctctctcaatttgtggctctcaggggtgctgctaagttttagagtgcttgaattttaaaagtctcctgttgtgctgaggagtttttgctacccagtagaactctattgactattgtgattgaagtactggttttatctattgcagcaatatttgtggcaaatattatgaacgcacataaagtgagttaactgtattgtttggctcagacagtaaaatgggaaaaacttgggtcaaacctgtggagccatgatgtctttttttttcttcctatccctggaagtcttaggttagccaaaaatgcataagctttaaactgctttacaaatacgccagaagctgtcttttatcgtatatttgttatgcaatactgaggtactgctgctgggaaggtataagtcaagttgatataatttggattgattagcttttaaaagctttgaaatgacagtgcaattattgctatgatgcaggtcccttacagctggattaatgcatttagtgaacaatttggccatgtaatttatttctgtggagttcacattaactgttaaatgcatttattccccaacagtcgtattaatactgtgataatgtgcagcagtagtagcagggataaactctaagaacttctcagtcccagtttagtttcaaattctcccttcatttccactaatttttatcatgtagcagatcagtagcaaactatgtgatgtctcttacctcttcctcttcctctggctgtcctttaatacaggtgaagggatcaaaggttgacaggaagcctatggaccagaaatcaaagatctggttgcccccatatctgcataattgctcctcaaatttcagacagtggccttggccgttcactatgcagtggtttttgttttagaaacctcattctgactaaactcatagattatgctgagtggatcatgcttagtcagtagtttcagatgataatgattgcataactataaaaggttcctttgagagatcatcctgtttaacccttcattttactgatgaggcaagtgggtcccagagaggctcaaggtcatttgctagttggtggcaaaacaaagcctagaattcaggcttcttgacactcagggctttcactgggactcctctctgtagaatatttaaggttaccccatttacatctcttcttatttgtcccgcttgagcactttatactctttttagaaatgtgagaaacacactgtagttgatgtagtttttttcaaaatatagagaaggtttacatttagctctatctgggaaacattctgagagattttctataaataacccctcactatattacaacttccaggacactatgcctaaagtgataattttacacaaaaaacacatatatgtcatttacatgatatagacacacatccatacacacgcagtatagtattccaacttatgttcctttaaaaagtaaatggctacgaagctaccaaaatgtagtattttccttttattcattacaaagatcaatcttttattttttatcccaaaggaaaatactaatatttataatatttatcaaaatgcaatgagattttatattatttccaacaattttaagaactcgccaattttatgtcttcaggttagaaaaataagttattttgtattagaaaagcaatactttgagtctcctttggtaagtttaaagcaaaagtttgttggcattttgaatgtcaacaatgtttaataatttcaaggatggtactgcaaaatgtttgactaatttaagtatgttccaaccataagcattttatctccttaacatgtcaggttggtcccttaaaaagatttattgaaattaatatgttctgtagagttgagcgccagtgtatatttttacatatggagaagtaaatttaaaattgtacagtacataaaaggttttgaaaacagttataaagacttatttaggcagtgatttaaatttaaattaacagcaacactgacaattttctatttgtttagctattaacgaagctatttaacaaaatgttttgtagactccagttcttagactttttttcttttttaaaaaaatacaacattcctttttgattctggcgagtcaggaggaattcctactctgaagacagagccagagtacagagttaatgtgcagcagtggccttcttccttggaccctaagatgctggagccactcactgcacttttcaagcagctgccaacattgtcagcactgatctgtcagtaaggatttctcctggcaaaactctgaagctactttctgacatcttcaacaaactaattgttgtctcctgcctctgcgagccctctgaagtcccaacgagttagtgtcttctcaagagatgagaaaaaggactcacaaaatcaacttatcaggctattacgcattgtcatcagccaaaacaaaaacctgctaaagacaggagaaaaagtagaagaaatgggtctctgagaaaaggttacagaacatccatcttctctcctcttctgattgtttcctttctttgcccattttcatacccgtttccctctgttaaaagacactttatgacaagcattgtaatctctttagaacggaggggaacctcttctttaggacacaatctttgcaagttgtgagtgacagtgggaaagggtccaattgccactgaggacaccaggcaataaatcatcctcccctggcatcagctggctggacgaatccccacttcctgagtaagtaccagggcctagatgtgacaaaacagctattgtcagctcctagtggccacattcccactttctctctactgagattttccgtttactcgagacttttagtagtgcaaaccatattgggaagaaatattcaaataactaccattagaaagtgaaatatctgagagttggataattataatattcatctaagagcaacaattattagaggaaaccttctgttttcattttacatatcatcaagcagttgctttatcaccattaaaagtggcatgtcttttcattttttaaatgtttgatatatagagtagttctcaaaatgactttataagagcaatgtgcaaaagatcaggtaaaaattttataaataatatgaaaagatagattgctgtagtgataattttataatttggtagagttagggcattttcaaatagacacttttctttgcagtgattaagtttagatatactattattattaatatgcttgtaaaatactgtaaggggtaagctgagttccagttatttcatgtgtagttaaaaaccattcaaaaatcccaaatataacagatattttatatataaataaaattcatacaaaattattccaaatttaggaaataaaatttttaccataagtataaattatacatatttcattataaacttggttaattgctgaatatgtaatatatgacagcataagtactgaaatctgagatttttaaatagtcttataactaagataatttaaaaattatcttgaaaagtatatacagaacatacttatacctattgagaacatgctattttgagtggtgaaaactttcttgtgttttgagaacttattaaaaaatcattttattttaaattgttgtgggtgcatagtgggtgtatatatgtatggggtacatgagatgttttgatacagtcatacaatgtgaaataagcacatcatggagaatggggtgtccatccctgaagcatttatcctttaagttacagacaatccaattacactcttttattttaaaatctataattaagttattgttcattatagacaccttgttgtgctatcaaacagtaggttttattcatttgttctttttttttttttgagagggagtctcactctgtcactcaggctggagtgcagtggtgcgatactggctcactgcaacctccgcctcccaggttcaagcgattctcctgcttcagcctcctgagtagctgggactacaggcatgcgccaccaagcccagctaatttttgtatttttagtagagatggagtttcgccttgttggccaggatggtctcgatttcttgacctcatgatcctcccacctcggcctcccaaagtgttgggcttacagacgtgagccaccgcgctcggccccttctgtgtttttttttttttttttttgaacctattaaccctctccacctcccccgccaacctccccactacccttgccggcctctactctctaagtccatgagttcaattgttttgatttttagatcccacaaataagtgagaacatgtgatgtttgtctttctgtgcctggcttatttcacttaacataatgacctccagttccatccatgttgttgcaacatagatcttacattttttagcataatttttctcaaagaaaaagaatgacttagtagagattatttaaataacaaattggtaaaatctattaaaagtgggactttaagattgtattagaaaaatcctttgtttacataatgcttaaaattcctgaacaagtataaaatacagtctatcaccctggtctagttcataaacatttttgataacttaccatgtctgtctaatgttcagaatgcttcaaatatttgtcattatattgacaaaatatctggataattgacagattttttaatgttccacctgcttgtctcatgtagacacagctcatatctatttccctctgcaaaaatatattcttgtccaacttacctgtcaggctcttttatgattatgaagaataccttgcaagaagctgatggattccctttttatcccctaaatcatcttgagctgtcacattggagctgacacactttcattatcataaatacacacaatacacctctttacaatttagtaacaaatggctaaatgtatttttaaaacattttaattgtgtagaaagctatatctggtgcatgtttttctttttcatgttgtaaaatccagtgattaactgccatcttttaatattggtgcggtgatgatcataatatcaaaagcattctggcattatgaattcatagtcaaatggtgacaccaaccagatgagatgatggtgtaccaggctcgatgacagttctatctcagtttatcatcttaactaaaaaataatcctatctaacttgaaatccacagcagctataagtagaaaataaatccaaaccacagctcagacttgtaacctaacagctatcataaataatcagagcctatttgaaggtggaagatgggacattagaagctatttacactactagagtgatgccatcgatcagtagcggcaacccgtagataaggctcctatgatgtcatggttatttatgatgggcattgacagtaaagctactacggaattttctcctcagacagcttcattcatttttgtttgtgatgcattttgttattaaagaagcaatcaatagcaaaaatcgtggtgataaaagtattacttgttaaatatgtgaaaaatgtgcatgtatgtaagaatgtgggacaaaagatgaagaatttaaaaattcactggcagtgtttacgtgttccagctacaaatacataatagattcatttcacatgtcttgggctttcaaatgtggcccacttgttcttcctcttacatcctattctcttgttagaaagcagagttaaaatgttgtggtgccctcccacttccccccacatcatatatttgactcactttagacaatataaaatttaattagagaaatcacatgtgataaagacaaacacccattactttgtacataacccatctatatgagagcaaatttggtgatttcagtttagtttttttttaaatgtcattttttacttgttttgtttccccccatcctgtagctcatcttctattactgaaaatattcactagaccagtgcttctcataccttaatatacacacacatcagctgggaatcttgttaaaatgcagtttctgtcgcagtagttccgggaagggcctgaaatccaacatttctgataagcacccaggtgactcaatgacagtccagggatgctggtccagggatcacacttttagcagcaagacactaggtaaggtggttatttccatacattgcagtcttcccttcaaatcatttgcctgtatttaaaatggatgtttttctcattggtgtagagcagtggttctcaaactttagctgtagagagccatttggagtggttgtttaaacagatgtctgtgccccatccccgagtttctgattcaataagtctggggtgagcccaagaatttgcacttctaaaaagttcccaaatgaccacatttttgaaaacccctggtgtggagtcctaatttaacattcacatgacacttgaagcccttatgtaatgctggcaaggtggtaagttataagacagataataaaacaggggaggggaattaacatttgttgaatgcgtactgtgttttaggcattgtagatgctaacgacctacattatttcatttgtcttacctaattaccttaatttattcaatattgattttggttctactctatataatattttctggaaatcattggaaaaatggcctaaattctcatagtgccataaaaacaaaattcttgccctgttttctatgtggttccaaatttttactctgagaatgtaaaaacatagctttttttccccaagcccccttttcctatcactctcttcctcccgatctgctaagacactatgagtaacgataaacagcaaagacaaaaaataacataatctctaccttctaggggtttatagtctaatgaaggaggcaggaattctacaagattgtgtgtagtataacagcagaatgaaattcttgtgaagaagtgcaaccttgcatagaggaatgagatccatttctcaccctctctccctttactctccttttcttgcagcttctatgcttcccaacacacacacacacacacacacacacacacacccctaacataaatacatttcctaaatacctataattcagaaaaaagtgttatctatagaaaggtttctttggcctaaattactccagttttctgatagccccagttcacaccatttcaattcagtgggtttctgtgaggtgcctaccattccagatatttggggcacagtggggaccaagacacagccccagctctccagagttgacagtctagggcagggagacctacaagcaaacaggcagttacgatacagggtgataattattacactctgtaaggcggaggtgctatgagacctagctcagtttattaggcatccggggaaacttcttggagaagtgaaatctcagctggtgcctgaagaatgagtagaagttcaagggaggggaggtaggaactgaggagggccaggttcctggcagttgaaacagcttgtttaagagcctccgatcctgagggagtctataaggctgtagatgatcaagtagttcagtgtagctaagcacaaacaccctctgattatatcgcaaccaaataagtgctatgctttaaacatgtgttttgtgaatatgcagcacttatgaattctcttgtattcttgataaagggaataggcttttgaaaacctatttttctttggtaaacagtattgaaaattagtcacaaaggacagataggctatcactcagggttggttgctgatatcatctttattttcctgtaatggctgagtatagattatattaaacattagtcaccatgtgaaaaatacactttgacacacagacacatcttttcacatctatttgtgtagaaggctggaggtcaagcagggggcaatgtcatgttttaacaatgcccttttataaggattcagttccaggaacacttcttgggcatcttctgagtacacagtatttggctcgggcttcagagttttgagggcttctagaagacagggactttgtccatgaagcatgtgtacattcctggtttcaaggcaaggcatacacaggtaaacagcaactggaaactcattcccaggcaacaatgaccccctaggggtttgtatcagggccatcagttatttttttttcttattacagtgacattttgagttaaaaagatggaggttggtattaataacagcaaatgtgttcttgaaactgacaaaaggatgcgtgtcgggaatcaataaattgaaatctcttccaagcttatgcttttgaaccacaggtctgagaggtctcattctagtgtaaatcacagagagtcattcagatgtatgaatgtagaaatgtcctacagtagcaaggaaatcttactaattttccttcttgcctaaaaaaatttatatattgtatacagagattaaatgttaacaatggtggtgttctttctctctccctacccaacccttaggtctataatttaacttattggctaactaaaataacttctaaattaagcagtgatttcacataagtagttattttccatagatgataaatcttattcatggacgcaatcatacatgaagacagaatcacttcctatttcattaaaatttacatataaaacttaactactttgtctttttaaaaaatagttattctagtcacttgcagagtatcttgcattgaatttctctcggaaaaaatatctaaagttactgagatgtttctatcaaatattacactgtggtaatgttcatcaagccttttatggatccttgatttttacataaaggtagtatctctgaaacaaaatgctgttactttttagtccttttcattgaattcatttattctagtggtaatgcttgattatttccaagagcattgtcaagcttttaataataaatattggagttaatttaaatgagtcaaagttcattctcatttagcagccatctatttaagtaatttacctgcccagtcattcccttctgtgtagcaataaacggaaatggctggaaacccatcacaaaacttttaaggaagaaatacagtgttttaatggagaatccttttaaaagcatgagacaaatggcctggaattgatgcatattaaacatgtattttatttcaagcactgataagtgaattatattgagtttcttcagatttaacattatcctcagtaaaaaaaaaatagtgtaacttttaatgttttcattgcaatgctttacaatattaaattttttttcctgtaggccatgaggtagtcctttgtggtgagcttttatttgatgagagagaaacattgtgtttattaatatttctcactttttacaggaggctctgcttctatgacttcatttggccccccagaagctccctagattgtactcaggaaatgttattacaagactttgtgtcatattttttgaaaagatggtttcctgtgacttacatagaatagtgtatgatttcactggaattttaacatttctgcaaaaagagtaaagagtccaagtgggccacaattactattttatataaaatgatattagaaacagtaacaccaaagatgaatccagaaagccattttgatatctaacaaaaccaaacgctaaaaaatcgcaaattctctaaaacatagtttgcataaagtctgccattgccttattcctctaaaataattaagtaatatataatgtataggaacaccaaaactaatttttctgtttctaaatgtattaagataatatgaaatcatagtttagtaaaatggatttctttgttttataaattcattatatacatatattaaatgcaatcataataatgaatcaaatgcaagcatgaattacccataaaactgactgttaaacttttcttccaaatcattttacatgattttgagttaaaacaaataaaagaaacataaataatgaatacatattataacacagtgtaacaaaaattgaggtgtttcaactattttaagtcctatcaactgtggggttctgaagtcatcttttactgtgtgaatctcagttatatatttacatacttatattgaggattgcacttatggaatattcaaatgtcttctctgctttccctggaacaaactttgcccatttcgtaaaagttcttccccaaccttccaagcgcacgctgagctcacctcaatttttgacatgctgaaggagagccatagagggacagaattgtattctgtttcaggaaaaggactgaggaagattatcatgagctgaaggaaaatagcacagagaatacagaaaatgccttctttcctagttcaaaattaaatcagtcttcatcatcacaaatgctgagctctcagcaaatagttccaaacttcttactagtgcaatttatttgaaggctgtttttgctctgttgttttcatatggcttgtctgatgtgtgtgagtagttttgtctcatagccaacttctgcttccttgttcagtccagtggtgagcagagctcaacattcatagtgaaaaatagaatgatagccacctaagcataggaatgacaaacccctgaaaaaaatgaactgcgttttgtataaaccagtgggggccatttctttcttatttgccacaggccagcagaactggagcccttttagaattgtaacactatttttcctcttttgaactctctgttacctctattgagggagtgcagatatgcaagggaagtctaaataggtaactatgtaattaaattccaaagatagaccccatgatggtttcacctgtcttatctgaagaattgcatcttttccattacatggctcattttctccttagactccacctttggtgggccactggctccaaagggatacatgtgattatttatttgccactgtaaaatggcaattatttatttgctattttcttctttttcctgattaattcaacaaacaagttttgaaaatcacagatgagttggaaatatttgattgtcttcccagtgtacttattatacaggatcagcatcctctctgacctcaactatttctctctcgcaatgaatgaccttctcctcatcaaccagcgttctccgtcttctgtggttcttgcaggttggaatcacctgaggagttttaaaacttctgatccccaaggcccatcctgaacaatcaaattaaaatctatgagaacaggatccatttatcagaactttataaagctttcctggtgattctaactttgagaaccatgtttatagatggaatgagctaataatgtccggtgcttcaccgtattttgcatatgtgttaatttgaacccaattagcacatcaacaaagataaaattattaactgcattgcctctttctgtacaatttccttttgagcagcagaattgattccagaacaatgatattggtgtttaaaggaggaaaatacaaatgagtagctaaaaatagttatgcaaattgactggatatattagggttaataaaaccaataactaactctttacagatttaatcctatgagaaagcagaagagagccagcaaaatttgcacattccattctagaaagttttttatttatttttttttaagaaagtgttattaaaagaaagaaaacactcagaaggaaggtctagagagatgcctcaaaaagagtaaacagaattgctaccgtctgggtttgctcttatgctttaaagacaaagaaagaaggaaggaagggagggagggagggaggaaggaaggaaggaaggagagaaggaaggaaggaaagaaggaaggaaggcggggaggtagggagggcaggaagaaaagacaaaaaagtagtgaaaagaaaagaagtggaaagcacagttgttatgtagaactcctttttcctaagcagcacaaaaatgatttgttttcatatttgtttgttttatattgattttgggttttctttacctgcaacaatgattgctaaaacattatattatcataatataaaacaagttaaaaaattaaaatttgtatttacttgtaatacaaataatgtgaaaatagcatatctgaaacttttattcggcaaataatttgcttttcattgcttagggtagtggtgttggtgtttagttttgggatccagccttgaaaataagaagagatcaaattggggagggatgtcaaccaagcaactggccaaacgaaaattcccccatctccctaatgtttattgtgggtaattactatgtctccatccttttatttattctatattttatttaattcctaaaatacagtggctattttctccttctcgctggcttggccaatcacagctatttgcagctttgacatggtgcagttgatggggttaacaggtcacccctctgtatctcttgtccctccacacccctccccatcatgtctaacttcctcaaaactttctctttttttggcttcagccaatcctgatgaatagttgatgctagatgtgctttattataaacatgtataatttgtaggcagacctttatattcttctgaacatgtttggtggtcagacataaaggaaaaggatattattaatttaaatttcataaagtgaaatgctatgtttttgttagaatatcatatttttctagaaaactttcttttgttaaaaagtattttttcttcaatgctgtgcttttttttcttccctagttgtttgaattataatggcattccttactaaatttttccactgtcactccatgcatgggttagcatagacttggttaatttgttttgccagtgaaattaacttaccactaagtactgaatctgaattatttaagacaaaatatcattaaagtataggaaaccaataaatgcactgatgaataagcattgtttactgtgtgtatgtgacatttcacaaatgtaaaatgtctattcagatttttatcattttttgaaatgctaaacatgaatgcaaattcacatgaaatgtcccatatggtacagatgcatctgtaagatatgggtatctgtgtatatatgagtatgtagtaaagtcgattgtattttgcccttatattgtgtaaaccatgtacgtaccaagacaattttatacatgttatatcccttcctcttgcatgctcattaatcactgagcactaataacacatttttttgtcttggtacaacaaatattctggctctgactctcgttctggctcatttacattggcctgcctgtcagttcaaagcttcagggaattaatattacaagattaaaaagtgaagtcccttaaacatcccatcttataaacttgtggttagttttgcagggagaaaaaaaaaataagccttcgaagggcaaggactttcaactttcttggccaagatttcccctttccttcttccctccttttccctgaataatgaaagccccagactctctaggacaaggtcctacctatgtcctagtaatgtgactttcttaagagtttccccctgagggatatgtggttaaactgtgatgagcttctgcagtattttggatgccacttccctttagtttgcctttgatttgcactttttatctattttaggataagagtctgtagaaacacctcaataatccttttttttttttttttttaaataaaaaagaaacattttccacagccatctggtttctatgtaaatgtatgcagtgactctggagccatccaaatcccagtacgcatctcacttgctcactgactcttttttggagaatcagaagaagaatcaaaagcctctttgaggattacagaaaaggaattccacatgtgttagtgtgtgcatgtataggcaatttattttagagaaaagctccactaaaatcaaatgaatataatctaaacatgcttttaaaagattaaaataaaaagagagatgtatctggaaagccctttgaatttttatagtagggtcaatttatgtggttcatcctatgtattttgagatcaatcttcagtgggacttacaataaatgatgtgtttaagatttctatagtcttccagtgtgttatgacacttatgaaactataagaaacactcacagtaagctattcctgccttctattatcattctactgtaagttatttctgtagatatattgttttcaagtttttattatataaatcctctttattgctttttcatggggatgataattaacacttttatggctgttgtgtattacaagtatctttatatataacattagagttcatattcaaaaccactgtattaggtaggtatggttcccagtctttaggtgagaaaaaactaggttcagagagtcaaaacccagacaatcagtaagtggtaaagttgggagcttaaagtaacaatatatttagattgccttttctctttattaactgtatggccaatgacaatttgtttgacttttgtaagcctcagttttctcatttgcaaaatgagattaatatctatatcttggtggtagtggtataaggattaaatgtaatgtatagttaggatgtttgtacagtgtctagaacataataaacagggtggggtagtagttattatcattgatagtattattagaggcagaagtagtcacatttgtggtggcataataatcaacatcattatctaaaatttacctatactttagctgtaaatatataggtaattgaacactacaattgtcatttatagctctataacttacatatatatttctatatatagacaaatatgtatttatataaatttagggtctgtgcataagaggataaaatgaaagctttattatcgaagttcagtaaaatgtctttttataatggaagatattacttaaatgaaaatgtcacttattttggtaatatgaaatttcttttctacagattacatttatttttttttggaaaaaggtcaaaatcaagaggaaaaatatggattgctctaggcgtttataaaaaaacacaagaaaacttattttgcttaaccatttcagatgtccatgcaaatttccacagaatcggatgttggaagagatgaggctataatctatcatcagtttattaagattgttatttgctcttttttaatcttttagacacagactgatggaaatattatatttaataattttttttctgtgaattctactgtggaactcagtcacaagtttgaactagatgtcattatgttttcaaataatagttatctgagctccaagcagattctttcctctacttgcaaagactttccctcttctttgtccagttaattcctaatcacccttaaaaattccacctgtaggctgggtgtggtggcttatgcctgaaatcccagcacttagggaggccaaggttggagaatctcttgagcctaggagttccagaccagcccaggcaacatagtgagaccccatctctacaaatttaaaaaattagctggtcgtggtggcagatacctgcagtctcagctattcgggaggctgaggtgggaggatcacttaagcctgggaggtcaaggctacagagagctgcgttcataccactgtactccagcctgtgcaacagagagaaaccccacctaaaaaaaaataaaaatccacctacccatcccctttttaagaaagtcttcttgactcttgaaatagatttagatatttcttttgctgacacacaaaacactttgtggatacttctatcatggcccttgccatgctgcatggtaatctgcttacttctctaccccctcacttggttcttataggtcgacacactttcttagtcagctttaaatgctcattggcatattgtacataatttaaaatgctcatgggatgagtgggcagcagcgctttaacagtttcccctgtatccagaatttttgcagaattcaaatctaaaataattttctcttaaaaatattgcaatggaactcctctttgtcacccatttatataaggaaatactggggcagggtaggttataaaattcaactttactatgaacaagaactggctcaggaggcaatataaactggacagagcgagttagatggcttcattcagtgggattccaacagctctccagaattaagaattaagggcacgtcttagtgccttagaaaaggatgctcaatggttcacttttgcacacagacaaacaggcacttgcttgcccacactccccacatagttttgaaggtaacaatgtcccaagcattttgagacttcttctttggttaatggacaaaacagcttccgaaatagaagcattataggaaaattctaatcttgatctaactcagcaattgaatatagcttaaagcttatagcataatttctgggccacctgatagactgacttcaattattttttgaatcattagaatgtagcattgtaattaattttttttcacaaatcaagtgtaataagatgaatctctaattttaaaaaaagttaatgtttcccaaggctaaaaaagagaaatgtgtttgttttcaaagataatctatgtgcatattcatcagtatgtttctatattgatgttaaataacatttctttacttcggaatgggtagcatcaccagagaggattctgtgtaaaactcaggatactaggtaaggagctaacaatatctaccagtaggttccgtacagtattttgaacagtaaaggatcttcttctaaagtcaggtactcagatgtaaatagcctcaagtctcgtgttttatattaacatggttagataatgtattccatgaaatattttagaagctctgacaatcatgtctccaggtgtcaagtacaacaattctctatcttataagcgaacaggaggttgaccttgttttcccatacaactgaagttgggagcgaggccctgtagtcctaacattttcatttagtaggtggacattactgaaaaaaagctactagacactagtagaaaaagctgcatcagctttttctacaacatttaattcatattgcattcagtgatccaataatttttgttcctgcacactatacattcatagacattggttaaatgcctatcaaatttaagtatattttaacaaactaatagcttccttttccataatagaatgttttaaaacactcacatggtgcagaataatttagttcagttatatgatgacaagactaaacaaactttctctggagttctgggtttttcatttcgttactttgcactgagcaagcaaatagagatgagctatgaaattttaggactttgccttgaaacacgatctagttgacttataaaatctgagatgttgacaaaatgtgcagtcaatatccaaataaatgcagttacttcattttatgtcaacggagaaggtgaaaagtgcaacttaactggcttggtaagattggaaggaggggctgggaacatacaagagacaacaaagagatagttggtaagatttagtggcttgcttcatcaggggtggtgagaagccagtgtgacaaagttcagtcgggtcaaacaaagtgcagaaacttcctcatagacactgaaaggagggtgtagcatggaaacaaaatgctcaaatgttgtaatcttgagacagctaaaatgatagtcgatgtgctgtttctgtctaatcctgctgttccttttgattcaggaagtagagaaatcaccttatctctcatgtaccagtatgatataattaaaataggacatgcttttgaagtgaagtatttaagggcttcaaagaaggtgtggagtgttataggatcagcatatgtctccttctcaaaggcagttatgaggacacatttatttaacaaagacatccttttgaaagaggaactgcctcagtaatgatagagtgtgtatgtaatgtctatcgaattatatacattgccaaagatatatgcagtttactctctgacctagatcttggcaaaaagacaggtcaatgtttttatgcttttttttcttttttttttttttttttgagacacagtctcactctgcgtcaccattgctggagtgcaatggtgtggtcttggctcactgcaacctctgcctcctggcttcaagcaattctcccgcctcagcctcccgagtgactgagactacaggcatgtgccaccatacccggctaatttttgtatttttagtacagacggggtttctctatgttggccaggctggtctcgaactcctcaccttgtgatctgcccaccttggcctcccaaagtgttgggattacaggcgtgagccaccgtgcccagccagctaatttttaatttttattttttaacttctgtaagaaaatatcatccatttggctaaaagatacataattttcattatgttcccaaatcaacctatactaccatatgtacattaccataaattcatggtaatatacatgaccataaatgcaaacaactaaataatttttgttttgcaaggtagagcatttgtttcagatgagctgatgtctatgattttgcatatgtggctatttggcaagccttttgcatctgaccctatagttgaccttggaattggcttactttaaccatgatggatgtaccaaaagatttatttttgtcatctaagagttgagtcctaggctattgggagcataaagctgtttattgaaagtaggcttggcaaacctttgctttcaaataatcttccagaagctcatctaattttgctaattagaaggagataaaatatacccacattgtcctttacaatgacttgaaccctctgcccttccttgatgataatagtattaaacatatgtgtacttattgcattgaatattaattaacacgaactgaaaagagagaattttgttacacacccaaacatattcatgaaattaatatttaatttcacacaagtactttactgtccgtttgaaggtggtaaaaatagcaaaggcaacatgatttttaacttgctgatctacaaaaaaatgtttaaatagactccgattattgaagcctgattttaataaataattcaagaatgaaagaacggtcatttctgtgggaagcaaaaggagaccattcaactagtactgaccttgtcactgaaaattaagttctttctctgaatccaaaaatcaaagcttaaaaggccactctctctataatatttcattaactttttgaaatgaaatacctattgattaggttttctttcagataataaattctacatgtctaatctgtcacttcaattacagtatttacttgtacacaaggaaaatgtttttacatgtgaaattaatagacttttccaaataacatactgtaagggttcaggtggcataatttttcgtttctttgaatagaatatccagagtgcatccatcttttctcttctaatgttttgcctgtgttgttttctgcctagaaggctctcctctctctctgtcccctggatccttaacaagatcctagttatctccaaagcctagttcaactgttgcctccaccgagaggcttccttgagctttttttctaaacagaataatccctcctctttctctgtgttccacagccctgttgacacacaccattggtgtggcccttattgtgccatgttatctctgccctaggctggcttctaagccttttatggctcatctttttcatattgctatgtctagtgcctagcccagtggcaggcacacagggttgttgaatttagtgctacacattatggaagctgaaatgtttgttttgaccctttggtttgtatttcttcttcgtagaaatcaacgcaacttcatggatctttatcttttaatagtttacatgaagtatctcacatctggcaactatcacccccgacccaatcataaataacattcaaagttatttaacttcctttattaaaggggagctgaaaggagcagcagactttgttggccaacttctagaaaggaaataaaggccattcagacgtcagaagattgtatatgttagttgatacagtgcattcagtgttcttaaaggatcaaacaccaagttagtattgaactcaattttccatcttcttcaacagtgtctaagttaagaatcaaagtttgttggtgttaagatgctttaaagtagaatgtcttggggcttcacatacccttcagacacatttatcctaagctaaatttaccctttatgaaggggacaacttgaactatttaatgcaccttaaaaagtggtggtgagaggtagatacttttcagttgttatgtcatggcctttattcagtatttctgaatcctcttacagatagaaacacttgcaaacattcatcgggaatttggctagcagaatagtaacccaccagccaaagcccacctcatccagtttccagtggttggttgctagaaagatattccagtgactgtccgaaagcaaaaacaagcggacccgtagctgtgctcctgttctgtgaatggtgtgctccgcagtgtccacctcggggtgcttctgtgcacctctgggcccaaagctcagtgaaaacttttcactattcataagggggttctcaaacccatggtaggttagacttcaagatctggttttgatcatcctagatttagtactctgctgcctggaaaatatgagctgtgagtagtgtgaagagctgttactgtaggacccacagtttgcaaggtaacttcaatctgtaccaggtgtgatttgattttgctgagatgagggagttggcagagaagggaggggggtggtagggaagaggctgtggaaataccctcagtaaaaagtacccagagttgaatcttctagctgtcagaacaagttcttcctggcaaactgcgttaacggcattagccccagcccactgtcctcagtctcttcctgcacttgtaggaggaaagttggttctaagtttctgttatgctcagtaatgagacagaataaggtgacacggaagacagtgaaccagaggagggagaatccgaggatctgcaccgagtccctttcttctagtcattagctgggactttggcacgttgccgaaattctcagaaggtcagtttgttcctttgtcaaataataattaaatcttccctctacccagagagtttcctaaatgaacttttgaaagatattgtctataaaaatatttcaagacctgtaaaaaatgtttttgacaagacagatgtgaaagtatgcagcagagcatgtgtgtttgaaatcctccagccatgaagatgattttcttaaaggagaagtgtgtatctcccgttctcatactctgactatccctatacttctgacaacttctaggcgttggtttctgtgaacacaccttggtcactacacgagagtgtgcttggtttcctcatcagtaaactggggacaataatacccacctcccagggttatcgtgaggatgaaacaaagcaacctgtgtgagcacagagcactataggagttcgctgaatgttagttcctcactctttcctctccacccccatgcccctactctggtgaaataaaatccttcttgtataactcaggaagccccaggaacacattcctgcaagccatggaggaaagaaatacttccctgtgtccttttggagagagctgggcttcggctgggctgatgtcatagctatgctcctggctgccttttagtcagaagagatgttagtgtgctgaaaaatagccaaggaggcttttttcctctgcatgggaaagaagacatttttgtccatcctccaagtcttccttgcacagattactgtcaaacccaagcactttatttataaaaatgccaacatactctgattatttggcgaataaccatgctgctgtcagtgtacaaacagcacatagagtataaaaacaatctccatttttatcatggctgtcacagctgggaggctgtggaacaaggatgcattgtttgagggaagggctgtagaggcaacattcaggtcctttggtggcctcctgggcagaaagactgtggtcacatttggtaaactgttacatgttcttttactgaaaaacattaggcttgccataaattagtttctgggttcaatattgagatcttgacatactgttgcttttagataagcattccctggcctgcctgtctgtctgcctctctcttctctaattcataggccgtccaaatgcctacgtgcttccatggaacaggaagacagacccagtggctgtgcaaccaaaggaaatccatcattcactgatgaatttctaatgacttcatattttactaccacatggaactcccaaataaagcctctagaagggaaacacacacccaatactgggggaaggaggggtaaagaagtgatggccctttactcagcactggtttctgacctcctcaagctggttccttctgggtcaaggtagatcctagggaggataactctcctggtttcagtaacagttgtgaagcatatgtgtgagtgcatatgatgactctgcatgtctaaggtctaacagattggtcccaggatattacatgttttccctggaaaaccatttctttttttcctaaaatgtgtttcatcattgtatgagctgttgctgctgctttttttttttttttttttttttttttttaccggagtcttgctctgtcatgcaggctggagtgtagtggtgcaatctcagctcactgcaaactctgccccccccgggttcaagtgattctcctgcctcagcctcccacgtagctgggattacaggtgtatgccaacatggctggctaatttttgtatttttattagagatggggttttgccatgttggccaggctggtcttgaactcctgacctcaggtgatatgcctgactcggcctcccaaagttctgggattacaggcatgagccactgtggccggccttttatgagcttctcagtggatgaattggtatcatttacctttagtaggtactcattggcatttgctgtctttataattttttttttctttttacagtggtgaacactccaggaagaattaactgtatagtccttcactcctcaaagaggaaactttattaagttgttcagttggttccatcctgataagtcttggtcaggcttgggaaaaaagttttcatgtgatttttaatgaaggagttctttacacctatagcctattgagagactagtgagctgccaaggaggtcaatgagtatggagaataaagcggtatacaaaagacaaagccctagagcctctttgtgaatgaataaaataaaattgggtgttagcccttgcacctaattcccaatctggccaaataggtgttatctttatacctctattggcaggttccatcacatctcaaataaagaaaataaagaagaaaaatatttgggtctagataacatcgtggggttagaaatactctcagtaccacctaagaggaaacacacacgagattcagttaattttcatgctaaatccaagtgtcatatcacaccaccagaaattcaagtaacttcttatagttcagaaataaatgatggtgttgacaaggggtgccacatgtgaagaaaccaatattattttgtaagattatgtaagcaaagctggagatacatggagaaactgtgtgtcctttaataatcccagctctggaaggacagcctcagaaactggaaaaaaaatcacttcggtggctccctgtgttcttcagaaagaaatccagtttcattagtttgatatttaattaggacagcaaccatgagtagtgtctttcctctttcctttccaaaaatgtctcttccactgtcttttctagtgccatgtctcatgttttggtaaaactaattgaaccttgtatctgtactgctgttcatgtttgacctcctcccttaagtgttaagcaagtcctccctgaccacgcttgtcccaccctccctccacaaaaccacataggtccacattccatctccctgaagagtcactgcccaactcttcaaggctttgtttagctaccttcttttctgagatacattttctgatcagattgaaccagttaaaccagatttaaactcttttttttttttgagacggagtctcgctctgtcacccaggctggagtgcagtgttgcaatctcagctcactgcaacctccaccttcccgggctcaagtgattctcctgcctcagcctcccaagtagctgtgagtaaaggcgcgtgccaccatgcccagctaattttgggatttatagtagagactgggtttcactgtgttagccaggatggtctcaatctccggacctcgtgatccacctgccttggcctcccaaagtgctgggattacaggagtgagccacctcacccggcccactctttgtattctaacagcacttttcctatccatttagcatttcacaatttacttttaatgtagtagtttatattttttgtccaataagttttacttcttgagcatagactgtacatccttccagtgtcttagatatgaatgttcatggaattatattagagtggtggccttcctatcctggcatggctgtacttaccaacaggaagcacaccagctttgaagcacagacccattgccaaatcccctcatggagaccctgggttattttctggtaagttattagcccctctgagcctcagatttctcatccagttactggcagttcatttataaaatatattctagcacagaacctagaaagtaatatatgctcacaaaagggcagctttttcctatcactccatcagaatttcttagcttatgtcttcctgtaataatgaagcaaaaacaaaaacacaatataacagttctctacagtgttgctcaaaatgtcaaaataaagatgtggccaataaaaaagaaagaaaatacagtttcatttcactgaattacaatattgactatgcttttcaaaatacacttgtcccctattgaaattctaggacgttttcttgaaaatattatgggttcttccactggtggaccatcccattcccttccttctttcctcttataccatgataatcagtgcactaaattgtaagctctctgaaaacaggggggtcattggctttagatctgtgactagaacctgggaaagggttagtctttaattaccgtttcctcctgaccaactatacctctactcagatccctctttatccttcctcctcagggaccttacgtcatcaatttttctttctctctgtatgtcttcaacatcactttgtatccttaggatcaccagactttctggctggcctcagacagtcccagtttattcctattgtgtcagcataagtagcatcctcttttaccctcaaaaacatctggtttggatgacatatgtttctcctaattatatctgaccttaacctttaaccatccaaaagctcaaattctcccatcctaaaaagacctaacaggcacatacattctaaaatccgcatccaatcccttatttttctctccttcccttcatcgtcacacgtcttaaaaggattgtctacatccatttctccatttctttatctactattatttctctagacaatcgtcttatctctactactcttctgaaattgctctgggcaaagtcaccgtacgacctcttgttaaatcctttgaacatgtgaaggggtctggttaggtgatttacaagctccttctccacctctaataagatgctatacatttgaaatatttcttgactctcatcttgttaaccaagacagttaactggttgaggttctatcacccatgtgtccacagtcatgttataccttatctcatttagttcacacaacaaccctctgaagtaggtatcatttccccactttacacatagggcagaagagagattgataactttcccactttctcacagctactgatgatggagctaagactctcatttccaaaataaactctgttatttttccattacacaattctctcttcttcccaaccgttaacatctgtttccatatgaccaattcattatagacactaaagagtggtgtgctgattttttttttattatactttaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatccacctgcctaggcctctcaaagtgctgggattacagacatgagccattgtgcccagccgtgcatgtgtctttatagtagaatgatttataatcctttgggtatatacccagtaatgggattgctgggtcaaatggtatttctggttttagatcctggaggaatcgccatactgtcttccacaatggttgaactaatttacactgccatcaacagtgtaaaagcattcctatttatccacatcctctccagcatctgtcgtttcctgacttcttaatgatcgccattctaactggcatgagatggtatctcattgtggttttgatttacatttccctaatgaccagtgatgttgagcttcttttaatatatttgttggtcacataaatgtcttcttttgagaagtgtctgttcatatccttcacccactttttgatggggttgtttgtttttttcttgtaaatttaagttccttgtagattctggatattagccctttgtcagatggatagtttgcaaaaattttctcccattctgtaggttgcctgttcactctgatggtagtttcttttgctgtgcagaagctctttagtttaattagatcctatttatgtatttcggcttttgtggccattgcttttggtgttttagtcatgaagtctttgcccatccctgtgtcctgaatggtattgcctaggctttcttctagggtttttatggttttaggtcttacatttaagtctttaatccatcttgagttaatctttgtgtaaggtgtaaggaaggagtccagtttgttttctacatgtggcttgccagttttcccagcaccatttattaaatagggaatccttccctattgcttgtttttgtcaggtttgtcaaagatcagatggttgtagctgtgtggcgttatttctgaggcccctgttctgttccattggtctacatatctgttttggtaccagtaccatgctgttttggttactgtagccttgtagtatagtttgaagccaggtagcatgatgcctccagctttgttctttttgcttaggattgtcttggctatacgggctcttttttgcttccacatgacatttaaagcattttcttctaattctgtgaagaaagtcaatggtagctcatatttttaaattgtgtaggttctaaaaattagacccactaagcattagtcactgtcctaggagtggtgacagttgtggatatttaaaccagagataagggaagtagctgttgctatgtaagtagtgagtttctggatttcagtaaaataaaccaggatttcgtttcttgaagtaattatactctggagagaggaaagaaggatggagacaattatgaatgaccttacatctctgagctgttgagaacttctggatcagtggctgatgttttcatagccttttcaagtgaaacctttcagtgaagtctcaagccacagaccaccagttgacaaaaggatttttttttcaaggatattaaccataacttgagtatcatataatgattgtcatattaaagaaaaaaacctccagccacatttttaaagctatttaacctttctgaaaactcagagttttgaaactttttagtatcattcaattcgttttgagtgttatcatttcagtgatttgtttaactttaatgtaagaattggcaaggagtttctataaaacaaatacaactcgtataacaactctaagccagtaatattgctgataccactgaaacccttatccctggacttaattgctctgaggaccgtaataagtgaagaaaactgttgaataaactctttgtaaggtccctcacgctgggaaatagttaagtccatttcttatctctggaatcatgccctttttgatctaatttaccaagtattgtgattgccaatataatgagaattctaagatagacagatgtaaatgaggaataatgggcaggatttttcttttaactaatgacacacagtaatgaaacttgattaaaagtatatgtcttttggccgggcgcagtggctcatgcctataatccctgcaatttgggaggccaaggcacgcagatcacttgagcttaggagttcaagaccagcctgggcagcatggcaaagctctgtctccacaaaaaatacaaaaattagtgagatgtggtggcacatgcctataattcccaactacttgggaggctgaggtgggaggatcatctgagcctggggaggtcgaggctgccatgagccatgatcatgctactgcactccagtctgggtgacagaatgagaccctgtcttaaaaaaagtatattttcttaaagtgacaaatgtttgacatatgtgaatgcatatgagatctcctctctgtgggacatttgtgccccttatctcattttacatagccatagacacaatataaaatcatcaaactttgttgatatgactgcctcaccctcaaatgcatcctgagaaatttaaaatagttttataatgaaactgtttagtatctgggtatttttggcaagcagtttatagatactgttcttttatttaaggccaccaccttttaacaagatgtgagagggtgttttaattcttctgcgttgtttctgagctgtgtgtttatttggcaacttcattctttgagttgtcgaaagaacagaagtttgtaaattatacaacactaaacagtggatgccatccatggcttttagcccaggccctgtcaaatggttttctattttctgtcctggccttaaacattattgtgaattacagaagcattagtattcatcaatttaaatctattgttttttaattagtttctaaaactctaattttaattaagaaagcacaggctcttgttgaatatgttggtaaaataattattgaccaaagaacaaataactttattgttaaatatttaggctcatatttgactttacctgtgttaggcaattttttttatgttatggggctatgcctttatatagcatctagcaatgaaatatatctatgtcattacattggtgacattacaccaatgttgtataattttggttaactggtaacattcatggaatagatatatgccatcgctagatgatatttgattcctttgttattacaaaggaatacaggaattgcaaactggttttaatctggcgctctttgggttcagtgacaatgtgttgagatcccatggtactgattactattgaggctggagggaactgtggtagtatatggccatgaatttattattcttgttacatacactcccagaaaatgctgtccaaagacctaacatgcaaagacacaaagctgttaactttttaataacttttcttccagtcaccagtaagatggttgaatttgtctctttcccatcctctttgctgctaaagaaggaggccaaacatctctagaaaaggtctcggtctgtgtactttgattctcaactcatgagcacaactgtattttacaaagaataaacagatatatccgaatgaagtgtgaaaagagccaaacaggacagtgtgagacttggatgagtgtctgggtcccatctgtttcacatttaggttcctagggtcaaggactacagggctgattttggtggctcccctgccgcccttctcagttgccctctggacttggcctgggaggatgggagatgtgggaaagccctgtcagctggctcagaacccaccctattctgcaggcatatctggattgcaaaagcagcgtgggtggcactgggtctgaggatcaacaatctcactcactctgtgtcttggaaagttactcagggcctcaatttccccatctgtaaagtgaggataatagtagctgttaagaggaattgaaggcatgggaactacacagggccctgcacagtgttttccacatagtagttacttaacaaatgtgcctgttgttgatcttcataaatattcataaatattcaggagaataagggataactataaatattccagaatcctccagcttcctcatagaaatttctaaacttcccttagcactttttaagtaagaatatcgttgccctaaaattaatatccctttcctatattcttctttttgccttttcctctctatcagtttctgcggccaatgcttgcttttttttctccccatttactcttccctagttccccttctgtctctgttttattctcttctttcttttcccttttcttctctttcccactttcattcttgggcatcttttattgtcctctcttcattctcttcttatttcttcttctcatacttttctatcaaaaggtagttgtgagaattactaagacaatgaaaatcagtgtaaaaattggaaagttattttaactaattaaacactaattttagttagcaggtgacattgatggtgttacattggagcagaacatggactaagcagagactgtgaactatgcacgtgctataaatcccctttcctcttaactcattccatctttagagataaatgatcatggatgactgatgtttgagttcatttatttgttcatctataaagaagtgctaagtatgtgccaggcattgtgcagcaattttggaggaagacagttactatgccatatggtcaattcattcttgatccatcgtaggaagtggtcagtgaagtaattgtggaattaatggccaaagaagagaaatggctgaatggagctgaccttgtgaagaagacaaggaaggaggaagctctggatgttctagcaaagtgtagctaattgtgtacagcagatcatacagtatgagaagtcagaaataagatgggactgggtccataaggaaccttacattctgaatttgttgttaggttaggatgtggtagcatatagattccaaaagttctgtgacttgataaaatggaagtctgtttcttgatcagtgtttggtcctgtcagttgtcccggttcagttgtcttaactagttagccatagtccatcacttgtgaatactctttgcttatatccttacctctcttacttctcaactggccattcccaagctctagtttgatctgattctccacctactcttcctctgcacctctcttaaagaaccattttataccttcttctatttaccttaacctctataccttttcccctcttcactgtcagctgataataaccatatctgttatttcactgaggagctagactaagatgaaaatatctacatgccacatcaccaaatcaaccaagcctcctgtatctgtcccctcttattctgcctttccttctgtcactctgtccttggtgtccttgctctagtgtaaggtgaatttccttccatgtacatgggatcccattctctctcacctcctgcagacatccttcagctattctgccctctctctgtagtatcatctgattttctctcccgctagatatttccattagtgtatgaacacactgtgctatcttccatcctcaaaaacaaatctcactagaccctacttaccactccagctattgcattatttttctcctcctctttagagcaaaacactgcaatttacactttctctttttttcccaacctcatctcacatcatcaaagagattctctttttagggccatcagttactgtcatgttgccaaatccaatggccaatcctcaggcctcattctatactatttacttttacactttgactcagttattcatttctttctttctttcttttttgaaaaactctagttgcttgagttcttgcaaaccatttacttttgattctcttcttatttcactggttgtctcaacttgcttttgtggttacttgtcctcttttcaccctttaagtattggagcacccagatgctcagtacttagatcttttcacatctctcttcatgctcattctccagggcagtgtttctttccaatgtcgcagtttcaaatgccagccctacttggatgactcctaaatttatatctctatcccagatctctccctttaattccacgtttggagatccaactaccagctgacatccccacatggatgactaacaggcatctcaatattaacatgtcaagaactgaacttttggtttttcctctctccccagacctgctcctcctagtgtcctccttattctattaggtgctcaggtaaaaaaaaattggagttggccaggcacggcggctcacgcctgtaatcccggcactttgggaggccgaggcgggcggatcacgaggtcaggagatcgagaccatcctggctaatcctgtctaacacggtgaaaccccgtctctattaaaaatacaaaaaattagccgggcatggtggcgggcacctgtggtcccagctactcgggaggctgaggcaggagaatggcgtgaaccctggaggcggagcttgcagtgagccgagatcgcgccactgcactccagcctgggcgacagagtgaggctccaactcaaaaaaaaaaaaaaaaaaaaattgcagtcattcttgcctcttctcattctgtcacatctacatcaaattaatcatcaaatcacatcaatttatttattaaaaatatagttgtcatctgcttcttgtcaatcgcactaccctggtcaacatcaccatcatctcttgccaaatgaaggcagtgtatactatacttggttggtctccttgcttcaccctttgttgtgccataatctgttctccacattgcaaccaaggtgactgattaaaaacataagttagttccagactctctagtggcgtcccaactcagagtcaaatgcaaagttcctaccgtgctcacaaagccccgcgtggtctgggcccagctcctctctgacctcatctcctaccacctactcctgtgtaatcaccacagtggccaccttgcttctcaaacactccaaatagtccctacatctaggcctttgggttattattttttaaaatgtgaacattgcatcttaaaccacggtatcaacttttttttgaatcacaggctttttcctcctcatttctggccacctgcagaattcatgaagaaggtcatgagcttgtcttttagtaaagtatttctaagaggatattgctctccatccttgtccagttcccattttaaaaatttagagaaaggtaatttttgaaaaacaaaagtacaaaaaaaaaagagtaaaatgtaaaagaaacactttttttctttaaggcttttgacttgatcaaaaagaccaggaaccagatgaagccatttcctgtattatgtaaactgtgtctaaagaagaaatatgcttgcactgtacaggaaagcatggtattgtttctagtgccatttgacatttcttgcactataaagcaattgatatgtgcactacaagctaatcatttggggaagtgtttttgattttgcttagataggtatatcattcaaattttaagacagttattcaaaattagggtgttttcagctatttgtttattttgagagaaagtcccatttaaagaaagtattattgtagttggctattttgaactatccatggtctttgtataaacttaccaagttttttttctcttattgtatcacagtgcaagccttattattcattttcctgataaatattttcctttcctaaggcaaagctggaaatttacttgtaccaactgacataattgaatatagttattatccggtgctcaaagctctctgatgtgctagacatgcccaagaactcaatactgtgaccttttttaagagtcattgtgaagaacagcattagagcatgatataactgccacagccatggttagcaaaaatgtaatacctgttttcccacggctttcatgtttggatattactgtatcttcttaatcagatgtctccctttgtaatttaatttatcatttagttggtaattttgttgtgtctactgcatgcaggaccctgggatagaggctgcaggtcatgtaaagaagcataggctgtgaacctactctcaagcagtctaaaatccttttaagaagacaagctgtgagaaagaacacagctatgtctgttaggaagaaaaagagaagtacttaagatttaaaaggagaacaggtcatcgcatgtgtgcatgtgtgtgtggtgtgcacatcataactaattaatgctgaggagactgtagatcagtcaattattaactgattatggaaaaggcattgaaacaaatacagaagagccaaataattgttagtgtaggtttctgaacgagagtgacagcaatagatacacacgccaaaatcaaagcaaacaaccaaaaccttgctaggcaattctctaggaaatcactaaacagcatcataatgactttccagaattaatgggactttccaaaatgcctatgataatttgaaagattaacctgtttgatgacacaatttgctataaaactattaggttgagacacatggaatagccactttgtgagtcataaaggactgagtatcagcgatttcataagatcaattgaatataagtgatctgaagaaggcagagactgtgtgtttttactttatacctcaggcctaacacatgaatcacatataataggtgctcagcgcatgtttatggactggatgttgaatgtgtacgaatatgtgaaatgtgaaaaagaattatggattttttctaattgggaaaaaatgtctttaatcttataaagacacaatgttattggaaaaaattgcaaaatggctcaagggaattgtgtgctttggttacttttagtagttacagagagttaaggaacactgggtattaacagtctgtcaatgaacagaaaatgggaaaagggtccaaggccacacttgtcctgcatttaaatggcctcttccccggtcctgatgtgtgctgtgctggaatgtttggttttgcccgtggtgatcacaatagctgcttctaaggcacttcatagcatcacacatcctgacagggtctgcagacatcatccagcccacactctcgctttacaggtgaggaaactgaggctcaaggtggcgacatgagtttgccttagtgctgtcatgtggtagcacaacgggaagcaagactcaagttcctgactctccagttagtgctttatctcttacaccgtgatgcttcaacaagaattaccccaaactgtgatatgggtggttatatgagcttaagataagagttgaggcagatatggaaataaagcctattccagatatggaaataaagccatttccaggaaatgagagtatttgtaatgaaaagctgtaaaaatcctaataataaagagaagatatgtttccttttaaggttacatcccacagctttctgtttccctctatatgtaattgtcattgatttccagatgaagttagtttttggaagaaaggactgaaaaagaaaatgggtgtatgatgatatcagaagtttatgcctggttgtgaatattattcatatatcttgaatgagtttattcaattctctgataatttttataagataaaaatatgcaaatatacatttgcatactcacatggacttctgagattattttaccattttttaaatttaaacttgcatatgtcatagaaaccatttaggtttttttgtcaaaagaatgtactgctgctttgtttaaaatagtgttactcagaattcctttcatatccttttttcttttagatcttgcatgtttatagagtccggtttcaggggaattcctttggtagtcttcattgaacgtcagcaaaatatattatttttggcttctgtcctgattaacccagacgttttaatgtgtgttatgatgggttatatgatggatagtcacctgtaccctgtgatcagctaaaacttggccacttgagttaaaccttagtggtggaatgtcataatttcccatcttttgtttgattaatacttccttttgatatctgaaagggaaatgtctggaagtgtccatcgatgtacagtcacactcaggatgagaaggaagacgtgtcttttatggggagagaattcagttgatcataacaagctcactcagggcaaagcatcagacactcccttttttaaaaaggaaagaagaaataaacagtttgctcacccttaaaagtgtttttttcctaaaattttgttgagttaaatacctttatttggataaaaaataatagcatgtgcaagagaatgaacaaaattcttaagtgacgattgacaaataaattttgttacaatgcatgaagttatatgcagtggctttaaatttataaatatattgttgtaagatgtcacatcaaaatatgtaattcttatttgccctttatttttgaacagtagatagaatatttattatgcctagagcagcccttgtgtacaaaaccatgacattctttaacacatagaattatttaagaacattaccttctcacttttttggagagagggagttccttataactcccaatttatataatatgtctcactgtatctgtaaataccaatattcaggaaatgcttaattacattcccaatgtttacatagatagtgttaattgattcactttagtgaatatttattgagcaccttctctaagtaacttggtgtaccagcagcacaatagtaaaatacataggcccagcacttgctctcctggagtttatcatctagtaaaagagacaattagggaacaagtcaacacatttacgtataattacaacttgtaatcagtttgctaaataagtagtgaaggagaatctaccttgctgtgaaatggcagtgagggaggggaccaggagaatatagaagaaaggggaagagtaacctaactaaagtaaatagtgtgggtaaatacttgaatcaggaaataatttggttaattcatgagaccaaagaaagcgagaggagtagaacaccatgagtagggagaagagtgaaaggaaatgagagtggagaagtagcaggatctggcccaggtagcctcagtggccaggataagatgtttgggtcgtattcaaattgctatggagcatcagaaactaggagcagtggttccctataggagtgggagggaactaggtagatgggaaacaaggatggtagggaggcttttcactgtttatctttttatactatttgtttatttagaaacatttgaatgtgttacctattaatagctttaaattttaaaaatttaacaggaggccatttacacttataagtaaggatgtatcttaacatgatgctgcatttatttttatttatttattcttttgagatgaggccttgccctgttgctcagatgggagtgcagtggcatgatcatggcttgctgcagtgttgaccttctgggctcaagcaatcctctcagcctcccaagtagccgggaccacaggcacatgccaccacacccagctaatttttggtagaggcagagtctcaccttattgttcaggctggtctcaaattcctgggttcaagtgatccttccacctcagtactgggattacaatgattctgtttttaaatgattattttggcgtttgtgtggagaagctattgaagggggcaattctagggaggtgatgatgcagctgtaactagagtgatggtaatagattgcaaaggggattattaaaggtttatttggagggagaaagaaagtctaagaattattgatgttaggagtaaaggagtgtgagggaaactagggtaattgtttgatcaatggaaccatgcccaatgatatgaaatatcaagagagaaaccagtttggaatggataaatctgaaattttgttttacaaatggtaaacttggcatggctgttaaatcccaaatgttggcatcaagtggacagttggatatgtgagactgcacctaaggaagtggtctgggttggagataagagtttgggagtcatcaacttccatatgatatttaaagctgtgatagtggaagggaccccctgtggggtaaggaggagaagaaggcagaagactgagccctaggccttgcccacactttgagaaggagaaagaagaaaccctttaggatgacagacatatacagccatagcagcaggagaaaaaccaggacagtgaggtgtctcagagtctgtgcatgtttcaagaaggatgaaaatccagggggctcttgttctagtctggatttttgctcttgtcacccaggctggagtgcaatggcatgatctctgctcactgcaacctctgtctctcaggttcaagtgattctcctgcctcagcctttgagtagctgggattacaggtgcccaccaccacgtccagctaatttttgtattttttgtagagacagggtttccccacattggccaggctggcctcaaactcctgacctcaggtgatccgtaaaccttggcctcccaaagtgctgggattacaggagtgagccactgagcccagctgtggattctgccacttctttctattttatatgtcatctaatttcttggaagttttcatttttcatctgctgaatgggatgaatatgtcttatctatcacacaggcttgagatgagcaatgttgagaatatcagttgaattaatattttcttagtatatattaattaataaaaatctattgaacttattgcataatattcagctataattatacaaaggaagataatcatgaattttttattacctcgataatgctttactttaaacacctgtgcatgagtgtcataaaagatatttaaatcagaattatattacaaagtaatattgaattaatatgtttacttgaaaggaacagagcggtaacaatgtacctagatatacttataaaaggaaaatctttaaccaaactagagaatattgaaatcaaaatatgtttttctatattatctttgttaacaactaatgtgtgtctaggtggagagacattcccaataactgccattgttacagggttaaaaaactgagttgaagtaagtcattgggaaggggaaaaaaaaaaacctttacacaactttgttaaagctagaacaaagagtccatggaaagcaccaggtgtgacatacaaaagataaggaacaaactcttctgtgtacatatcactcttagattatttaatgacttgaaagatgacctccactgaaaggtgtggcatgaaagtgagcatgaaacagaacactaatcatatatttcagcaactctgatttccagtgggctgggccttggtgctgacagtcaacgtgtccattgtaagacaggtttatttcttgcataagtttaccattatcttggaagccctggttactggcaaggcactctctgcctgccgccctccatgtttgttctttttttctgctactttggaacttagatatctggtctgatttctaaagtgctttgggcttccttgtgttgggattttttttccagcccccacaattaggcaatcatttattagtccttgtctcgtaattgagatgcacattatcattctccttggcttctgtgatgacttgttacacctaccttttccacctccttatatcatgagattaaagcactcagtgagctcaagtaacataataaaatctggaattaattaacttcactgaatatgattatattatgaattaagtagctccttctcagagtgtactgtaactaccacaataaataaacctataaaaatgcggttttcagggggtttaattttcaaaagagccttcactaattctattaatatttattgagtcctatcagtacctattgtatctaacctcatttattctgattagaaatgtcttgcctttcacagtagtgtaaatttactggtgaaagaataaagaaatcttaagctaccctttcaaagatcttatcgttacaaatgttttttgagtatcagctatgagccaggaaccctagcacagtgccttgcacgtaggagggactcagcacaagcttcaggagagaaattgagtggaaagagagatatctaattataaaaactaactctaagatggcattttaagagacaaaacagaggaagttaaaaagatataggaacaggaaaaaagtacaccaaagttatatttataatcagcaaactaatgaaaggctttcttaattattttgttcttaatactatggtaacaatgttttcaaagttgtcggaattttcaggttattgattgaggtgataggaaatattctatttaatgttgctttagctagactgccattttatcttctgtgtagctcagtaatacttatttttaaaatataaggaaagcacttcaacttctgaatggtccagcagcttataaatgtggcctagggtccaagaatggtgtgtttcatcaccattcacattagatcctttaaattaaatttatatttttatacattttattacttgtcaattggctccaaccagaggtcaataaggttgaaagaacaggaactgaggatacataaaaaacttttaggtgtattgatttggctgaattattctcatgggaacaaaatacaaagtaagtcaacactaaaattaattttttatattaattcaccagctgaacagatgatgtatagaagtgcgtggaaatagcttcactttgacatttattttaaaatatcaaggctgtcattacatgcacagctggattaactattaaaagtattttctgagcccaaaactatactgataatttgattcaattgattcattggaagtgagaagattggaaaattcctccagaacccatctctcatgcatgaggggtgatgaaattgcttcccttgagcaaacacaaaagcagcttcattgctttgtagtcacttggacttaaaattcatattttttgaaagcaaccacatttcttgcagctattcacaggagttctcatgaccctctctgataaccagcagtgtctgatctcattgtttagaagctcatccttttcttcctgagaaggaactgtttatttggcattaggccaatatagccaaaggaaagaagataaactaaaaaccaaaccaataaacaaagtcatttagtgatttgagacagtgagggaaaatggcagagaggtgcataaagcttccaattcactggatttatggtattggaaacaggatttggctttttgagtatttgaaaaaataaagggttagacaaaatcaggattggatactcacaactttggggctgcttctggttgatacagttttcagaagagaaagaaattgagtttgaatgccttaagtggactgtgtggtttgtttcacatggatttcaccactccctgttatcttacacttgagtgttcacatctttacactaccgcttaaggtcccagatattgcaacgtctgttatgaatgacttctaacatgtcttccacctccactgttttatgaatctttaggtcaggcacagagttggcatttagtaaacatatattgaataaatgaatgaatagtagtgtgatatatatatatatatctgtttcaagttgggttagccatgaattccatgagtgaaattttctgaaaatgccatcaatgtgtgtcattacatggagaggaaagaatggcaaggaactttcttgttttgtgggaagggggaagttagacttttgatgatgttacagacaattggcttggaatttgtagaaaatatgtaaaatggtttcttttagtgaaaatccaaagaattctcttgatcggtgacataaatttattggtggtgtttttcatgtgacctttttgggtgatcattgtcttagaaagaaataatgtaagagtagttgagtatatgtcatctctcttcaaataaatattaaagatgtgaaaataatctgaaagaggactcctcagtgtgtttaggttttggctctgttcaaatttttctttgttgttaatcttttatctggtttagtaaaatctagtttgtttctaaaatgttacgctttttttttttgagacagagtctccctctattgcccaggctggagtgcagtggtacaatctcggctcattgcaatctctgtctcctgggttcaactgattctcctgcctcagcctcctgagtagctgggattacaggtgcctgccaccacacccagctaatttttgtatttttagtagagatggggtttgctcatgttggccaggctggtcttgaactcatgacctcagtgatccaccggcctcggcctcccaaagtgctgggattacaggcatgatccaccacacctggcaaatattacacttttaaaatttatatttgttcatagtttttccctggttcaaaaaatattcattctattcattctttcaatcaatattaaccaggcgataattataatgtaataattgtttgaattcaccagatttctttttattttagagaaaaaccaacagcaacaacaaaaccctgaggcacacagactgggccatgggaaacaaactctgccattttcacagcaggaggtgttgtgccaccccacggcattcctggtccctctgcctgccctggagcattggcactgtgtccaagctctaccttgaatcactgattctcttctattgtctaagactgtgctacatttctaacaggacttgatacatggacatgtgtcttccttttctctacttgtcttgaagccacagatacagattgtatatattcaagttcagctattgctggagtgtctagtcctgtcgggccccaattgtgtttaaaaaggcaaggtagtggaactctcttcatatttgataacctagagggaacattttaaagcaatcattgacatttaggaggcatatattcactaaaaacccctctttgacatctcctagaataagtacagtcttctaaacatcatctgggtatttaaacaagctgcactgatgtcagtgctaagcccccctcctttgtgttgcccccatcatattgatttatacttgaaggaaatggacataaaaggatcctgtatttggggtttataaattttacagaataggctataaatgaaggattagtttgtaagtttcaccttggtattattctcagtaatataaatcctataaatatactttacttgattaacatgactgaaaactgtcatcaaaattagcatatcttttacatatcagaagcatcttacctcttggtaattacattatttgattttcctagagtaatggggaaaattttaatttagtttaaaatatgaataatgttcacacctgcaaaccattattctgcctccttaaatttcagggtctcattcacatcatcttacatttcattgctttgtttggggatggtgttgaaaaagtaaaatcataggacatgccactattgttgattctaagtgaaaagccataggctatcaacactgctagtgcttattttctgcattatgatagaaaaaataaaagacatattttctcccaactttccctagagtggattgggtggcatcttgcttcacatgatatgaatcatacattttccttctattcagatctctgtatttctataatcactttgtcaactttaagaaggagaggaaaatgttttgattggaggaataaagtctgttcaggttagacataatctagtcagacactcaccttgtgcagctgtttcactttcagagaataatcataacattgtgtagaatgatgatgagatatgttattatctaacagaatcgcgccgatatttaattaattccacattagccaactaacatgttaaaagagagctgtggctaaggtttaaatactgaacccacaatatagaaacagagctaagaaagattgcttcaagttaattcagtaactagtgacagcacgagaaacagaactaaaagttcatgtcttagtttagggccacttattgagcgaagccttgacaaatcataatataacccaacaaggtgttggagtggctataaaagctaatagaaccccaggctccagtatagaagtacagtgacctgatttaatggggtaatggttagctctgttgtactctcctctggttggaacccgtttgggttatcgtctttgtttggggacactatgttttgagagagagattcatgaactagaaagcttccaaagaaagggcacaaagatagcaagaagtgagatcatgtcaataaatggaaggacctaaggatattttagaagagaacacttagaaggtacatgaggactagcttcaaatatctgaagggctgtcatgtgctaccatgattagacttgttcattgtttttacatcagcaggtgtgaaattaagactatgagtctaaaactttaagagggtatagaacatttgaacaattataactgttttgagtcaactgggttaactaaaatgttgtgagatagtataaccataggtatttgataaacgccgcaagatcattttataaatgttttctatttgaatgatttataagagaggctatcatctaagattctaaggtttcttcttagtatgtaaattatgattatttactataaaatatcattcattttcttactgtgagagcagaaattcaatctttagtggcttgcattctctttattaacagagtcaaatctgtaattatgacagtgggctaggctgctcttaaacaaaggttatgacttcatggcaataggctgagggccaagagataataatcttaggctgacataaatctgaaacaatccatgaaattgttgaaaaacattatcagagtgcactcagttaggctcacctctgaagcacagcacaaacaatgagtcccttaagttttgcaaggtttctatgagggactcgtggctgtctcagacatgtgagggagtggaggggaaaggaaagtgaaatgatatggaaggaatcaagaatcaagagctttgtgacatcaatacttatccacattcatagtgaaggctctctccagcctatttgtaaaaaaaattatgcaatttgtttatttttatatttgatttctttgtggggcaaagagcaggagaccaaatagcatcagaacttgaggtacattaaccagaaaaaatgtttagctattctagtgaatacacagtttgaatgaaaatgtggtcattaaaattccatagtggctgagcagtgtgctgatatatatggaattatgcatatggaatggggctgtgattcatgaagttcagtagaaaagagctctgtagatcagattccgggttcaggggactttgagatggggtctgtctggtctgactggggtgaactttactttgaaaggtcttgagtgatttgctgaaggaaaagctgttagtaaatgatacaatggcgactcaaacccaaatcgggtgacctaatcttatactccaggcctaatctttacttaattttattccaagaacattttgatcctggtagaatcaggtgaggaaggaagagcaaccacagcctgggcgggaaggaaaatcttgaggagctctggcgtgggtgtgcactgggtggggaacccagcccctcctcttggcctcggtttgggcggcgggtttacagtcttcatgctgggagagctgctttttgaaccatctgtctgcaataaacgggcctcctgagtgtggtgtcttgggctctaatccttgagtaatgactataggtggaaattgtctctgaggcaattcctagtgagaactaggagttctaggaaggatctatttgttaaaaatcagccaacagcaattttccctttaactgtcttctctgagtctttgctccttaaatattcatgaaacttgcagtgatttcagattaaagatctctccaagataagtagttcccagaatcttatatccatggtggtatctggattcgtttctaagtttcccctattatagttcgaaatccctttgcaaagcttgtattgctttcatttactgaaaatgaacaatgctgaggcaggacccaaaggacattaaaaccccattatagttcacttcctgaaaccacacattcggtcatcctgcaggtaaaatcacttccccgtgcgtacaggggagtgtagtgtttcctcctcagtgcagctgcaatgtctctaaactggtgtctttactaagagtttgttgaatgaataaataaattcagattatttcatgtcccaagtcttcttgtgattgaatttgattcttagaatggagatggaatccatgtgacacattctattctaagtatcttcaaatcattacagtaccctagggccaaattcaatctttgatttgaattaaatactaatataatttaattaaatactagaattatagtataaggagatatgtatatataaatagatggaaatattaatagatgtcaaaatatggtttatattatattatatatgaaatgttatcaatataaagacacatttctctctgcatcttcatattgataacatttaatatacatatctcatttaatatataacatttaatacatatgtatctttgtatgtaaagagagaaccatatgtgtcttcatattgataacatttaatatggtgtatattaagaagtatttttatatcgatttccattctgttttattctttgtaaagtagaaggcatataaatacagataccataaagctaatccactccgtaaataaaagacatttttataacacagagatttttccaagaaggaaattggttcttctcccaccctctaaattgctctttattaaaaagaaatgtgtttgttcaggtttatttctcccgatgctggatgataatattgccgtggatgatgtataatcagtttttatggtgatgttcccacaaaaggagtggtttggaagtgaacaagttactctatggtatattcaaaattctccttttgtcatgttaggcacttctcctactctgtttctgtttatggtatcaaatcacaaggaccttatgtaaaacttatttcaaacatttgagattttagcacacttttcagattattacttgaaactctcctgaaagtttgcacatttgccatgaggaagaatttaataacaacacaagagtcttgtggctctctgacttttgtctttctgaggtattctttcctcttaagctaagctgatcagtcaagattatcattgacgtttacattgagatagaaaaaatgattttttttaaaataatatttttttaataattaccagcagcatttgagtcagaagagatacctcaagctgaactgtgtggtaggttcctgacctgcctcagtgctgttgcttctgttaaaaaaaaaaaatcagttgtaacaaacccaggcaaaacaaccttacatggtcaatagaatttttaattgcaaagatttcctctgacgtgagtgttaatgaatgtcaaagcaataacataaaaagacattacttgtttaatgattgatagaataagaaaaacacaaggtcttttgtcagataaatgactactgtttggtgttcctttacctcaggagtatcaaaagtgatctcagataggcaataatagcccaggagctaaggcagcaagtatgatgtagcctgttagattataaccaaaggaggaaggctaattaatttgtatcagtgtacttgttttctcacatggcaattttgacatactttagcatttttggtttgtttggatccttcattgaaactttctgaagaatttaaataagcatgtaaaattttatgggactggctttgtctatctgcagtgcaggtgtattactaaagacaatttaattattgctccaaattgttgaaagagcacagctggtggtgtttggttttgtacagatgttgttgtgacacagatctataacatgaaatgacaatggtgacatctaacaattgcaaagtaatagccaccaatgagttttgtttttctaagctatagtttacacctctggggtgtctaatatttgctatgatatgctctttgcatgcttaaagaattaatggtgacatattctgtatgattaaaacaaactttgcaccatgtttacgagtatgagaagcattgtaggtcagttctcaggttcatctcaggcaaaacacctttaagtttcaaaagtgccaagtctattcctgttatttattttcctcactcctttattactataattccattacttctttgtgaatcaagtcatgttatgctccttgtaactggctctgggaaaagctggtaaacaatctttaggggaactaggcgtggatttcagttgaaaactctgcccatgtagctaattcctatttgctcagaatgccctgagtttactgatggtctacaaagaacttgtgtggatgtaatcttgctggcaaatccacaatacaacataatcatggcttcttacagagcaagtttattgcagctgttgagggaccataactaaaccttccttctgcgtccaccagcctgccgccaagaatatttctttggcgttcttgctcttctcactcccactcactctgttctcacagatctgggagtgttataggatgccacttgtctgtcctgctgattttctcatgtcctgcctgaaaacttaacctaagatcattgttgtgagtaagagggcaatgacttaggagtcccatagctggagggggaaagcaagggccactacagactgctggggaggcatctatgtgggtctggtcaaaaaagtgacttgagaatggtgaggctcaggtttcatttcccttttcactcatcaggtgtttaagttactggaacctattcttgagtgctaaaggtgttctatctgaacagactatggttgaatcaggccagagcaaggtcagttggttcaaccaatatgttactgttgtatgagagctgaaaggcctgaaaaaggaaaacaaacaagcaaacaaaccatcaaacaaaacctcactttcttcctccacttgtccatgaatatacttgtgattgtaatacttgttttttattctctttgtgcagtcatttctaaagttctgtgaaaaggtgtctttgctttgttttgttttggtggaggtagagagcagcacgggcaatgtccctggtacaatttacccagaaactgagtatttatgttgactttaaggagaagaagaagaaatgaagttttccccagatatttgaggataggtaggtaacattgatgttcaaacataaaaagaatttgagagaatgctactagtttattttaccttcttgcaatgttgttttaaaggcataatggaaatgttttctacaagtactatgccctacaataaagtaatttaattcatttataaaaatctcaactttgaaatactatattgtattttgaaagtgatattgtactttttaatgttttttcataattatacatcatcatctgagacatttctgataccactttataattttagaatagcagattcaactcaacccttttaaaaatttaggtacattgaaatttgggtatgctgccaccaggtggtggcaaatccttcgagtcacgtgttattgtaatttaactttttttaacccttttaaataaaagcaataggaaatctttctttaaacaatatcttactcagaaacccaatatataaaatagataaaagtcaacctagatcctatggtgaaagtgggacaggaggttcaaagccaaaggtctgtgctcatatctttcctctgatgatctctgaggaacctcaggaagacagtttgaaaatccccatctcaattataatgcacatattttacgtaacattaagatagaaaacatttttttttaaataaagaaaactaagcaatagaaaagataatcttctagagcaggaagaaagaccgagaaagcatttatcagagcaaatggaggaaaaagagggtgcttgtggatccggatcaaatgtgatgtggtgagtgaagcaggcatgggcaagagcatgaatataagcccaaactgctgagaactctgtccaagcagaccaagctctgtttgggcacagtcaggacgtactggagattttggaagaaggactgaggcaggagggtatgattgtcctgagagtcaatgattgactgaacttcttcagatttttagattcatcattgtccaataagctccttagagctggggctgggatcccagagtataaggtcatcaacttaaaggctgataagccttgagctgtatttggttgtttgtttgtttttctagtggcttctctcccatgtgatgagagaggacagaacagactgcatagctgcctgtttacccagctccatacaatggggacatttgagcagagaccaggctactgcttctgcccctcttgagtcttgtcttggctaacatttttactttgtttgtgaccttacgccagtgccctcccaaatgatcaatacattagttaaaagcaatgtttttctctgtgtttggctaactttcccctgaaaacacctgcctgtagaaattgcaaactctcccagaaactattttctaaaatgattattttctctcaaaatatcttaaaatacggaacctaatgcaagctttgaacagacatgtagataaggcaagtatagtgatataactattctacattacagaaaaccaagatcctggaaggttaaatggaaatacaacaacttaaaaaaaaactcactaatcaactaaccaaaaaaaacccataaatagttaatgataaaccaataaaatcactagggtgtcttaaatcatatagttgttctaagaagtgtgtgtgtataacctacatgcagtaatgagtttctagttgacatgatagagcaaggttagaaagaggaaatgttagaattaggcaaaatgatagaaaatgcaagaatgattggaaatagccctgagcctctcaggctgaggtctccacctgaggactgtgatcaggttatttcagtgactctcacctgttactggggctagacactgtagatcacactggctggtaatcccataaagtatcaaatcattgattcaataaatataagctgaatacctactatgttccaggcactattctgaaatctagacaaactccataccctcatggactttttagtaggggcaaagaaaatgaataaatacagaaacaaataactatataatgtttggtaataataactgctatcaagaaaagtgaagatgaggaaggggataaagagtaaagggggaattgtagcacacagaaggtttggtacttagagcaggggtcaggtgtagcccctctgagcagggacactggaacagaaacctgaaaggaataacagtgagccatggggctagcttcagaaaaagcatttcagcctaagagaatagcaaggccaaggcggccgaagaagaaaccaacttgatgtttcaaagaaccagaaagccaaacacacgaggctagtgcgaatgaatgagagaggagcagtgaggtcagagaggaagggcctcaaaggccatggtgaggagtttggactgaatgtgatgggaagccaggagaagaccctgacggctgtgtggtgaatagacggtggggtgagcgtgaaaccatgaaggtgagttaggaacctactctggaattccaagagtcatgatggtggctggaactagcactgctcatgccagataactttctctcagactctcggcatgctctgttgatttgttctagctgactcctcctgcgataggtatttaaaagacaaatgtcagccacccctttgctagtcatggaggtacctattattagttataagatggcctggagctgaggtcttggataagtcacttcatctcactgagcttaggtggtccacattgggtccttttttaggtctgacatcctctgagccctaatttttgtgattgagccttaatgagctccaccacccaagatgaccacaggggcaatggaaatcattagaatgccccacatgcctctaaattgaatataatttgatccagatctttttccattccctgggaggctgcaaacattctgcaatacccgaattcagatcttcagtctcctattaggctgatttaggaaaccctgatgacaagaatggtcactgggtagagatggtaccaccagaattcaccctccccttcccataaccagctgtcatgcacttcacccttatggttctcaaagtggccctgtgagccttttcagggccctccttaatattcagttgaatctgaccttgtggctcagagagatcactgggagataacagatatcttgcatctcctaaattagcctgcacagagctcacagtagaattctggcatcttgttcagaaagcagaatatcacagggttgaaacaatcaatcctgagtttcaggaagggattctgtaggggcctttcatccttgcacagtgaatagatcttgcttcatcatctatcagttcaatcttttcatttatgtttatgattatctttattttattttattttgagatggcatctcactctgtcacccaggctggggtgtggttgtgcgatctcagctcactgctaccctgcctcctgggttcaaatgattctctggcccgagtagctgggattacagatgcactccaccatgcccagctaattttcgaatttttagtagagacagggtttcaccatgttggccaggctgctctcaaactcctgacctcaagtgatccacctgcctcggcctcccaaaaaaatgctgggattaccagcatgagccccaatctctttaaaatacaaaacgccaaactagttgcataatcatttgtggtccagtataagggtcatgtttcatgcctcatacacaaatggtagacaataaattttaaaatgtgaatctgttgaaacaaatatcagctcttgagtttttgcttgaagtatgcagctccctgtggtattattcacatgatcagattctacagaggagaatacctagtattcaagatgatactcaaatttagacacagaatcaaatactgatgtgaaacatgcagagtagctatctccatactaaacaaagcaaaagaaagttttattggatcagcatgtatgcactgcctagaaaaacatttcagaatgttctatacatctgaggcttgaaatagagcccactttcaataatagatgctataacaatgactatatccaatgggttaattaacttgtcttttagttttagaaattttaacttagtttatgagggaacagattttcctagttttgatgtgttccataccagacatttgcccacttctcctaaatataaactgatctcccacactgacagagaggattgagcatttctgaagtaggctgaggtaaaggagaaatttgagaatttcctgaggaatttagaggaaagtataagccaagttttagggcaattatatttactgtttaaaattaataattattatactcttctataatatgtcatgttacaattagttataatatatgactaattttcccaggaactcagttcttccttgatagtgagttggaggctgcatactttggagaaagccctagggagctgggcttattcaagtgggggaaatgaaggataaagggtgatttattgactattttcaaataatggatttttccaataaggaggatgatgttggactactgttcaccaaagtttgaataatatgaaatgagcttcgactgaaggatgcaagatttaggtaaagtatatagaaggatttccttttaataagtggagttcagcagagatagattcccaggccacaaaggtggtagtggtagtaggcaggtggctggtaactgttgaaaatgtgagaaaaccaccaaaagtaaatgaaagtatggagtgtaagtcatgattttgtttgttctgctacattctaaaaattgcaatttttttcatgagaatgaaacatgaaaaccaccaccatatccaagtacagtccatgatcccatttaagagaactccatgtaacatagaccgaaaactaattttacccaacccaactcgagaaatgattttttgccattatcaaagcattttcagtatttatgatctagaaatacagctttattcacttttatggtacaattctattcaaaattaaaatgtacaccatcagcatcatcagagtttattggttaagtcacccaacagtttttaagagcacagctctttacttgcatccacagcatctgaaacatgccatttttaaaatctgtgtatgtggctgtcactgggaggctcatctcaggtccaagtacataatcatgtaggtctggagctattattttttttcatgcatcctgtgggtgcacattcatggtctctacaaagtcactttttttctatatacgtttaaaggttattttaaaattatagagcaattcatgaaatatttgcaattatgagatcatactcaaaggaataactaataaatctgggttaaataatgttgactttttaaaaaatgatttcattataagacgtctttaaacatacaaattaaccttgattgtagtttttttcccccagttactgtgtttttcccaaaaatatctcaagtgtgccccataatgtacagagactttattaacatttggatacagcatgctttgtcttttctaagggatttttttttgggaaatgatttgttttatttggacatattaaagcatctattctctccaacactattgtttagggtagtatcggggctgatatacttaaggttactgttgtcggcttctcaaggtgtagtctaagcatagaacctttcattaaagggcaatgctacagcaatccaaaatagttaacactcctcctggtaccttctcaagaagagagtcatgtcccagaggtgggctcaccaagctacttttaaattatgcttcaatctgatgacttcaacagggtttaacttcacttagtggcaaagcttattttcaggtttccatatatgagacacaaagaaataactagctaaatacaagttgttttccaacctcagatgggaagttaaaattcctgcttctattttctaattcctcctctttattcccctgcccgagcactacaaaactcatcaggagttaattttttttagccaagtggtaatcatttgattttagtcaaactctccattggcctaatacaaatgccgagtaagagatgagggttgcacagcctgtcaggggtagctcaagtagctgtttgttcaaagtatttgctgaagcagaaacaaccctttttgttttgaaagcatgttaatgtgctaatgaaatgcacaaagcaaagaggttcatccatataaatgggtcatttaaataatgaacaagaaggaaggatgtggtttggtgtcagtactgattaattaggacataaaaataagtaaccatcccaacattggctgcctcccttgaaacttactctattagtgggcaatgaagttaatgcaattgacaatataattacaggttagtgagcagaacaatccacgaggaggttcttgtttcatttacagctttaattagctagatagcatctctgtgttaattttctcatctctaccttgctaatcttctggtcctcatagaaacaaaaaacctgttgttttcaactaatttcttagaatgttttgggtaccacatatagatatatagtattgttctaggtattcaattcaactaacttttattaaatgtctaccatctgatattcactgtgcaagcacatgctagtgagtttatagaactgtacttcagataaatgcaacgacgtccaccagcgacttatttttattgctctcttctctggaatccttttgtctttcataaaaaaagttcataaagtttctaaggtctggtgttagtggactgtgttgaagttgatggcatattgtcagatttattccttcaccaaagagttaaccttgaggcaactttatgcaatctattttacacaatcgtgattgaggataacacaggtagttgaaagttaattatcaactctgcttcaaatactgacggaacacctaacttgagatctattagcatcactggaggtcattgagactactggaagggcacttggaacacacacacacagacgcacacgcagcagattacatgagacaacaacaaaaccccatagaataccacttcagatgcctccccaccccaataagcgtgaatgtgatttgattagtattttcttgttactattaaatgatggctctgctgctcgttttggttcaggacaaatcaactgccaattgctaaatattctcaaagaactaatttcattctgatagaaccttttcaatgttatattcaaaaagcccatttttaaccttccagtgtagaaataactttcttatattgtgaaatgaaagaagaaatcaaaattaagttgtgttttggagaataaagaagaaagatactctttatgttgtagcaatgatttgtatcagattccttctctaagatttgtacttcttatatttatttttcttgcctattccccaggtttttagttcaaagtaaattatcaagattttttttttttttactaaaacttgcctctttcctctttctccccctaccccccaagtgtaaaacatggagaaagcagaattttctgttttttccataatggttcatttgtattctctgaacccaagactaaggcaagttctaatgtcttactgttttatatcaccactgaggtagcagtgacatgctggctgctgatgaataaatatatttatctggcttctaaacctgcttacactgttgaataatgagcagatgttaacaattactctaaatgtcttggatattttgtaaaacttttatcagacttagagtggtttattgatttagtcagaatcatgccctgggcacaaaacatattgtcgtatgggattcaacgtgggcggaatgcatgtccattaacattttaaactcctatacaagggccctgcttctggaaccttctgaacagtaggtatctctaatatgttcttgctcttcctgcataaaccaaagcatatttattgacaatttttttacggcctcacttttaaggatacaacaattgtatccataaaatacaattcctaattgtacaaataattaggaatgaaaaaaatgaatataggatttgaacaccagcttcatgcatttcaagtaaacattacaatccagcacagtaacaactacccatgtttgtttctaaagtaaatcaacaaaaatctatattcccatttctctggaattatgctttgttttttatttttttaataacatcaagccattttagttgaatgatacagaaagtcactttgaattcaaatataaaataaggtcatccatcatgttaacaatttaattacctgagtatatatttttccagcaaaacaaaaaaaacattatttgttgtgtatcttattactgagctgttgcctcaggacagcttggctgtcagtggacaggccctgtggtaagcaatggtgagatagggagcagataagcctggcagtcctctgcctttctttcaggccctctccatccgtgtttcctggaggccttacctgttagggtccttgtaatctttgtggcaacagtgaaatggtgacttgtaaaggcagcgaagcatgacagagagagagaaagggtcgaatgaaatagaaatgtgatattttctatcttcggagggcccaggaaataggactccagctgccgagctggggtttggcattcagtatcacaccgagtacaaggaatgttgtgagatttattatttaggactcatggaagaggcaaattaaacaatgcactagtttctcttattgtttaagtagctgccttcccagtgatttcagataaaggtataagttcagcactgaggaaatgagatcagaataagggaggcaaattggaaaagaacagcttctgggttcttctcggggcgttggaattgccgggctacctcccttttgaggactcaccaggtagcaggcaaatgtctgtaatgtgggtctgttgctgtttgcttgtttgttttttaattgtacaccctgactcctacaaatacctataacaacacaacctaatacgttgatcatatagcaacaatcctttctaatctagggagtggtggacataaaaatggcaaggaattttttgtcctgcttttacaattttatgcactatggtggttggcagttttattttggcctgattccttgcagggagcgttgtcaaccgtggaagacagaaaacaaagaccagacttaaaccaaccattagtacatgctgcctgtttcctggctggataatgttacaagaagggaaggtattctattcttactcaggctctgcatcgaggataagttttgcatttcagagtggaagactaataagtgatagagacaacagggcttggtcaacaacttgggtatgaatcacccaggtagcagagggggaagctgcctagaaggaaatctttgcttctgaacctcatccaggcagccctactgggtccctctctcatttaacctgagagaacttagttcaagaaatacgttcattctgttcttgcctcaagaagagctactgatcattttatggttaaacaaatccacagaagtttcttcgaagtgaatttcactgtggatgattcagaaattgctgatgatggcaaggagagggtagattttcttatgggttccttgataactttacaaatgcatctgattttcacagcgaatgcatgttttcataaatggaaacaaataaaacagtaggcaagggctttttcaaatgcttgccaagtacattaaacacacaaaagtacattcacagcgaaagttggttgaaaacagctgttttaaaggatttttgttgaatgtagttaacagcatcatcattataaggcctgaagcaaacatgttactgattacaccccattaagaaattggaatgcattcccccaaggaaacaccatagcacatgctatttgaaaataacaaccagctccaaaacgctcagctaagactttgttacggattgtgcagcctatctaataaagataaaactctcaggaaaatgagagtacatcttatcttaactaatcagaatatttttcacaatattgtttgagtggaggtttccttggcgtctttcaccttttccccaagctggctctgtttactgcagtcacacacttgtagctgaaattctacaagataccagatatgaaggaagttcggagattcaacttgctattgcatgcaaattcagctgaccatttgtttgaatgtgaaactctatgtagttctaagtcagcttcttatcaaatgttgtttatcctgggagcgcagagtattcttcaggtgggacagaaagctctggtggggtctgtgggacatggaaaatttaataaggaccatgggattagggctctgagaaataatgttcatgtgttgaaaaggcactgtcaaaacgccacagaagcagggctgcagagcgtctgcagctcagctgttattgtccagcctgtgtctgtgctgcctgtccaccatggcacagacacggctctacaaacacttttcataatggcccagaagcctcctgagggccctggggagttaggtagagaggaattcaaagtccaatactcggtaagaagaagttaaaaaaaatttttaaggcttttataactttacacacatctgaaagagaggtcagatttctcctggtgatgaaagagtcaccgctggggactaacctcctttcacaccatgggggccacaccatggatcctgttgtgaagggcaacctcccctctcccacttcctgaaaggtggggtcactgcccgagatggtgaggaggactgcaatgtccatggaagtactggtgtcttatatacatgtaaaactcagtgataattatggcaacactaacatgagaaattatatgataataaattaagaattttgtagttattatttcactgtgtcattcacctttgactcctagtgatgggacttttgatgagtgctttaagctttgtgaacctctatgtccttattttttacaagagaattataagacctatcatatacaacttttgtgagcagcacattcttagcatatatatatggatatttatctatacatttgtatatacacacacatttgtgtgtgtgtgtgtgtgtgtgcgctcatatactttaaaaaaaggatgtcagcattgcttggagattcagggcctatttgaaatttaagattgtgagagaggcctaattatttgttaaaggggagaatgttcctgggaaaaatccttctcctccaccagtttggaactttggagaccctcaggattaagctgagggaaaaatagacttcttaggctagagtgcatccctgcccagagtgatcagggatcctaatctcaacgctcaggattcccaagaccacgaaggaggctgctagaatgtgaccccgtggtttccgaaaggtaattatacatgccagatggcagtatctgggagcaggcggtatcgtaaatgcagttccctgtgtcgtaacctaaacttcattttcccttatcgcatggttcttggagtgtggaaggctctccttgggcagagtcttgatgggagagctctgaactcagcagagaagactgggcacaaagcctggcaccagcaattggcctgtgcacctgaaggaactatttcgaatgggacactctttacaaagcaccttttgtccaggctgacagtgagtgtggggaaaactagtggaaatggtgataagtttattacaccaaaactttgatgtaacagataaatctattattgataacactgcaaccatgagtcttgggaaatgtttttgataacatgacacaaatattagtattaccaactatcagtagaagccatttgccagaaaaaaaatacaggtgattttgaacaaaggcaatggtgataggggccagctaagaggccaggtaactatgtaactctatcaccatttcctttttcaatgaattgtgggcaaggtaaataattttaaggaacctacatgtaaatgcatttcagaaataatttcactacttagagtaaaattgatgtattgtccattaaatatgagagagatgccagtaaaattgtacccagaaattctggagatgagatctataattagaaatttcatcttcacaaatgaaagtgagctgggaggtacattctttatcatatgagtattattctgtcttattattgtttaaataattgaggcaatgtattatttttcctggcaagcaagctatttttttcttattatacaaataattatctcttttttttttgagatggggtcttgttctgtcaccagggctggagtgtagtgatgctgccacatccagttaatttttaaattttttgcagagatgaggtctcactatattgcccaggctggtcttgaagccctgggctcaagtgatcattctgccttggcctcccaaaatgctgggattacaggcatgagccaccatgcctgacctctttttttgtaataagtgtattcattttcttccataaaccctcatccctttctccctaaattctgtaatcatttactgaacatctattatattctaagtgcagtttaagttactagagagagatagagaaaataggttgaatctctgatcctgagcaactcatataacttcttttgttcgaattctagatgtgattgaagtcagcatatactttgaataacattgtccccatggaaaaaaaagtttctcatagaaattaccgtaaaaaagggatctctcaagtgggtggccatatgccagtggttgcattggggcacagaaaaaaaaaaattaagaactgtttctactgttatacactcatatttttatttggatttatcaatatacatattattatatcatattatatattagtacagtagcataattgattaatttataaataaatatattaacatattggaggtgcacactcaacaaattttattgatgggtatgtgatgataaatgcttgaggactacagctctagattacattcttaatgagggcaaagggcctggccatcttgtttggccttttactgtgaatggcagcgtcggtcacatttgggcacctaataaatatacagcaaagaatgaataaatgagtaaataaataaacaaatactttctctttcctttacagctgctaaataaaagtggtctatttaataaattcattattcatagcatgtggcaatgtgctagacagaatatattttataaaagaccctgacacagacatgttatcttctccctagatttggggtctaattgtaggtctatgcagcatatctggggggataccttcttcagggtttagcaactcgatatccctcaaatcgcacttcatgggctactcctgtgcatattgcttacttgcttgaccttgaaaataaggtactgtggagtcaacacttgaaggaatccaagaaggttatctggttgatctcatttcctttctggatgagacaatacagacaaataggcttatactctattttaaacaattctatatcctcccccaggaacctaattaagtgctggaatttgggtttacttttagagataatagatatttgaccaagaaaaaaatatggtaatggtaagttccttaggtttatcgaatattcagtgcttaacattgttattctttctcctcttctttgtttcagtagagaggaggatgtaggttttgtgaattcatagaaagcttggaggttggcaatatagtcccaaggaaataatgtgcaaaacaacaacaaaaacccaggtgactaaagttttgatattttctctgcaaatgcattccttttaccacttccatatttacggttcaattaagtctttttttaaaaaaaatttttttttgagacaggatctcattgtcacccaggctgaaatgcagtgttacaatctcagctcactgtagcatcaacctcctgggctcaggtgatattctaatctcagcctcccaagtagttgggactgcaggtacatgccaccacacccagctaatttttgtaattttttatagagatggggttttgccatgttgcccaggttggctttgaactcttgagctcaagctatccacctgcctcagcctcccaaagtgctgggattacaggcatgagccacaatgcccagccctcaatgaagtcttttgcaaataaatcaaacatatgattttgatgcatgacaagacaagcacaatgataaaaatgaatttaaatctatctgggatcatgctttagagttcacaaagcattttcacacaatttatcacagtctcactcttacagccaatcagtatatgtttcccaattttgtggagaagaaatgaaaatttcaataagtaagtgacttaaccagggtcccgctatttctacacccagagatacttcctctacgttagtactcctcagatggcaatgtgaatgtgatttacctgaggtccttgattaaacgcagaatccgattcagcatttctggggtggggatggagattctgcatttctcacaggtttccagtaggtgataatgcttttctccaaagatcacactttgagtggcaacattctacatcataattggttcctatgtgacgtgattaaagataaccatgcagagtagctttgtgcaatgtgtttaggacattccaagccaaaggctttgaaattggttatgactggttcctgcgggaggagagcaatcataataccacgaagagttaatcagtcattctcctttctaaacttctctcaaatatgttctcttctcgatttcacttctgctgcttccattcgagccatctgtgtctctctgctgggccatcacaacagccccagattgttggcatctcttatttgccatcagcctctcccactggcatcagttctttctgtctaaaatacaatgtcattatgctgttcccacctttaaaggcccacaatggtgttcaatttccaatatgatcaaatgcagtttttgagcacagcatattagggacttcacagtttgacctgtccccttcatccatacctccagctacagcctacactgtggccacaacccctccctatttagctttagacactgtatttcatctaccccaaacatctcacattttccaatatagtgtgcttgctcttttgcttccatggaatttcatttctaaatctgttctatttctttactagatctagtgacaaaagtttttacaatctagtgagatagcaggaaatgttccttacataaatatttgttgaatgaatacactagatgcctgatataactacaatcattgttggattagtatgtgaggttggtaaatagttacaaaactggaaaataaaataagtaggcttggatatttgcctggatttcacaaaaagattgttaaaggtaatcatattatggttaaagaatgcatggaaattgcagagcagtttatttagctgatcttgaccaatggcatgcttacagtaaaagcaaagggaggtcctaactctagattgtgcctcatcccgtggcatgttccacagacatttctttcccttcttgccaatttatttcattcagaagagtaacagtctgggtgacatgactgataatgttagctggcccatttgtatttctctcctctgcttctgttctgcaatttctgtgagactgctgttcatttctgagatctccatgaaagaactttaaagggtggtgcttttaaaaatcttgacccttttgtaacaacaatgaaatatcagtcttgtgtttgcaagcaaaatagcagagcttttgcctttggggaagcaagagaaacgacaatagccaaagggggcagtaagactgttctgttagaacatcagtattcgtttttgttaaaaaaagaaaacaaaacagcaagttgccagagaagctaattgctaagtaaaatgtagattgaatattgggcaagatgttaaaaacatgtttgaataagtaaatattaactaaacaattagcaatagatttgattatgctacatgaaacaaaacggtatgtgtataaacacaaagccacatacatgcacaaacgtgtaaaatatctttaattttcaggaatgaaattctctagcttttctattatcaggaatctagaagtttcccttttcttcttttgctctcttctgctccccaaatttccctttctgttctactactacctacttacccgctttccctcctcttttcctcccctcatttgtaaaacatatttcccactgaacaactacgtaacaagcaacttactctggtcttttttgtgtagtggggggaaggaggggaatgtggtgaggaagaaactgacccagctaattccaatgttccagacagtgaacaagacattggattctaaatataagacaaaggcatgattcaaacctcaagaaagattgagatttggggtcaggagccctaaaccaattctaagttgtgaagatcctggtttattatggtggtggttgatgtgaggaggagcaaagctcctgcctaatttggagagaatgcttagaaattgaaagtagagaccaaggtagaaacacatttgagtgaactaagccaaatctgaatgaatgacttcttaatctaacctaaaattgtatcaaatgatgggggcatagtttttatccctttcattcagaagtgactcagcaagcactcctgagcctgcctaggccagagcacagtgcaacatagttcatatttggaatgttggtgctttcaaagtactgaatgtttttagtgtctccacacctctggaaaaaactggacagttcccaatatatgacttgtctcttcaaggttaaataaatgctcaaacagtgaataaggcaagggaccgaccagaaggagcttgagttcgtcatgcatcaggaaccttcattgctccctttggactgtgctggccaagactgctaaagcatttccattgactattcagctctaccttttccttatgttgttgtctgtcattctagtacattggttatcagacagattatgagagaattaagatgaagaatcttgtagttatatagatgaacctgataaaactttccagctaacctttggaaaccatccttagcaggtactgtttctgagattatttgaaagctttaattttctatgttggcttttatgttacaattctcaaaataaatttggaagccaccaagtttttactgcattcatttggtttactgcattcactgtggtttaaagtttatattcaactactaaaaataaaattgatcccagttaaaggcatttaggactggatctaaatgacttgtagaactggacttgtccaatatgcagactgaataaatcaccagagatttttggcaagatcaaggcctggcttgggttgtgcatgaaattccgatgatagcccaggaatgtcaggaggcttaaggctaatgtggtccttttaagagagagtgagaaataagagagaatttctgtatatgttggtacagagcctgatgaaaaacatgaagaaaatgaacaaataagatccctatacattgttattagttaaggcgtgccatcattcattcagtgaatgtttctggagagttcactttgtttcaggaattgtgcttgatactgtgtttgtaaatatagcaactgttttatttctctactaagttggtccactttagaaactttgaaccaggaacttcagggttaggaaagaaaactctgagacgtccatgattaatggaatggatttgcgcttttctggagcagatggtacaggggcatctctttgggagaaaccctggttggaagtcaagaagaatgttttgcggtgtgagttcccttgttacagtcatatttaatagttagagcagagttcacatctgggaccccttggagaattagccattgtgagaacagtgaaccaagaggaaaccaaagtaataaatattggaaggcttgatctgatctcttgcctgtcttcaaaggaagcttcatttgtaaaggacatgcatgatcatgaagaaaggacccccattaggcaatgtggaaataataaaagactatgtccaaagtccctggtatagggaggttaggggactggctctgtgctcaactgggagagtgatggagctggactaaaattcatctttggttcccttttcagagtcctctgcttcatagagcacaattctttcgttttaggctacattaagatttatctgaaaaaaacttctgcatagaaacagaagaattagaacctgatgagacagtttatgctcattcgactttgttttttctctcttaagtttttctttcttaagtaagaaagtgtttcttatcccttttttgttttcagggaggtagtatgtttgagctcctcctgtgcttacggagtcaagaagaaaatgaactattcttgaatacccttgaatacccttcacctgtaatactaaggatgaagaccagagaaacacattgaggcagatataatatacatacccattttctctcttactctataatgctgcctgatgtagtttgaaagtatcctcataatctaaaagaggggaagtagcctcatggagtgaaatcctggtactcctagaaaattatgacagcacttgtgtgtgtgtgtgtgtgtgtgtgtgtgtgtgtgtgtaacataaattagctcatgttgtatgtctttttgcagtttgtgtttttcattaaatatgttgtgccttataataatagtagatactttatataatgctcactctgtgctacgcacttgctatgcactttagaaacttcaaattatttaatataggcttgctacattgttttaaattacatttagtttggttaatctctagtttttggatatttaaggtgattacattgttttttgtttctataaacaatgctgcaccagatcttcttatgcgtaccttcttggataagggtgaatggttgcaaaggcataaagaagatctagtacacatcacctgataacagtggttgcctttgaggagagggagcagacatagattgagttgtggttctaggggctttagcttcatatgtcatgttgtagactttttttttttttttttttttttgaggcagagtctgggtctgttgcccaggctggagtgcagtggcatgatctcagctcactgcaacctctgcctcccggtttcaagcaattatcctgcctcagcctcccgagtaggtgggaaaacaggcacgcgccaccgtgcctggctaattttttctatttttaatagagacggggtttcaccattctggccaggctgatctcaaattcctgatctcaggtgatcctcctgccttggcctcccaaagtgctgggattacaggcgtgagccactgcgcccggccataggacatttttaaacaaaaacatagtctcgtattacttgtgtgttaagattatttttaaaaataaatgtaaggcttgaagtccttaggcacataacttaaccaacctgatctttttaccccccactttcaaaataccacctaccataaatacttgatgtgtggctatggcagacaaatgcagtgttatatgttaccattgctttataaagtgctaaatatattcaagtgactcttattctaacatagctagatttcagtcatcagtaaaggcaccttagaatccacaagaagtaaatatgccagtgagcattccctagttttaacaaggctatcatctgcgttaaaaaaaagaatacatgttgtgttagtaagaattcaattcagcatgggaattcacatatagctttgaaatttcatatttacttatgtaaataccagccctcttaatttattacaactttacttgttagaatcaggagtacttttgagaactggtattgtgtccagcattgccaacccatttaatctgtaactcacatggtatagtttctggagctttgtttcatatagctgttataattatatcatgtgaacaccctgaacctgtgagcatggaggcacacacatgatcaaattgtagcagtaaaaaagaaaaaagaagagagtgaaattaaatagtgtattttaaattgccatttgcgtatcattagaaaactaagatatttagcagggtaacaatgttccagcacaggtgaccttggaacattatcaaatcttcctgctcacaagatatagcatactttaaacgccctaggcaggagaccttccaaaaacagacccaatgacaacacctagataaccatttcaatcctaaataaatttcagtgataaaaatgtgtataaatatctaaccctatgaggatagaaaatgtatagttggctcctttctgtgtaagaatgttcccttctgcagcaatctgttttgagatcaggtcaaatgttgccagttagttttgatttcctggctttttaaaagtccttgtcttaatgtcactactctgggccattcatactattttagcaggtcctatggtaagcatttctccatataagtacatgctttgaataactcagaggggaaacacacacacacacatttgtgccttttcaggtaaaaggacttcaatgagaactctgctagaaactttgctacctagcctagttattgccctacctgttttctggaagagattttttcccttctaaataaggattgagccaaagaaagaataaaggttctttatggtttaaatatgccactccctcttgtgcacttttatggagtgatgccttttattttagtttatattttatatctatgattacttcaaagtctattaagctctggaataagagatgcccaatagaactttcagcagtgctgaaaatgttctgtaatctgcactgttcaatgtggtagttgctagtcctatgtagctattgagcactagcgtgagtgaggaacttaatttttaactgtattttaaaaaattatttcactttaaattgtcatatgtggctagttgctaccgtatttgacagtgcatttatagatcattttatcacattcatataggactagagaaacttcaacatttatattgtagacttttcataaggaaaactaccccctttagttctatttagcattatttaatgtgcctccagaatttgaattcaaaccctattctccagggtttgttttgcttcaaccttttgatttcttcctgctcaacccctgtgctacattcagctagtaggtatttttggcaacttagatccagaaaacagtgtagtgctaagaaataggaaaatatacttagttcatgatatacattacagaatggccttattagatttcttattctcattatcaagtttacattatcacgtaaaacaagtgaatgtttattgaaagtgtatctttcctctattgaatatcaggcagacttttaaattggcagtactcctcactcatttttaggaagctttggaggccaggcacagtgcctcatgcctgtaatcccagcactttgtgaggtcgaggagggcagatcacctgaggtcaggagtttgagaccagcctggccaacatggtgaaaccctgtctctactaaaaatgcaaaaattagctgggcgtggtggcatgtgcctgtaatcccagctacttgggaggctgaggcaggagactcacttgaacccgggaggcagaggttgcagtgagctgagatcataccactgcactccagcctgggcaacagaatgatactccatctcaaaaaaaaaaaaaaaaaaaagctttggagaggtgtgagtcattcctgcctgttgaattttagctgtgagctggcttagtggcctccacacagccatgatagcacacagggacaaaaccatcctcttcaagggtttccaagagctaaattgccagtaagtaggaacttcttgctgccctatggggcctttgaatgtgattaggatgagcaacgattctacccagaagtgggtagaatgttgacgcagtaaacatgcagattactcgctgcatacaccctagtcttcacacacaccgcctaagataaaactgctatagagaaaccgtagcattcccaagcccttctctccggctccttctctttacttagaggccaaccaggatgcgcagaaaacataactgataccacttagataattattgactagttttagtgttgatgggggaggttgaattccttttctcttcctggttatatttcactgatgcaatttgcttatttctatgtggaagcatgatggtttttactctttgtgatgagaacttcagcgactgcaacaaaggtaatttggtaaagtgctcctacacagcatatatggctttaacattttgaactatatcctttttaatctatctctgtgattttgagtatgcaggtggtggtggatatacaaaatcatatagtgtattttgtatacccttgctttgtaacaaatgttctgatgccttatttgtggcaaagggatgttatagaaaatgtgttctaagtgcccacataaaacggcatgtgggcagctgaaatacgaccaactcatgcatgcattcctcttcctcttgaatccttggaaagtatctcaatttcctattctgtagctgactacctgtttttcatatttctgtgtttggaggaggtagatgcttcaagcaggagttaaggggatgaggtgtttctccttggccagcttgctgtcctctcacccttgctccagctctttcccgcagtcctccctgcctcccctcctctgccctcaccagatgtggtgaggtcgagacctcctgcacccagccagtgcccaccctatgacccttttctttctatttgaaaagtgtgagggatggggtaaggggaatgacattgccagacaaagagaagtttttcaaaagtgtatgtgcaactgaatgtgcagccagtgacttttgaaggtcacaggggccggccaggtgtgtaaatgatttgctttctccctttcttaacattcttattgggaagtcgtcatccacaccagcttctaagatggtctcctcagcattcagatgtaatttaaaatgtataccaggaccatgtcagaaaacgttttaaagattatctttacatatattgtcctcatttgctattatgtttctttaataatatataattttttttctatgaccaggttccttctgcccctatttcttttacctcaaaacattctggggacaatgtaaagaaagctacattgagtttgtctcactaaccagttgtgtggtgcactgagagggctaaggtgactgctaaggttttctgtagctccaggaatctgtgattcaattccttccagagcctatgtctctccccaactcccatgttagccacttctctttgactcccatgaatcatgttagatctccagtagtctctgggtcctactctgggaactaaggcactttcatgagtctcaggagagactcctttgcgtttaacagtgtgaattcaccctgccaaagggttaatcttccaagactaagtgcaagctgggtaaaataagcgaagatcaatggttgaaccctgtcatgagtggggtattcgatcatgcaggtttccagccagatttttagaaatttgcatcacagaagtcacctgggtgtcacactctgaggaacgctgggttaatgtgtggtgaacagaaatatcaagtttatgcctatagggtagttttcattggtatgagcttaagcacagaaaaatggccttgatggtgttaatttttttatgggcagttgcacgatggctggtctcggaatgttagctgcactgttgcagaactaaaaatgttaccctgagacattttaagagagtaataaatatctggttttaaaacacagactttatttttttctggaaaattctttttttaaaattttaagttctagggtacatgtgcacaatgtgcaggtttgttacataggtatacatgtgccatgttggtttcctgcacccatcaactcgtcatttacattaggtatttctcctaatgctatccatcccccagcccccaactgcaccacaggccccggtgtgtgatgttccctgccctgtgtccatgtgttctcgagttcagctcccacctatgagtgagaacatgaggaaaacacagactttaaaaaattataaacttggaaagtcttttttggttattgttgttgttttaatatcagagtgttaaggatgccttttccttttgtggctttctccataagcaattgcttggcttggtaatttagcgattatttgattgttgaaacattgggtatttgtgctttaacaaaaatatgcctggtgatgagactgtgtccttttatcaggataatctggcttcatgatgtgaagacgtggctgtgctcagggctgggggctgcaacccctgctgtactgtgccaaggatagtcctttgatgtagagggagtggttcccaagaagggcaggtgtaatttccagacctggattgcatgagtttgatgcatactcaggaaactaactgcaaccttagtggtgctttgggagatagttataccatgggaattgactcccttcggagaaatcggacttgtctttgttactgtctacgtggagtgaagtgctcaggccagggaaaattgtatctcacacttaaatatggacaagaaggactcaaactcttgtcaacatcttcaaaacataaaagcagtattacaaaaaatttaaaaaccagcaataatttttactaaagttttgtttggctctgctaatcacttttcttatagcttcaactttttcttgattaatattttaccatgaatttgggccagttattgcatagtctgtatgattattattgtacttaagtattagtccatccaggggcaataatttacttatttttccctctagtgttagttacttgcatggtttaaatttatacgattaaatttaacaccaccatgacaacaacaaaaaccctactgaatgtagctttacctattgttgatatgtatttaaagtaaatttccagcagtagaattatcaagattgtaaacactttaatatttgtatacatattataaaatttctgttcttgctttctgaaagggttataacagttttcaaagctttaggatataagtgtattttacctgcactgagtttaatatttaacataaatatgtttaatatataagttgtggaattataattaaatacataaatattataaattgcatataagtatatatagatagatagatagatacagatatagatataatctggaaccttaaattcctacttcaataatccatgaaagtgagcaattttttcacgtatttaggatttatttttcacttatttgaatgtgcattcctgtcctctattgtagttttcataaatttaacctagccacttggctagataccaacccatcatttaaaaatgtatcacttattatccagattctgataccagacatataggccagaacactgtccctttcttaccgggatcagtgagtttataactactatacattgtccttttttgttgagtgcgtttgaatatgcacaatgaaatgattattttttaatgactctgtaaggtaaatgcacaaaacacctacactttgggccaagtgagtatgaaatacctacacacacacacacacacacacacctttatatacgtatgcagctgttagaaagctaaaatttgaacaaaaatatttctattttccacttaatgaataattattgccataacacaaacctactctcttttaaagtttgaataaaattgaagaaaccaaaggtgtttatgtaattaaaaatagcaccaaagaactaaaataattagcttttggtgttagagaaatcttaaatgattcaagcacctgctgaagacatacttgggtgccagagataaatgatactctcatttttctagcattaagtgaggtttagtgaggaattcctattacagagagcatgactaggatttttattgagcaggaggccaacaaattaagaagcatgttttaatttggcaagatattaactggaatccagttgcattttctgccatggcaaacctacaaaataaagtgatacttttcattcttgagtcataccctgagtgcgttttgagttcattgcaactaaactcagtgccttctaattaaagcgttttgtccacatgtatttggaatttgttagcagggagatttttttaaataggtggtttctattacaaggaatcagtcaactgattttttttttttctttttaaagctgtatacagatacaggatggagaaataagcaatccttttcaaagagttagaaacttagcacgctgacttcagccctcacttaatcattaacttaatatgctcctttgggtagatagagcattcaaaaaagtctccatgcctcagtgtattaatctagaaaaggagagcagcaacataatggcaggctgaccacctaggaatagcatgagaacacgaaggtaaacacatggaaatgggctttgtgttcaccgagaggaatgccattcacagatgcaaagtggtattcaaaaactagttctcataaggtgcttattctctttatttcttaaagaactccttgctccttgaaaattcagacctttcatcttaccaggataggctggacttgctgctgtttaccaattaaatccgcttagtaattagaaactgtgtgtcttccgcccacccctcaattccctctccccacctgaaactcttaaacaaacactgggtctgtgacaaatggtgcattttaataaatgttttgtaaaggccaattatgcagtcaatattgagttgtgcgataggaaatacagctgcttggctatagggaagacgtctacatactactggcatctgtttggtaggtaatgttcttaaatggcctggcctttctccagactttgattattcataaatctgttgagtgcggtaagttgcactattagcgtttaatcttttattgaagcaaactcaggaggctgaaatctatttgctttagcaagcttgttcactgataaaagtatgatgtaaaattttccttttgtgaattcctcagtacaagaacaacacagctgggcacagcacagatcatatttatcttttcattaactaaagtacaagaagatagcatcattggaggcttataagaagggactgctaaagaacagttctcctcctgtttgcatacccacttgagaaaagctttccaaacaagtatttgagatacttgtgagaaaaagctggttgacttgtccaaagaagaccaagtgaatgtatataaagtggttggatttcagataacatttttcccctgagtgtttaggttggttaaatattagaggaggagagataataacactgtttgtcgccataaacttagacatacatcttttttcacaaggttggtatgaaaagctatcaaagattttccatcccagatgatttagtttcaacttggtaaaggacattgtagatggagaaagattgtttggattgtttccaggaacctggaaaatttgtatagagtttatcatagatacaattttttgcttcttgtgaataacgtaataactaattggttgtgtggtgcttatttgcaatgtgcactatacttggccatcaggggacatcttccagaatgaaataagtgacttatggcttatatgtcttaatgtaaattctttaagtgggtgagtaagacaaaattatgggagtcttctcttccttttcctgcatctctggatcatgaggattgtgattattcgtgtttctctagttcctccaacccctggtaaatggaaagcaactgttggactctgaaaaaaaaaatggactatgctaaagatatgttctccttttgtcttttctatcacatcccagtagtattcaggaaggactagggagtatggagaacacagaagggaggcccttttccagtcaaatgtagcattacttcaatcaccttgagctcaactcttgcccagggctgtcaaacataggctaatgttccatcccaggggtgaggttactttattacctactgcccaccccctcagccccacaggtccctttcttaaataaagctagaagcaagtaagggcagctctttcctgcctccatttacctatcgtggtctcattcctgtttccttaggatcatccagcccaactcacttattttatagagaagagacctgaggccatgagatgtaaagagaggttttaaaggccatacggtctatggaaaggcaaaaattagacaccgggtctcaatcaacactttttcaacttctctattatgtctgtgtgagtaacagagaccccaaaaacagtggcttaaaatttaaaagaaatctgaagactggcaggcaactgctggtatggcagccccatgatgttctcaggaaccctggatccttctaacttcctgctgtagtatcgtaaggtgtgaccttcaatctcacattctcaacatggttgcaaatcgtcagccatgctgtgcatgttctaagcaagagaaagctaaagaacaatgaaaatagtgcatgtccataagtcagtcccctttgaggggcttttctggaagtctccacccaatgataactactcattcttaactgaacctagttgcaaggcaatctgggaaatgtagtccattctttctttctcttccctctttttttctttccttccttccttttttccttctctctctctctttccctataatgacctgaataaaattggatctattagtaaggtttaaaaaaaaagaaaaggaattgatattgaataggcaacttcttgtctctgtgcccttatacttcatattaagtaattactttaggatttggaagcataataatatttgacagaagtttttcctttaatagtatgtcctcaaattgccagtattaaagaccaaatgtaatatgggacaagaagtacagattgctttatgtgagtgaaacaatgggagaaagctaagaaactattgtctctgaactgtgttggctctccacgttcagtgagacactggttctattgttgccattggcttggaagtgagcctggaaacaaatactgatgctgacttcacctaggtatgcttcatagatgacaacaaaaatcatttaacgatttagaagtaaatagtttgcttattttgccctgtacgtttaatggttataccattttcaaacacttgaaattgcaacccatgttaagtaacttagaactttgactaacaatagcataattacccaggtcttaatgtggggaagtaactgtactcatacacaactttactaacagatgtgtttatgggcaacaccaaggagaagttacttgcaaatatctcattggtcatgagatttatgatgctgcctggctgtcaatttgtcttttactaaggttagtttccttttttgagttaattccatttatttatggtgatctaaatgtaaaataattatttagagtaggaaattatcaaagtaaaaatcctccttgatgtctgactggcagccatgttgcctcataaataacaccctgtgtgtatagattttgttcttgacaggattcagagtagagaactctgaagacatcaaagagatttcaagaagcaataatgctagaagcctcccacatctggaaatccattaatgttactctgtcccctgagtaaagaatggcttaatagcacagtactgctgcctcgtacctccttgtccactgactaccacactagtactgcagaagggacagaggtcctagcgaagggaaaggattatagagaattagaatctgatatgccacctgcatgagaaaacataggaagtactgggggtagaacacatcctcttgcattagatttctcctaaagcatgtgacttagtatgcgttattaacttattgttttattctcccgcttttagtgttccattgtgctcaaggctggccagtggcctatgggttcccagctctctgatgtcacacactccttcattccaaatctctagcttgaaaagaaccttatgatgacactattcaacttcaatcttccaatgatgacttctatgtcaaatactaaactctctcactattttaaaaatggatatttagaactacaaattagagacaataatcgcagtacatactttagcaaataattgttgcactttcttgctatagagaaggatattgcaaatatattgattttcaagtaatggagtttctttggagcccatctctgtctgcccacacagcaaggtcggtcctctgtctgcattccatcatgcctgcctgccacatcttatcagtgcagagccctatgaagaaggttctatatattagccacaacatgacctatgtggacaagatcatccttagtaattactcactggtggagaagtgatttagaatgaataactcaacaatgccattatttaccatatatcatagccatggataaggttaaaaaaaatcttccttcaaattcgggttgatttatatatcaagaatattggcaactgagctttatctaacttttttttttttctgttttgctgctgcttaagaagatcttagttggtagagatcctgacagttccagttcctgactaatgtaactactcgaagcaacagttagccctgagcacagtccccagccaggatcttggcaagagtccatgggaataatctctttctcttggcagctgcctgaacagcagtttgtggaaaggactgctgtcagttggcaggatgagggtgggtctctacagcacattaattaatgcttactctttaggtagaaagcttcagaaacttgtataaaataaataaattaagacagtatagtatgtggtaatttggacagtgtatttgaagcggagatatgtctcatagttggaaggatgagagggtacaagagaaatggcccctgattatttatttcctaggtatgtcaacttctctgtatctgctttcttacctgattaacaagggtgttggattagaagaattctaaggctcccttccttctagcattctgtggctccatatggactagatagtctcagaaatgcaatatctgcacttgatacttcgcttttttttaattgatttataacactgctacttccacaaagcacttgaggcatcttgcaactaaaataccgatacaataaaaacaaagacatgtacaataagataaatactgagaagtaaaagaagggagaaaacagtatattcaatcaattttgatgaaagctagaagaaagtatagaatctgtctctcagcctcccatcagccaaggcaaaaacaaagatcaacaacaacatcaacaataaaccaccaccaccaatttatggaaaagaaagtagcagcagtgtttattttcccattttggttgttaggttcaattttcccccaggaatttggaagttaagtagtatgtcataacatttggcagagtccacttagatttcaggttttgattctaaggacatacatcctgaacctagaatacctgtcatctgaatctactctgtatggaagtgatcatattcctattctatctactaattagcatcattgtttttcttatttctacatttactttcactactgctctgggccatagtgggttttttttttccttgtggaatacaaaaataattttcatttgttatctttctaccaacatactatataatttgaaatattaaaataaaccagaagtaattttatttaataaatatttcattgacagtttaggatttgtgctcatattttccctacatccccagttccttcatgctaaaacaaaaagaaagacattactatgtaagcaaacaggccctttttagctattataaccaatctttattaacctctgatagtctaattcctatttactttaagacaatgaactcaaaattttattcagtattcactaatgaaattaattgaggcctagaattaccatttcctatttcattcaaccatcctattcataagtaaaataatgtttaaaaatgaactctgtgtgtgtgtgtgtgtgtgtgtgtgcaagtgctctgcgtatgatcaaaagagagagtcacacctaggagttcctgttctgtcaatattcggtggcaggacttaaatatctttcatcttggcagggcgcggtggctcacatctgtaatcccagcactttgggaggccaaggcgggcagatcatgaggtcaggagatcgagaccatcttggctaacacggtgaaaccccgtgtctactaaaaatacaaaagattaaccgagcatggtggcgggcgcctgtagtcccagctactcgggaggctgaggcacgagaatggcgtgaacccgggaggtggagcttgcaatgagtggagattgcgccactgcactccagactgggtgacagagcgagactctgtctcaaaaaaaaaaaaaaaaacatatatatatatatatatatatatatatatatatatatatatatatatatagcatcttgaaaaaaaggcaacaaatagctagtttaagttcagctcattgtttaaggtaattaatgggttttcttgttttggatcaaagaaaagacatgagtaagtgttagggaaagaggcagctgagctgaagtagtgattgtttctcagttccatccccagcccttgcaggggtagcaagcagcctggggcatctttaatgtaactccttgcctcctgtataaaagatgtgcctctgtggcaaaacaaaataaattcattttttcctgtcattgtattaatcacagtaattaatgctagctgcctcaacagataaatctcatggcttcacacaatagtttatgtcttaatcgatgtctaatgctaggtggtggggggctttctccagaaatgagtttgaggacccaggttttcttgtgacactccactgcaataaaaggcttctaagttcaccctgggaggagaagagaataatggagaagaatcacagactctaaagagcccagcctaacgtgacccgtggccttcacctacatttcattggtcaaattccgtcccacgactctctatcagggcaagcagagctggggaatgagatgagtaaatgtaggaattgatacagtatgggaaaatttgagacaactttttcttgatatctgagaagcatcttgtgtaacataaaactgattgcatgaggaattagggagggcttcccagaggagacattttagctgagcttttacatttgagtaagagtttggtcaggaagggcattttaggcgcaaagccttattctcctgttgtgagaatcaaataccaaaatatgtgccagtgttctttgaaattaaggtatattgttattattaaaatgctattggttagcaacagtctttgtccaaaagtggcaaagctttattttaaaaatcaggatgttactattagaagtcagaatgtaagctcattgagagcagctaatttttcttggctcgtgtccattagtttattccaagctcctagattggggcgtggcacagggtagacgttccataaacatttgagcaaattacagaacttgtaaaggactcagtcccactttctttttcctgcaaagactaggggcaattgcttctgttaaaatggcctctttgtagctacagatagcatgttgagtcagtatttagaaaatgaatgtgcctgtctgtacttctgcatttgtaagcataaaaacacacaggtgggcactgcccagcaagtggttaggaccacgggcactgtatcactgacatattcttcttcttttgtcgtcttcttcttcctcttcttcttcttcttttctccttctccttctccttctccttctccttcttcttcttcttgagatggagtttcgctcttgttgctcaggctggagtgcaatggcacgatatcggctcactgcaacctctgcctcctgggttcaagtgattctccttcttcagcctcccgagtagctgggattacaggtgcccgccaccatgcccagctaatttttttgtatttttagtagagacggggtttcaccatgttggccaggctggtcttgaactcctgacctcaggtgatctgtccaccttggcctcccaaagtgctgggattacaggcatgagccactgtgcctgtcccttcttttgtttcttaatctgcatgcacttaagaaaaagataattgtggctaatttatacagaactataaacatctcacatgaatcatttggtatgaggcacaattagtcaataaatatagtgctccatgtattttaaaatctattcccaaataaaaactaaagaaaaataatttagatgtattaataaagaaaaaaatatttttatcttttagaatatcagtttgtcccttacagtaatgtaaaattacatttattttatctttaggatataacatctcaaacagaggctattaacttttacactatgtgtaaagaaacaacttgagaggcaactttattatgcaaccacgatcatgaaggggatgaataaaccaactacttagaaaaaaaagtgctctattatcatggaatggttttcattgttcctttcttgtatttctggaatcactagaactaatctccaatctatgcactgaattttgacatacgataaatgccatgatttcattaatgattaaatacttgtctgaagtataacttttaaatattcagtgatgatattcattgacaagtgacaactaaatctgtttctcctgcctgcaaagaactttagggataaatatttatcctgttttatttctctcagaagctcctatattgacccaaaagtagaaaaatctagattttattccaacatatattatcattctcgacaagtgcagaaactgagaagggagaaaacaaagctcaatgtatggctattttagcagcctttgatcatgttggaatatgggcagtgaacggagactgataaactcatgcagttctttgccataaaggctactttagcgtgaagccaaaaaatgagaggggtaggcttacttttcgcagatttaaccaagaacaatgacaccatttgcaaccacagtgcagagccaaaaaaaaaaaaaaaatcattgcatgcttgccaacatatgctccttagagaataactggaaaatgagaaacgcctgtcagagattaagttctatttctaatgcaagcacaaagcagactgatgtctttttaatgaaaatgaacatattacaacagatgagttttatttgttagttttaatgtaagttctttagaactctggttactgggtatatttttttaaaaaggtaaattttaaaatatgatgagtaagtctagccaattttggcaccaatataactaaagcttttagtggaccaaatgtcagggagtccaatattatctaaaaataaagggacacgaacctattaatacccactaataagaaattaaaattagagattaatgaacatttcccccattttgtacctactttcagtcataatagttaacatttaaatcgttgctctgtgtcagtcactactctaagcactttatatgcattaactcattaatccttcataagaacccattttgcaggggaggaaactgggtcagaaagagattaacaaatttgaccaagatcacacaacaagtgatttgtgaagttgggattcaagcccacactgtcagactccaggggctatagacttactcaacatcaacatatcaccctgctttcagcaaacacattcttcgttgaatgcttttagtcaatatgctctggactcaagtaagccctccaatgagaaagcagaaaatatgtttttttgagacagggtattactctgttgcccaggctggactgtagtggcctaattatggctcactgcagcttgaccttctggggtcctgtgatccacctgcctcagcctcccgagtggctggaactacaggtgtgtgccactgtgtcaggcaaaatttttttttaattatttttttagagatggggtcttgctatgttgcccaggctggtctcaaacacctgggctgaagcaaagtgcttgggctcccaaagtgctggaattacaggtgtgagccactgtgcctggcccagaaaatatttggccagaagaaataaagtatgatcctaatagaatccagaagcgtaagcatagcactaaatgatgcccttaggcctgatcttcaagccagtcatactgtataacgtaagatttgagccggtgtcggtatcttcagacatgtaggaggaagtgatttaactatgaacagttgtaaagtggcagctgttaggacaacccaaattgtttttccaagagaaaacaatccacacttaaaaaaaaaaattgggccctttttctttttgtcctggcttctgtcttggccaccttggccacatagtgttgtctgttaaatataataaaactcattagggcagtccttcattaaaaatggcatcagctctagaaactcactatttaagcttaaaggactacatattcatgatagagtcgagagcctgagatttgggatgcaaaaccatagatgttgtattgtcagtgttcagcatgtgacctgagtctcatctgtaaaacagaaatgctagaaatgaccactttatttggttattttaagagttacatgagattaaacatgtgaatacaatgtgaaggcacttttaactgaacacagataatagtcgatattattaaccttaaatacctccaagtgacttgatgggtgttagggcagtggaggtacttaaaatgtttgtaacaacacttttatttagtgactttgaaaaatacagcctactgatcactctccattcacagaaatttgggatgagtgtatcttcagttttcagacagcgagacataattcctgaagtaagcattatctaaaaggtagaagtcagctgctaactaacaacaatgacacctcagaagcacagaggtcagagaaaggagccaagaagagtttgatgaagggcttagagcaggagtggttactccacagtttaacatggcaattgactcagaatttagaagaacagtaatagaaatactaatggattcatctttttaaaaaaatgaataaaagaaaataacctatgacttgggtaacttgcttcacctcctgggcttcagtttccaaactgtaaaatgaaggttattgcaagtaaataaattccaaaatcacttctagttctaatctctggttttccagatctttctatagttctatagttctttcccaatgtatttgtcatacattttctggaatctactttttctttttctttcttttcctttttttgtgatggagtctttctctgtcacccaggctggagagcagtggcgcgatcttggctcagtgcaacctctgtctcccgggttcaagtgattcttctgcctcgaactcctgagtagctgggattacaggagcgcaccaccagcccagccaatttttgtatttttagtagagatggggtttcgccatgttggtcaggctggtctcaaacccttgacctaaagttatccgcctgccttggcctcccaaagtgctgatattgcgggcatgcgccgccatgcccggctactttttcttacactgcatgttctttgcttgtatttgggggttacactgctatcttgaaatgagatatcaacataggcttctatcaatagttaatatataggttacatctctaaacgaagtggaagcatttatccacaccattacggcagctcctccacagctcacgggttttacttgatggttgaggaaaggccaaattattatgtgcccgatggaaaaaagggaaagaaaaaggtgataaacttatatatccaagttttctctagagaagcaatcacttttgccctccttggctgagttgccatagccccaaagtaggaagaattagaacctaaaaactgtgcaaaaatttcacagaatttggggattttcttcaataagaccttgaataaaaatgtgaagattaaataggtgactagcctcagtctaatactgcatagaataaactgttacaccaacataaatatagagtggtaacaggagattggtcaattttggtagagaatttaagttttaatgccagaaattcaaaattatcctggcagaggagaaggatatgcttaatgttttctggaagacacatgcaaattacctcatctttgaacattccctagaggctattattattattttttatcccattcccaagtattactcacaaagtggaaagggatgaccaatttcttaaaatgctcttgacactctttggtgcttataatgtatatttgtagcctccgctgaaagcttaggtacatgtacaccaatctatttatatttaccttgttttgctcattcttttttcttttaaacatggatattattttaattgaatttttaaaaaactacagtattttcgaaaaaccaacaggattctcatttttggaccacttacaagttgtttttcttacatccatcatctttgtgctgtctgtcttcctggcagcctgccatgaagctgtttctgtttgctcagctctagctttcctattctaaaacttatttcagaagaatcagcatcttgccctctcggaagttaggagatggctctatgcctactctacaatgactgggaccctgggaaattacagctgttggcctcagtttccacatctgaaaaatcatggaaatgggcatatgagaaggtaggagcagggagctagatgtgcccaggcatctttcctgtcctatggctcaggacctctcttcactgaacctttttctactgatgactgagtgtatctactggatccagcttaaaacacgttgatagtaaccaacatccagcatctcccgaaggagatgtgttacctcttggactaactccatcttttgcccacttgaaatctgtgttattgaaggctcatttttattttacgttctcctagtaaaagtcatggccatttagacctttgaaatgactgttagaaataattgatcaaagaatcaaataatatcttggtgctggaaagtgtatcccacagaattatttttacttcaggatgacatatataaccttgaattttaagttcagtagagcaggcaatgtatttatttagagggcagggccattaaggcagactgtttttttttttttcttgtttgaattggaaaaaatggtaatatatcctttacgtcacagtagcaccctagtggttatcatattgcattagttacatgagtttttggggaacattatacagtatatactgcctccagtaaatacaccagtcatgcatacagttacatagccagcgccaggaaatttaggatgacattccctgcaggttagtaattctacccattatttatattggtttgatttgaaactagaggaagctaagtatttttgaagacttttctgacagaattctagaaaaaccagagaatgaatatttaaaataggttaattatctttcaaattttttttgagaacacttaaatttagtcataatgtcaaatcattgagaaaggcaggaaaagagtaaagtacaggcatgtttcatctataacttgaagccattcataaataaaaatctatcttgggtgtatacttaacaaaatgatctttaaaaatggattaaaaaattagtaatgagcctgtgacagagttgctaaagcagatgtggaaattgtggaacatcgtcttggcagttgaagtggcctttccagctggatgtcttcagaaagtgagaatttatgtttaagccacaatacagaagtcagtagtatgtgaagatggttgtcataacagtgcaagattttgatgcaaacacttgatgattgtaaggaacttgaccaataaagtctgtgctgtcataatgaatgaagaccaggttatttgaaacttctaaaatagcatcttacttataatgatgtcaaagtatttcatgcctttaacttatttactttggaaggaaacagaaatataaacaggctgatcaccgagactacccctgagccacacgttttcttttatccaataatctacgtttacctatgttcctcgctatgagagggtccctgtgtctagtgcctaggaaggctaacacaagcacagagaaaaaaatgaagtctccaggttttgttttgtattgttttttaaccagtttagagatggcatatgactaggaaggactgcataggctcctgatttataaaatggatactactcagctcacaaaattggtatattagtgaaatatggtactgtaccggctcggtgtcatggatacttggtggatatcaactctcttttctcttcctcctataagcagtatacttctgtcaattacaaaagtctatgcaagcaatgtgaagagatagtaactgagtaactttgggcaaattatctaaacctgaaggaattggattattgggaatgtcaaacaggtttcagtgtttgtgcatcctttcctttggtagatctctgatcctttagaatattttggaagtggtggccatgctccatggtcggctagcagcagttcaagctatgcattaagcagaagaagagccttcatggatcctgtttttgctgttgctagaaccagataaactccaacaccacttctatatctatcatcctgcccttctgtttgtaccattgattagttctctgtccacttctaactttgattattgccctaaaattctaagatttttggaatgttttccagattttttctcatttcttcatgaaaattgaaagaaatatctttttcctttttataccttattttaggggttatctgagagtaatattatctcatttgtcatgaacagaacttgttgaaaacaatgtcaaatatttaacatgaaagtttaggaaattataattcaacgtgcattcctgttacaagaaacataaaatgtacagaaactgtggtttttccccctgagaaaatggtttgttaagatagtaaaaatcactagaatgtaagcttcaagatgacatgaacttttgtcataaagagtgcctgtaacaaagtaggtgctcactagcatttgttgaatgaatgaatgagtgtctgctgccttaggtagaagagattcttggaccatttcttggcttgagaatctcagagaacagggctagagcaaaagctgaaagtcagttctcaggtttagggaccaactctgttgatatccattcatgggatttcactcatgaaaggaatgtggatgtgctacttggatgtgctagactgactccctacgacatagatttcaacctttattttgcttcccaatgacatcttctggttgattatagatgttaatgccaagattttcacatcccgtccaaacaatatgctaagtcttataacagaatgtaccctggtgcccatgggaactcagaagagagaatttcaagtcattttttaaaagggcatcacatgattgttaggagaaataactaatacaagtggttttgacaagaaattcttaaatatttcataggaataacagtgtcattattctttggatcatcatgatatgagtcatcaattatgctattggattcaattcaatttaatctaataagaatgaaatgagcacccacttcaagcctagatgtgttaaatgtagttggggtacaaagaagtataaatatgattagggtagatcatttcattactcttttgttagggttccttttctaaatgcatttatgttgactttatatgatggcatgaaattgtgttaagccattataaaaattatcattgttttccttttctttctggggaaaaaagtgttctgcaaatatatacattcaaaaaatcatatgaagtatatatagatgtatctcataagtatgtatttattctgatacatgtgtcttattcagaagcatgtatcttatacttttcattctgaagcttgcatcttattttcagaataaatatataatacataaatacatgtgctccttactgataaatatataactctaaggtcatggtaattaatatgttttctattgctgtgtattcaaaacaacttttaggaaaagaagtcgaatagctcaagaaaaaaaaaaaaagaactaaacagcagtggcttgttttacaaatgggtttgctgagaattcctttagttacacgctagagatatttcttgatccctttgttggtcagcattagtgaagttcattacattagatttaaattatgtcagtcactgtctaggtgcagacagattcagaaaggcatattgtaaaaatatagtgagcattgttgctatttccaaccaaattcaatcttttggtgttggattaacctattgtattcatgttcacatttatttatgcttggcagaattcaacttcctgttttccagaggaagctaagaactcctaattttaaaaaatagctaaaaatccagagctttaagactcacaaggcttttgaatgtcaaatggatcttatagaaaaatatttgatgagttaagtattaaagaataagaaacatatgggttaaattttactgaaatgcacatgggcttaagaattaaggaagaaaggacttggcaaaatatggttttggttttgccaaatccaaagtttgagaatagagtaagatattgaacaaacccaaaccatatctggctttagccatctgctagcctgttgtctacaaaagccttttgatggggctttgcctttctaaaaccactgatgacacctgaattcgacatgtggtgtcctttagtgcctctgtgggctggctagcctgaccgcataaacttgtagttccatattctaacaggtttggtgtgtcagatttcccagtaaaagtgtagacttttactaatgaaacaattagcctaagacttgattgcatttttaattcaatagatgtcacatttaaatatatagatacaatatttatataagtataaattatttttataaatatttgttatatataaaataaaatatttgaatgctactatagttaactattttactatattatcatagaactttattaatatgaatatgtacttggtcatatcccataaatctccgttttctaacctaccagaacacactttctgttcttctttttggatgctgaggatttttatcttttattatgcttatctaaatgcatatcttctcccccatctcaaatttaaagctcattttgtgaagaatttttgtttgatttatactcttatttgtcaaagatatctaggctagtatatataaataaataactttacattaaagttgctgcatgtattgatattttacaaaacattttaatagacagagttttaaaatgaactcttatatcatcttgcccagagccatctctcctaaattttttgtacatttatgatagtgtaattttacatttgattcgattgaaatgaccttctatccacctctgatcaaaaacagtttatataaatttccaacaccataacctcaataaaataaatgtacatctaaaaactatacaatgggtatagaatacatgtttgtattatctgtatattacattgtaatatatggtttggattatcttttttccacctatttctttaaaagcaatgcagcaatagattcctattctgagtagtcagaactgccctgaaacacattcacacttccacagtcgacggggcttttaataaatgaacaccacttcactttgcaagcagtagtgtgatgtgcctacattttaattatacacatattccaaagttccaagtctctctgtagtgcggtccacatttcatgctggagacacttggccaagactgaattcatatgtcctacagggttacatatgatgtggctcctctcccactgggttacacaggatatgagctgggtcctggcggcttctgaatcaagaataagagaagctcttgtggtgtgaatttaaagagagaaaaagcctgtctctggcattcaagtcgctggaagtttggcatgtctagctgggagtagacttcggctcacagaactgagagataactaaacaaagatttgttcaatttgataaaccccctagcaaagaccaccttgccaactttctttctaaagaaacttttcacagctgaactataaaaccttgaaaatcaaggatttgtaatggaaatgctgacagatccaactaactcaaacttgtaccaaccaagcattgctatcatattttataactgtttgagaagtttatagaaaggaatgatacatttgcttcatgggatccatttcctttgctaaaaactaccaaatgtccccagagtagactccttcactcttagaactttcttgatactcttttcttaagaatagaaatgttaaaattgctaacttctcctgaggcttgaaagcaactgttgcctcatcctgtattcttgttttacacttgatgaagaaaattcagacactgccatcggtgcttcagtgtttattagttatgcattcttgaaaacctgttcaacattttagcaaatttaccaaaattatcgtagagatgaatcttctttgtgagttttgaacaagtggaaacatttactctattctcaaaatgctggccagaaagtgaaagaaaacttaaatgcaaaaagttaccatcatcttaagggtggtgtaatctttgtacagatatgtaaatacaaatttccatttatacctttttttgaattcatactgcttttttgttaatccttaaatttcagttagttggccatagttcatgcatactcaaattgaatttcatcaaaaatcatggttaacaaccacaggaataattaggaaataattactcacagacataataaactacagtgttacttattcccctacaataacggagagttgacatttgaatttctgagaaggtttaaatatattttacatgctagaaaaatctgatgggtataattttctctaatattaacgagtgagacatgattgctcgagaaacaagagaaaagctggttggtcaaacatatgccttttgtttctacattttgcataaaggtcttcacttggtatgcgggttcctcagcagaaaggagaagttacagttaacaaattaatgaaaaccaagtgatgcctttgaagaattcttaagtgaaccttaaccagtgccttgggctacatgttcaatgcgaacaaaaaaattaaggtgaactggccactgctactaagagtcaattgacagaatgcatgggtcattaattttgtgtcctttgttttgtcagtgtgttttcgtgaggcctggtaaagaaagtaaaaccactgatgctgaaaattgtctgctctgtagctcatttcccctcccagcatgcactgacccaagggagtgggcttcaggtcgccagcccccatttccctttcaaacactcccgcctcctgcaagtttgagaacggatccattgggttggtggagtggttaattctttgcaagtttgtgcttaatcatatgcagaatgtaagtaccaataaaaatgagatgtctgctcacaacgtttccttgtatttaaaaaagattctgaaacagcttctgcaacctcggttcctttcaattatagcagaggagagtgtgaaatttaaattggttggttcatcttaattctctgttgtttcattactagtaacccctgagggccaccttttggatttttgtaccatgaatgagtgatgtaactataaaatgcccataatactggggtggcatgctagaactctatttggctttaaactgtgttctaagccattgtgcccaaaatgttattgctcatcaacaattccataattccatatcaaggcaatctagactgtatcacatttgattaccacgaaattttatttaaaaacagattttttaaggatcaatgttttaaaaagctggctaccctatcaggctaacttctcgactctcagcaagacttttgcagtcttcaaagtggaaaggatgcaactggcctgaattagagtaacaatacctctgccttggaccgggagccaaggaagatttgcagatcttaggcaaacactatttgtaggtttagttgatagcagtccagaaatcatagaattgtgtgttgttctgtctttttctttgaatatttatcagcagcactaggttgtggcactagatgtcaagtctagggatgatttggatgcaatcagaaatggttcagttatggtagcttcccttccatttattccttcatttgacttggtagccatttaggtgtttattggttcattcattcattcgcccactcgttcaacaatcacgcaaagcacatgataggtgctaggttagacaaagataaattagataattcctagcctaagaaatcggttttgtgggccatcagacatgtaaataaatacaatatactgtagagtatgctggaaggtagggcatttgggtgagattgagagcctggaaccctgcctataaatgggatggagagatgaacgtacttgtaatagtttactagggctgtcccaacagagtaccacagactgagtgacttaagcaacagaaatacatttccttacaattccggggcccagaagtctaagatcaaggcattggcaggcttggtttcttctgaggcctctctccttggcttgcagatctctacctacttactatgccctacttacatgatctttcctctgagcatgcatgtctctggtgtctctttgtgtttccaacatttctcttcttagaagtacgctaatcagattagattatggcccacgataacagctcattttaactaatacttgtaggtcctatctccaaatatggtcatattctcaggcattgggtgttagggctttaatatatgaggacataatcttgggtaccataacagtacccaaagaatagtactcaaagaagagatgaatagagagatgtcaaattgacagacaacaaaagggtattcctagaacagtgcctagaaatgcatccctgaacatgttataccatgtatagagacttagactaagaatttgtgcaatacaaactaagaggtagatttagcagttttccattttatttgatgattaagcatctactatctgcaaatcactgagttgagctttgctttaggaggacacaaggaagtagcgaaaacaaatcatttaggggccaccaatctgctgaatttctatatcttcatcacaggttttcaattctagctacacattataattatcctcatagattcagattaattggtttggagtgattttcccaagtaattgtaatgcaattctaataatattgtcaagtttagaattacttgaaacttctaaatacatacataataaaaatagttaacatattgtttttaccctgtgccaggtgctatcctaaatacttaaacacatgattttatttaatcttcacaacctatctatgacataagtattatgataattctcattttagagatgaagaaatggagcagctatgtaggttcactgggcaaaagtcagctagttggtatcatattgacccaaatttcaggtttaactgaattctatcacatttttaacaaagtaatttagagaaatttttgtgcagacagtcttaatgtccaaagattctgtttaaatatatgtcaataaaattgtattttttagaaaatttctcagtgccaaaagtatgacagcatatccatcacattttagggattgtgggataagcatgtagtgagtgtttaataaatagttattgtctaaattgctataaattttagaaattgtttcaagaaacttgaaatgcaattacatcattgcattaaaaggctttattaatccttgaataaaagtattagaggcctggtacagtggctcacgcctgtaatcccagcactttgggaggccgaggcgggtagatcacctgaggtcgggagttcaagaccagcctgacccacatggagaaaccctgtctctactaaaaatacaaaattagccagggtggtggcgcatgccagtaatcccagctgctcaggaggctgaagcaggagaatcacttgaacgcgggaggtggaggttgtggtgagctgatatcgtgccattacactccagcctgggcaacaagagtgaaactccatctcaaaaaaaaagaaaaaaaaaagtattaggtggatggttagcttttttgtttttcctttacaaggatctctttttattctatatttttcataggtttattcatgtttttaaataatactgaatgatagtaattattatatacagtgagtagtttttccatgatagggttatacaaaaagtttcagaggttttttgcaacacagaaggtttaataataaagatacggttgtaattgttatttaccaatatgttgtgatggtataatattatatattttactaatatgtaaaaatggtctataccttaaaaaaatctctttaaataataggctattgccagagaattgggtgtatgtttcataatattattcataggccctggagctggcacacaaataaagacccaatccattgtctttcatagaatgatattgcttaaagcaaagaacagcagacataaggaacaaatacatgagaggagaggtaaatacataaaaactgtatgtgggccaggcgcagtggctcacacctgtaatccagcactttgggaggccaaggcgggcggatcatgaggtcaggagttccagaccagcctggacaacagagtaaaaccctgtctctactaaaaatacaaaaattagctgggcatggtggcacgcgcctgtagtgccagctactcggaggcaggagaatagcttgaacctgggaggcagaggttgcagtgagctgagatcgtgccaccgcactccagcctgggtgacatagtgagactccgtctcaaaaaaaaaaaaaaaaaaagtgtatgtgtactgtttcagttgatagatgagataatctaattaacttttatcaagatatgataagatttaacttatttcaaagcctgatagtcttgtgtactgcatcttagcaaagtgatctcatgatagttgtggtttgggatgtacctagtgacacatcaggcaggtgtcatctgctagataagggcttgggaaggatgtgcaaatatagtcttcctgctagagattgccagccaccttactgacccaatgttgtatttatgcagcttacagtgtgttttttaagagaataaaataacttgttcaattgccttcataatctatcaaacactgttttgtttatctgataatgcttttagtattatcataatattattatagtagttctaatttttgttttctaattaggctcaaatattcccctatgatatggattacctttggaaaacatcatattttaattgcatggttgcttaatatctgtaaatcagaatcagggtcaatatctaagaatgtcccattaactctaaagagaaatgctcacttttatttggaaaaaaaaggcttggcagacaagctgggaactaccagatggaggaggctgtgccacatagattataagtttttccctctcttcttattgatgtcttaagttgaacatgttccatctgtccactctcagtaatgaatagcgacttttttattgtaaaggtaacacattccatatagggtaaattaattcaagcatataatgaaatgtgcaagactcaatgctctgtactgcgtagaatttgaggattatgtagggaagtgtggaaatccaatactatttctataacagagcatatttttacttggagagggcattagaaacattctctcctaagacctctcagttttgttctccactagggtctaaaagtctgagtgataggttgtagaaattgtttgaatctgatgaattttttaaaaaaattattagttctataaaaatgattatttaaaactaattaattttctaccacccacagtaaagtactttgctagcacactagtaaacaattgaaaagcactaagccacctttttaatgtgttgactatgtctaaatccagcttgtcaaatataatatgaagataatgtttttaaatttctttattcaaagctttggcttttttaaagctaatgtctctggtttgaatttttcttctatcttgtggcaaggatggtggcttttcaacatttaaccctagcgtggctgttctgttgtttttcgcatatttcattattgatacttctattaataatattatatttcccctttataatgataacaacaaatactatttatgttttgcatatttcaaattgtttgggtagggctaaatcttcattctgtctctccataaatgggcacccagaacacttccaaaggaaaaccaataaaggagtcatatgattcttttattgttaaaacaggattaaaatttaagcagctgcttggcctggttactatatctatttttaaagccttcgtttttttgctgttgtttgtttttgtttttttgtgtgtgatggagtgaggttgttgtatgtatcaactgtttgtgtcaataagctttgaaatgctaactccttaaatagtttaagacacttggctttaatttttggtgtggcaatcttctctttctgtgactagattttacttgttgatctctctgaaatctggagttggaagttactatttctttgcttacagataattgaagccgaccaaacttgttaaagtcaaaaccaacaacaccatgctttagtacacgcctctgggtttagtcacagactctggtaggttctgcaaatggcacaatttatgcggtggcatgtcagaaacttaatgctgtaattttcctcttcctaatggagaattaagaatctaaagggtctgggctgttcacatggaccgaatccccacagcttgggtgcagaggtctctcaaaaatttagtaagtgagaaggagaacaaagattcttagttggaggggaaaaaaattagatcgcctgtggctgagaagctgagggggacaggtaggcacagtggggtgcaggataatgaggcacatggcaaatgtgatgcacagatgttaagccaactgtagctccggctcccaaacttgtgcatgccacagcaccatgcctcggggctatgtctacaccagaacatttgcagcagtaaacgacggcaacattaggttcaaattaatctattactccagagctgtgaaatgttggttgcttgtttcagaattacattgcctgtgggtgaaatgttttaggtagattttaatgcaagctcatggctttctgaggagattaagaggagaaagggaaattagaacagttaggagagttgtggaggggcacatttctggttaaagtatatgaaaaagtattacatatttcacgggcaggtctggtctcctgttggccacctgctgggactgaaatatcccacatcataatgaaggcaggtttgcagaagccttgtaaatacttgagccctgcaattgaagaaggcagacaaagggggctttggggtctcctggagacttttgagggttaggcctgtcaggcgagtgctccaaatgaatttggtaatttattattctgcacttgtttagtggaacatgtaaaattttgcatttaggtttttaccctcatgagtttaagtaaactccggagtaacaggtagccatgtgacgtttcagagtatgtttcgaagtaatcctgttctccctctgcccattctttcactgatattggcaggttcattttcacaaacctgtctgggactcaaacgctctattttttccaaagtggaaaaaccaaactttgaattaacctggatttttttggtcaattaaatagtttattcaatcagacgggggaaaaaacctgtttggaagtatctataaagaattttttttaacaatattgtcgtttttcttataaaaacacttaattgaaatgcctaagagctgcccagcacaaaagtcaataaaaaccctagaatagagtttataggggttgtctatgtacataattaaatccttcaggcactttaaaactctgcaaaataaatggttatgcaagaatagcctgctgagagaagaaatgcttgtatcagctttaaccagctgccctgtgttccatgtttctgggttggaatgagaaagctattagaacactggaagactgcaagccacatacaaatcatctttgttactgacacttgggggagtactttatagtggctgtcaagaccaatacaaaacatggtttgtgcctgaaaaagtcaagtgccattattcaaaaagaagatgttagtaatccaaataactgaacaacatccaggatcttcattgagtttagctgctatagacgcagatttattattgagtctgacttaagtaaattagcatgtaggtttgcattctagatttgatggaataacaaaggttaattacttgcaatgatctatgctggaataggagtaaaaggggagagctatatttagatttaatttcaccattcttaagggaatactatgtgaggggacgggattattatagggggcaaaggaaggagtgctaaggaaaagaaaaaaaaaaaaaagcaagcagtctaatgaatgtaaccaatagaaaaattgtaggtttgtttctctccctggccctcaaagttatgataaatgatagcacaaggaaaagataacctaccatgagagtaggatcaccaaggccaaatactaaaactcccagctgactggcccatacactgcagcctctgttcgtgtttattttttctgctcactcttggtttcgtcaatcagtatgatagacgataagtcctgactagagcagcccgcgtcctgctctctcacggtgggtagcatgttgtggttggcgccgagcagtcggaggatcgcccgcatcaggagcaccaaggggatgaggttcggagcagtcttccagcagccggctccttggagaatagcaggcaggagcgttatcagcggagagtggagttgccaagaaactgaccacacattagtagctttgtttgggtagagtctaagggggctgtagctcatagacttgagacactttctgttaaatcatccctggatttaagtgttaaaagaaagcttgttcaaaaagaaaccaggactgattgccgcaggcagtcctgtgacaggactctcaggattgagagtcaggaatttgtggagttgctgtgctgagatgcaaatggacatcaatttaaaaagaagaaaaagaagaaggctcctctcgtggtctaccatttacttctaaattaactatctcctaatgtgtaaaacggcattaaaagtgcctttaaaagaaatctataaacacaatggggagctttagttagctggtgacatatgaaacactgctcagttagccgacagatcatcagatagatggaatttcctgaatgctattcacagatcactaatgttgtttatctactctcagcactaatactttttacatttcattctaggagaagatttttactttatttcatgtatcaaaacttctagaaaaattttaatatcaccaattttttggaaaccttattttgtagaagcttaaagactataaagaaaattaaaaatgtcctgacttgattcgctgaagtagccaaagtgaaattcttttgatatcttgtgatgcaacattggtcaaacatttcctgttcaacatttctttcctgggtattagtggttcctttctcaagaacaaatgctttggaaatctggtgctctgtataattacaagaaatttcaaataagtgatcagtacactttccccaaaagtaatgcttcttgatagagtaaggtaaacttgacagttctttttgtgtagataatttttctccattttagaaattacactaatgtgtgaaggaatgtttccccctagcttaaggtacattccataaacaaaatgaatagtttcggattctctttatacctggtgttattgtaactgctgatgtatgttaaggtgaaatttaacactggaatattagttttatttcagttaattatgtttctaagagctcatgaaccctaagatttagggttggtctgtttctagttatcctgccaagttttttacttgatggagggggtctgtttcattctgcttggcctctccacctttgtaacccctggtttcctcttttcctgaatcacaaatttacgttctccccttctgtgagaagattgaacgcttattcaactccaaaatgactatggtcacaaaatatcaacagtgatttttaatagatctttgcctatcaaaatattgttgcttaataatagggtaaaggtagttgtggctgctgataggaaggaatctgactattaataaaaagcagacaagggtcttgaaacagtacttccactgttgcaatgtagacactttatattactttatttagtgcaacacctgcagctactcacattgctggtggctgaaataatccaggtccacacggagagggcattacaatttcattgtgctgtttgtgcttactgtttaagcctttctcacaggagaaagcattagctaagtgtacagtagataataaaaagggggatttgggctcatctgttccccttaaatctgtctaataaaatctctcctcataattagtatctgactccttttctaccactggctggcatctagaggcaggtagaggcacaaaatggcatttgttttttagttgtcccatttcatgactttatggatcatcccctctttgagccttcatgacctaagttctgagacttaggaaactgtatacttcctaagattctcttctgcagaagttataatagatttcagatggaagatgtttgggatctcaacaggacaaagaggacacatcattttaaggcaataataacaagccattcttcatccttaattgacaacttaatttagattttagacgagtcccttttagtgatgtcctattttaatttcaaccccaaatgctgataatcatgaattcaaaaacacagtctataaaaagttccatcaaatgaattttggtttaggcatgaagatttagggtgggggttggggaatgaggctgaaacccagctagaggtcatttcttcctcatctatgctggaacagctcagagttcaggggattcatactcttttgactttaattgctctggggccactgaggcaaagcaatggtgctgtatttgtctgggggtcaaagaagcaatcacaaaggtcttcagaatattttcaaacatttgggggagatagatggtattcagacattctataatcataaaaccagtttctagatagttgtcgaatttcctaaactacacttgctgaagtttatttggttattgaaacatttagcttaaccagtcatgttctttctactttatgaaaatgtagacaggaaattatcagcaaattgctcgtttagaattaaagacaggaaatgaacttcagcagttgaattcttgtagtaaaaagcttctacaactaaagcataagtaaagccagcaaaccttttatttttaagtctgggctttgttatatcaacacaatggaattaggtactctgtcctatttcgcctcaaagtttccatattgctttttacagcatctacaactgtttctgttactaatttccttgtaatttttaaaatgtaactgaggtttctattctttacttatttagaaaaaaatacaatttcttggattacattaatagattaatgtaggatatgacacagcaatggtaagcttgctagtttatttattaggacaccccccaaaataaatatctttttaagttctcatattattttcatctggaagtctagaactttttatttgaatctcaattataatatattttaacttatatttctaaatagttaataggtttcccttgatgtgaacttttcaagccatttctttttgatagctattacttagattttattcttaatatattatattgttagtatgtccaatatatcagtggtatctacaaaataattcctgtatttaattttcttttatatttttgttgccatttttatttctccatatatttcaaatactctaatattctttaaagttctccttattggtattgcattatttaaataaaccacaagcataattctcctccaacaaaatgatttgtaccatatctgactattttgattacctttaagaaaaaaggattaaacaagaaagaacctcaagctttagccaaactgaacaatttactcaactttgcttgaggacgtcagaaaattagggttttgtgattaatttaaaatttacttttatagcagttcacatgtaacatatctttaagtattttggaacccataaaaagcaagaattattctgcatttcaaaaaatatatagtgttaatctattattatcgattctcattatgatgaagatgtgatacattcaggtaagatttaaataagtatgagacattctaggtttattggtattagcattttataggattaatcataatacatattttgtgtaagttagtttataatcttttgttaactgactaaatagtggatgtatatattcatagtggtttttctaccaccattttgaaagtgaaaactcacttttaatttaatattcaaactgaaatttccttagttgaattctataagagatcttaagagaaagtggactttctaatcagatttgtttatctgaatcagctttatgccttatgcaaacttttataagagagtccaggggatattttagctaaacctttggaagatattgcctccaaattgttttatttagtaataattttattcaatggtttgttcgtggggtttttttggtttggttttatggttcctgtttgagtcttccttacattaatctgaagggcttgtaaattttagcttgcctatgcctaagagtaaaattgctgtggtcatttcaggtagcaaaacatcaaacttgatgctctctcatgtttcagtaactcttcgcatgttcctgtgaatttaaaccagtttcctagtatatgagttcatacatctactgaaagaaacatgactatattcaaattagcatgaggtttgacttaaatcatgctacagctggcatttgtgggctaattatcaacatttgttaatctgagagtttttgaggatgtctttgattttgtcagaaaaaataatttcttttttcttttttcttttttttttttttttgagatggagtctagctccatcacccaggctggagtgcagtggcatgatctcagctcactccaacctttgccccctgggttcaagcgattctcctgcctcagcctccagactagctggaattacaggcacctaccaccacacccagctaatttttgtagttttagtagagatggagtttcaccatgctggccaggctggtcttgaactccttacctcgtgatccacctgcctggacttcccaaattgctgggattacaggtgtgagccaacctgcctgcaccaaaaataatttcttaatagtaaagagtaagaaaatttgtgaagttaagtaccaatatagaaaaatccaggataaattttaaatggttaaatagtatgggacttctaaaaaatgggtgaactatataactttaaagttagctagtatatttactttagatttttgctctggtgttcaggtatgcagtgatttttgggaagcatagtcattcttttattcagtcaacaaatatgttcatttaacaacagtaagtgccacatttttttttttttttttttttttttgtgatggagacattgcagttagcacagcagaaatatgtgtcgccctcatgaagcatgcattctagtagggagggacagcacatcaataaaggaagattatttcatacggggacaagttctataaaaataataaaactgtagtggagaatgagtgactaagggtggtcagttagctcttaaaataacaattttatattgaatactatagtgagttacacaatctttatctgagtgaaatcctttggtacttattcagacaagagttctgactctcatgcttgaggataagattatacatttcagtattacattgaagatatttcatttttaaccagactaacttagtatattgttatttttaatgtgaccaaagaaatattttcatagaagctaatgctgagtcttttgataatttgccgtatcttagtcaatcccaaaaaatttattttctactatttacatattatcctagtggatattacattacttactgaagcctttggttctatgtttcatctactcagacttaattcaggaagagcttcatccagatgttttgtttatttgtttctcgattacatgtatgagatttcagaatttatgagatcataggtcaagtgaaagttcacagttgagaggtcaagtaagaagctaaaatttgtgaaaccaaagaaatgacaggacagtgccaaatgaaaggtcaaaagtcaagtgacagactcagtacagatgaaagcaagtggtgagtttgttgaatgtctgagcacgttgaagtgtctcaatagtcatgcacacaaagtcaaaggttcttaaccttggaattcacaattaataataacgtgccacttgttattgtataaatatatgttacttattcacagagaaaagcatctattacatacagtcaaagagtcttttcattcattgattatcattaatcagggtgacccttttttgatgacggctcttcgaggtgtatacaaaacatccaaatttgggaaatcctaactaggcttttctttttgtcagatgcatgaaatatacacaatatacacatggcagatcatgtgaggtgttaaaaacttacttaaaaattagagaatagattttttctcttacagacttcacattgataccctatctggttttatttctccccttattcatttatgtattcatttactcatgtttagcaaatattaattaaaaaccacgtcatttttagttacttctattgcaacactcgaagagaaagtttacttatgagaaagagttgctttttgaaatatcatggtgggggcatcctttccaagttttatgtgctggatagtacagatgcttctccacttaagatgggtttatgttccaataagccctttataagttgaaagcataaataaaaaatgcatttactgcaccaaacctactgaatatcctagcttagcctaacctaccttaaatgtgctcaggacacttacatttgcctgcagttggaccaaatcatctggcaacacagtacactatagaccatcagtgcccttgtgatcatgtggctgactggaggctgtggctggctggtgctgccctgtaccacatatagctagcccagcaaaagatcagaattcaaaaaaatccagtttctactgaatgcgtgtctttctggaccattataaagtaaaaaaaaaggttgtaagttgaatcatataagtcaaggagcgtctgtccctttttttttttttttaagcaaaatggtttgattccaggacctatgatttgggagatagtaattatttgtcatttggggaactaagagaatgaaaacataagcgatccttgttttacataaatatgatattattgctattatgttatcttttttgtgtgtgcgaagaaaattactttttcctctgccctagtaacagagaaacagggaagtctgtagttctaatttagatatgttttcatttatccatagagtctatcactttaattttaaagaataagaaatatcatttatttggttatttttcattcctcaaaaattttacttttttattatttattcctccttttttatttttcaggaatagtaaacacgttttcatatgtgagaggtgtgtgtgtgtatgcatgtgcatttgtcattaacaataaatggttctttgggacttagggacattttgtcagtgatttgctttatggatcatacaaagtgaccattcttcaaaagccaagcatttaaaggaagtctctttccatattctagaaataaacagcaacatttcatgacaaactaaaaaaaaatgaatgataggttagggatctccagctctaaaaagaggaattcaacaaaagagaatttgcttttatgtagagtcctgtgctttttttctcatagagcacattagaatggtttatttacaagtaaaaatcacattgatgataatagaagtcagtggcaagtcaataagagtttagtctctaccaaactataaaattggacttttaaatcatagcgtaagcactgtcgttgtccaaaagaagtgtttatttttcctaagttttgcctttcatatcacgcccataaattttttcaaatatatactttgaaaagctaagggcaagccctgaagggtgaaatattgcaaaccaattaaaaacaactgaagtgagattctaaaatacaggagttttccaactcatgaacaatatttagagagctggttaattttaattcctctgggaaccataagtctgggcattaataggcttagagtgataaaaacagcaatatactatgcacatatagatggtattgtcaaaaaaagaagcaattagtggcaaagaaagcataagtatgtacacatatggtgagcaggttgacatgtaaaatatatggccaggaataacagccaatgacaaaagagaagtggaagctgggctactgttttaacttacacaatagcaaataaatgatttgcacacaaacacatcactctagccatctcaaattattgaaggctctttagtaagtttaccagattttttttaaatcagctaaaaatctataatacatggctattcctttcctttttcttttttcccttctttcttttttcttttatttcccttttcttccctttttttaaattgcttttatatgtctcccttatctctagtcttctttctctttccatcatttgctcaatgacataattgactaaatggatggttcaattcaatctgcttaacttaaaagtactgaagaatcttgatagaacctaaaatactgatttttttcaatcaaagaaagcaccagagaaaggggccaactgacccttgctatcgttctcagtggtcatcgcttgaatggcacagagtacctctgtgggggtgggcagaaactcaccttttcagccttttcaggtctgtttctattctttccatggtaggaattgtgtgtccactccaaaaaatctgtctcatatttctctttgaataaaattataccataaacatttctataagaagttgacctgaagggacacatttacatttcactttttaaaagttatacagctgtcactataaaatgtaacaggcatattgtaaccgtatctactatgttatagactttgtgtcactttcaagtaaaataagtggttatggaaaggtaattcatttaaaaaactgataagcagcaacatatattttactcctccatagtcaggaaattgggagacatgcacaggttcatttccagcatgaaaatcatgttactgtgacgaatttaggtgcagcatgctctttacaatggaaagtactgtagtatggaataaacagtaataattttagtagtattctccatcttaaccctgtttattttggctatggttcttttttgggatgtcatctttcccaaaacccaattgctaaaagctggtttcactggcagagaaataaaaaagacagtcgagtgagctttagagagtgctgcaattagttgtgtgtgtatggaactgcttatctgcgcacaactgggtctaaggaaactctgcttagtatttattaggagttgaatttatatgagaaaaaaacagatgctcaattttgctacctttccttttaaagtttaatgtgctgtaaaatacaaggatctgtacaattaaaaagaaggtgctttaccctttaacatgtgccaaacgtctttcacccccattttactgcatatacctcctgtttctacaaagcacccaagaagtagttcatccccagataacatttctgataccgcatgacccagattgccacaatttgggtgaaatagcctgaagaattatcaaataagatagctaggatgatgttctgtattctctggtgttggtacagcaccatgtttgggacccaggtattctaaagagaatccttcaaaggcagttccaggctgccccacaataattgaaacataggaaaaccagtatcagacgtcactatctttcttttggatttgaaaacaggaaatgacttggcatttctaatcctgactgggagacaggccctgactccacaattatagagcataattactccaagctcggtctacgaagaacccccaactgcttgttgaggacctgccaggaaactgacctgggtgaatggtctggaagagaacatgaggtgacaagaggctgagatgccattttcaagtaaatatacatgaaaaggctgcttataaaggtagaggttgttaaaatcagcttggcactagagtttaagctgagaaaaactggcaacatacagtgtttggggcctgaatcaaatattcactgaagctttgaatggtgtggttaaaaagaatattttcaagaattttactttaaaaaattctcattttcaaactgcaccacaagcatagtttacatgctgcctcttaaaaatatgtgtatactatatatatatatatattttacaaatggttactggattcctatgtaaaatggggccatagtgtcttatactccctctgcaactcatttcttcctgtaaacatgtaactctttgttggtgtttctgatgttactctctccaaattcacagctcgctgtgattcctatgccagttgcaatacataagttctttgatgtgtctcccttccctgcctttttttttcttttttaagattaacctttcagctattaaattgattcctaacaaaagctttttttgtggtttgcttatatcatgcttggaagaacagcaaataataggtaacagtggtggagctggaaatttttaaaagacatgattcttgggtccaagtcgtttttcacttttgttgtagaatggcctcaaaatggtaatttttggtatgatcttttagaaagcccaccagagtttagaatatctcaaaaaggtgaatttaagagaaacgtgagaaattcacagaaccataggactaaatgccttctcacgtgatcagaaaggagaaaaggctttggaagttccttagagtttctagctgtgctggccagttattctggcctaatgcattggggtggggcaatgggtaccattcatgatggtgttgggctgcttagaacttgtacaagaatggcttaaagtgacatcatccagtctcaaatgtttgatgctgaaaagactcaggactaacagcttagaaggtaaaagcccctactgctaaactttgggacactgtcttaactggaccaagtatataggatctgtagatacatttgcatattacttcattaaacaatgaattagaaaatcttgagaacttgctttaagaaataatattcactttttttttttttctggtcatgggaccatgtatgatttgtcttccacctcctgatattcccctcactcacttcatgacttcatcatactggtttctattctgttcctcaaagatttctcttcctggggtgcttctccctagctttttgtgtggaagactcattctcatcttttgggtcttggctcaaatatcatttcctcagtagggacttctctgactacagctgttttctctgactacagctgactatagctgtctgaagtttcctacttctttttctcctaatttcatcatcctattttttaaaaatgtccttcatctcactcaccataggttgtaagtaacttgttagtttatttacatttacttgttatgatgtgcctctcccttcttgtcctgccagaatataagttcctgaaagtcaagaaacttgtgagtcttgtagacttccttatccccagtatttagcctggtgtctggtgcaagtaggtgttgaataaatgttttatgggtgaatgaatgcatgaatgaaaaagtgaataaatgaaagaatgaacaacatgtttactttatgcatgcactacatttgagaagcttccaattttattcaatagacacaacaaaaggaaaaacagaaaaagactacaattgtaagaaattggagagatcaagactatagatgcaataacatccagaattgtcaaagattttatttccaccaagaatattttgggaatcttttgtagagggcatgcttcttatgatgaatgaaggatgagagaagagagagtatttaaacaaacgtctatgaatggcaagttaataaaagtgaaagttaaaaagacaatatattttctatttgtgttgttattttgataataacaaagttatgataaagtgggggaaccattgaagatcttatgtgaggggaatgggggcaagataaacaattctgtatgttgcggcaactattcttctccattgtgaaagtgaaccaatgattgaccttcaaaatgaccatctaggaaatttaaaaattgaagtaggcttgggtaaaagtcagaccatgggccatgaaaggtagaagcctcttttctgctcttcagcagaaatcttgaggctaaacctattattcctactgctgtgggttctttcagagcagaattaaaccatttcagaaaatagttatatgtgtgagttggagttcagaggagaaaacttactttagagcttgatatttaaaagatacttgttatgcatctttttaataaatcaataacaaaatcgagaattaagtcataatgaactggtatcttggagatacattcaaacttccattaggaagactggcctatttataaaatctgcccacttttaacctggtatctcaaagaaaagctaaggtcagctgtataagttgaaatcactgcattattataacatcaaggaggcaagatgcttcatatcccatgtatctcaagaaagaaaaaagctggctaagttgataaagggaacttgcaatccagaaccttttttttttctttttggcactaaaagaggaaatttagagaaaagccaagatggtagacagaggtctcaaagttctggcctggagggaaatgaggtgaacataggagttagtggcttatgagaagaggtagctgcctcaagacacctgagaaattttttgtaaacatagaagtaaatccaaagagagtatttgtatattcaagtattatccctaaatagccccctgaagtattcttccttgacattggagtaaagaaagataactcaaaaatgcaattaagtctgctgtttggcatttttaatcttcctttatttggaattttctttgtttagttttattttggtttaatcaacttgatgttgcaagtattttttacccacattatattatgacatgaaaaaacattgtagctgaaagaatagagaaataacccatgaaactgattaggaaatcatagtctcttatattagtgtgttttaaagcataatagcacctggttgtagaggcttctgaagtgcagagaatctcacactcatgagtgctatcttgagggcatattcacagtagccaccttatccaagccactcagatactttaggcttagcttttaaaaatgacctgcaggaggggaccagggccattgaaagtagtagaaacagaattcacaaccagaatccagacctcattcagctcaatgggcctctttcatctctaaggaccctcacctaactccctggctagtgaccatcactgacccaggatagtaacctcggcccctccatggatttaagattaagccttgccagtccctggaaactctgatcagaagaccaagcagcaagtttcatgactgaccagagaatataatttctcagtctcataagcctttgggttcagaaattttagttgagatgctcttgtgacttatttggtgtctgctggctgcctctccacttgcccgtttggtagtcaccaaccatctcacatgcgtggatggcactttctagctaaacttaatcacagtcccaacaggcctaaggaatctcttcagttcctgtataaggagttggtaaggttggccttttctttacagcagagcagatttttatggaacccctctggaagattttactgtaagtaaacggaccattgactagaaagccagaaccagtgtttccaagccagtgcagttaacactcatgtatatgtgagtgtgaaaagcttgggccatataatcagcattattttatcaagtgtttttgtgttttattttaaaagctttgaataacatcttcactgtgtccattgttatcacacccagtgagccaaaatatcagtgcatacagtgagctccaagagtggcccaatttgggatttaaaaggtgtgtttgagttaaaagcataaaaagccttaaacttttaaaactgcagactattgtatccttctaactccagaacagctccgtctaatgctgtccaacttggcaataaaaacaaaatgaagaaagccgaaacacttttagactcacaccaagtatgcagtatttcagcctgacaggattattccttggctggagtgacttacgttggaaggggaagtttgcatggaaatgcctttgaggttaattgtaatgtcattaatgtgatgttataatcacatctctgaatttccttcataaatttcttttctatttttatcctgtttttatttttaatacactactttcttgaaaaagtctactgtagtctcacgaaaatacaactccccttttttaaagccccgtgaaaaactggtttttgcataaactgtagtttataaaagcatggtcatctgtcctctcctgctttgcagttcctttttagtctttgatcgtaacatacgcctgcatgatgagtgactttaaatgatcaaattcaagtggcagcagatattgcactgagcttagaaaaaacaggtcttgtgctagtatttccattatgactgtttagtatagtattgcccggaatatggcaaaaccaccagagataattctttttaagaaaatcatctgtttagccaaatctgtggtagatttgcggcacagactacagtagaggaggaactcagtataaaccacagaaactgctcaggaacgctgcaaggctgttgtaatcagattgcttgtagctacttgggctgttgttggttccgtctgttgtgatgagagcacagggctagctactaggttctctggcgttcccagcattgtctgttctgttgacctttgaatgtatttgtctcaattgttcttgggctgtgggagaaagactttcggatgagaaaacaatggttcccatcagggacactgctccatacccaccctttgttttgggctcactttcacagcaacaaaatcccaagtttggtcatgctgccctcctgcctcctatgtgctgattcccacttctgaaaacacatcttgaatgtgcctcttgaaatgttgtcatttttctaatcttgtttcctttttaaaacaagcattttattccatgatttgcacagttctgcatctatatcaatgacttttcacccattccccctttccaacgcatttcttgggcaaaagtttgtgtccagcctgccattcaggaaaggcaaaggtttagctcaaatgtgctactttgtggtagatggttggggtcaaagcctgttcatgagatctctgtccccataaccagaaaacaaatcccactgatacctaccaatccttatgatctgatacagagaaaagaaaatctatacagaattctcagaaacatttactctatagggcatttagcaaataaatttctggtgtaggaaaaataggatattataccaaaattacaacaggtaggagacagaattttaaaagtaaggattatgatattcagaatttatttatatgtgtacctgctctctctctctctgggtatattttataatcaaaatattatgaagaaagtatgtattttattttgctttttctcagatggtaagatgtttatatttattttgttgttctgtaaaaatgatctagtcctttttcccattagtgagctcttgctaatattagtactgtgtacaatctgggcctgctctcacctttctctagaaatccatcaccatgactattttataaaatagtgagtttgactaaattgcccgaagattcctttttcacaaaaggaagctgtggtgtccagccaatgacttgcctaaggtcacacaatgaaaaaactaaagatgggtgaagttagacacctcttaaacatagggcaaggatttccttttatagcctatgaacatctactctcaaatcaaatgatttcagagattctcctgccattgccctgtatacaaaaaacaaaagcaaaattttcttccatacatgggagaaatagaactgcttttaatgaagttctgagattcagcacagtcagttaaattccttccagttgataagcactttatgtaagacctctgtaagtgaaacctgaagaactcctttgattcccctttccattattgatcattgtttataatctcttgaacaaagagaatacatctacattttatatagatgtctaaagggaaacaaatctagttttaattccgtgttatggtgttggttttaggaccttgggcaagttgtcacttgattttctcatatataaaacggggagaataactgtacttccttcgcccatagtaaatatttgataaatatcatctccagacctagaaccaatgtggagaagttccagaaaagatgtattgttacagtttatgaaattcataatacgtaattcacaaagtttaaatagataaaatacttcatatacagttattataaattcctttattcatctctataatagttagaaaaacttattctgagggactataggtcctgtggaaactcacactccacttctactcttattctttttttattcaggtgatattagatataatgaagactaacagtagtgttcaaggttacctttaatgcatccagggttacccataatatttattttacctctttgcaccagcattaaaaaagaagtgtgaggcaggggtggtgagagaatactttgaagagaacaaggagataaatgaccatctaggttaggcaagatggggacgtgctcagaaattatttgttaagttaaagaatgttaaagagacaatggaagtttatgtaataaaataaggagtcctttgctgatttctcttcttctacctcacagatagtttttgggccattctctttgtgggttgcttatttcccacaccagtctgtggcccttaaagcaagggtcttggctgggcatggtggctcacgcctgtaatcccagcactttgggaggccgaggcaggcggatcacgatgtcaggatttcgagaccagcctggtcaatatggtgaaagcccctatttactaaaaatacaaaaattatccaggcgtggtggtgcatgcctgtagtcccagctacgcaggaggctgaggcagaagaatcacttgaacccaggaggcacaggttgcggtgagctgagatcgcaccactgcactccagcctggacgacagagcaagacagtgtaaaaacaaacaagcaaacaaataagggtcttaggacgagctgcctaatatttcatctttgtcagcaagaaaagaaagtagaatagaatatctttgggtatgggccctgtttttgaatttggtgtagggtgttttgagagaagatacagctaagatcaccagtccttgataagacagggtttcttttctcatatgtgcttcaaaagtcacaaataatcatcctgactctccttggcccacctcaaaccactctatccccattggtttggatatggtcaagtccagacatgtccctctaagcagccagggcagcagaatctctacttaactaacattagttcttaatagactatgggatattgaacataaaatccgaatagctctccacttgtatttaggatgcatttaacatttttctcatagtgtctatatttttattattacatagttaagtagatcttatgctaaaattcacataatgatactaaatatattctctataaaactcattttggagccctctggatcaataaattggttagcattatcaatatcatctctgctttgacatacctgaaaatcacgtttctttaagttaggtaaatatttaagtatgagaaaaatctgaccaatgtatttagcagactttgtgaatttttttaaaaaagattggttttggaaaatacacacatacattttgccaagaacttgccccctaatgtttaatcttgtggctttcaggggaaatctaatttgtatccttcgtttatgctcgactcaacagattgttgcactgttagccaagtgctggatggtcttacagcccatggggcttttcaggtttcttgattctctacgggcccccttgccttgcttctcagtccctggtggataatgaatgccatacattttaaactcaggccaactattcaaaaattaagtcacactacaaacaatgagctatctcagtatttgtgaaaactggagaattatttctttcccttcttcccatccccaatggccactcagtttttactgtgaggtttactgggtagctgaagatgatgactgaaggaaaggatattccactgaagtgatagactcaggatagcactgtacttttctatatgtgggtgacagtggcctgggaaagtgttggggctgcgttttgagaaccctaggaagccatggcatccccctcaagccattcaaacaccaaaacaactcatttgggtttacgttgtgttggatgaccactgcagcttaatcaagacttcttcttgccattgctttgaatttccatccacttagccagtattgcatgctctatcactgccaggcctttgttcttccacagatactccttggcccctttagaacacagtaacagtattgttggtgatgaagggcagatgggaaggaaggcttgaaatgggcccagcaggagctgacgttctctatctcctctcagattattttctctcttaccctctagaaagctccccatcatactccttagtatcgataccacaccatatcctagatgaaaggcacccccgtcagtggggcatagaaaaaacctagggcacggtagtcaactagagtattccagtggctcagaaaaaaattctgaagcactcttccttttcttgtgaagagcttttggggtttaataatggcaggagttccaggttgctctgcttctcttggccaggcacttaacctacaggaggttccacctgaggtcatgggagtcactactagtggcttggaacttgaggaagaatagaggggctcacggtccaaatcagaggagatggagtttctgactttcagagtaaagcatgaataccttttcctatgtacatactgttaaatcaagtggttggatattgtagtactattactatcaataatagagtatttgttctattatagtataactgtaattctttttacattaaagtagaactaggacaaactataccatttgtcacattatttcccagggttctaactccaagaaatgagttctaatttcccagcaataaatacacagttgaactttataacctatcacattttttaattggaagttactttatcttcaaacctcctgttaaaaatataggactttgaaatactatgcagccataaaaaaggatgagttcatgtcctttgtagggacatggatgaagctagaaaccatcattctgagcaaactatcacaaggacagaaaaccaaacaccacatgttctcactcataggtgggaattgaacaatgagaacacttggacacagggtggggaacatcacacactggggcctgttgtggggtggggggaggggggagggatagcattaggagatatacctaatgtaaatgacgagtcaacgggtgcagcacaccaacatggcacatgtatacatatgtaacaaacctgcatgttgtgcacatgcaccctagaacttaacatatagtaaaaaaaaaaatataggactttgaaaatgaaatttgccagtatgaaagcagagatacttagagtcattcttataccacagaattagcgattactgtatccagtctcaccattttatagatggggaaactgaggtccagaatggttcttctgtgatcccttagtatttcctcactttgcattttcttttagaaaatgtgaaaaaaatctaattgttccatgaaagaaggcaccgttcattattaatggaatttccttttattcaattttgcagtgtctgcaacaagattatgaaaatgataatttgatctagaagtctttccagcttcagcaaggttactttgtggagttggagataaatgaccagaagaaaacttcacaaaattagtgtttacacttaatctggcaatgagctataatttgattggtaaaaaattcatttggtgtacctctggccctttgctgctggataatgaaaatttatatctgcgtttcagacatctggggagggcctgacagctttggggctgaatgaaagatgatgtcacactgacccctgtcagcatttcctcatagactggttacccaaaacccaacagcactcacactttttttccccgctgccagagcagactctcatttttattttggaaagttaatgacactgtaaatctaataggccattttagtgccatcatgtggatattaaaaaatcatgtgaccagtcagggcaccatatgtgggcttcactgttgtctaatggcaggaataagaggctgtaacaaggtactgagggcagccagtgtttggaattaatttcgaaaccatagctacctttaaactaattctgaatctctgctaatgattattgtttgccatttcaattaagtttgctttaattagctagctaatatcagattatgttggacctcagaaaataatttaccacttataaattgatgagtaactcatattctgtggcacagcactgacccatagaactttctgtgacgatgcgaatgttctctgtctgtgttctccagtaaggtagcctctagccacatgtggctattgagcacttgaaacatagctagtgatctacggaaatgataattttaagtaattaaaatttaaatagtgacatgatggcgcaactataatgtaagactagaatatcagaaaacaacaacaaaaaagcatttccttcaggtatctagtctgcctttcattggtgccatagtggaaaggccaaactacctggtgacagagctgaagtctgatttacctttgtatcatcataatgccttttggacagggtaaaaatatttagaagcaagtgatgcataaacgagtgaatgaagtggatacgtagataatgaataaatgaatgcaagcaatttaagtgattttttttctattttaccagttcttgctgcccttttcctgaaggacacgtcagccaaaagttgtgagatttgacagccagatgaattcttagtgatcacttagcccaacccattcaaaaccagaccagagtgacttccaggagctgccactggcttttttttttttttttaacatctctttacgtctccaaaagctgtgctcttgagtacagcaaaaagcccatgggtccaagggggctaaaggtaactgggcacacaattcacactctttcacaaaagaaggtgggaaggcaggaaacaattatttttggatgctagggtaattgtgtagccagatagaagtatgtaaagggaaattgaaataatttctgagtttactccaaaatgttaccgaagtatttaaaaataaccattaatgactgttatctaatgttagcctcataaaattaggacaaaggtgatagttctggtgaagaagaagatgatgatgatactattagttaacatttgtttactgcatattgtttcaaaaatgatgctaaattctatgtaaggattactttagttaatctttgcaacactgcaagatagttccagtatttgcccattttacagatgagaaaaagaagagagtgtaagtagcttgcttaaggttatgcaaccaatacaaggcatagatggattttaaatccaaacagcctgattctagaattacatctttaaacattattgtatagagtgcctttccctaatcttcttcttcgattttcttcctactttccttccttcctttattcattgatttagcaaatgatttttaagccccaactatgcgccggatattgttcgagcctcaggaaatacactagtcaacaagacagacaaaaattcctgcccttatggtctttctcttctactggtgagaaaagacaataaaaaagttaagaaaaaagtgtagcttattggcaggcacggtggcttaagcctgtaatcccagcattttggaagacccaggtgggtggatcacctgatgtcaggagtttgagaccagcctagccaacatggagaaatcccgtctctactaaaaatacaaaaattagctgggcgtggtggtgggcacctgtaatcctagctacttggggggctggggcaggagaatcgctagaacctgggaggcggaggttgcagtgagccaaaatcgagctactgcactccagtctgggtgatagagggagactccatctcaaaaaataataataaaaataaaattaaatgcaagaaagataaaataaagcaggtaagaggaatatgaagtgttagcaggtgggaggaacaggtagaaattttaggtaagggaggtctcactgaaaaggcaatatttgagaaaagaagcaagtaagtgttcttttcttttctttttgcttgtttttgagacagagtttcactctggctggactaaacagctcactgcaggcagcctctgcctcccaggtgatcctctcacctcagccttcccaggtagctgtactaccagtgtgcaccaccatgcctggataatttttttgtatttttttggagagacagggtttcattgtattacccagactcatcttgaactcctaaactcaagtgatccacctgcctcagctttcttaagtgttgggattgcaggcatgagccaccgtgcccagtcttattttctaactatatagttagaaaatgtatatttatttacttatatttatatttgttaaaatgtatataattggaatatattatatattagaattatacatattagaataatatatatattagatcctttaaaaaaacttaatgagatggttcctaggttaggaggtaaacttatagttaactgtattcttgataaaaaattaggatgattttatatatatatacacatgctattattatatatagcaaactaatgtatataatatatatataccattatatatatacacacacctatatatgtaatttaaatttatgatgacagtggatttgggcatgcaagtgtgacagactttctctcactccttctacaccacacacccacccctacatatgtagctacatgtgtgtgctcaaatatatagtggtgtatatatagcatcctgattttttgccaagaagaaagttagctataagtttaccttctaacctaggaatgatctcattaagtttttgttttgttctgttttgtttttaagacggagtctcgctctgtcgcccaggctggagtgcagtggcgccatcttggctcactgcaagctccgcctcccaggttcaggccattctcctacctcagcctcccgagtacctgggactacaggcgcccaccaccacgcctggctaatttttttgtatttttagtggatacgcggtttcaccatgttagccaggatggtctggatctcctgacctcgtgatccaccctcctcggcctcccgaagtgctgggattacaggcgtgagccaccgcgcctggcctattaaatttttttttaaaggacctaatatagattgatattcaagttgagccagagctataaaaagctaagtacctctgtctatgaaattattttcaactaattcctttgattctgtgatacttcgatgtttgctgttatagcgagatgaggataatgcgctgaattttatagttgttgcaaaaagcccacagcagcaacactggggccccacagacacacatccaagatcatgacatagctcaggagacagcacacacacacacacgcagctatatacgtaggggtaggtgtgtggtgtagaaggagggggagaaagagaaagttctctgtcacatttgcacgcccaaatccactgtcatcacaaatttaaattggatacggtgcaacattgtctgtcaaaataaaactgtaagagtaagtaaagagagaactttttaattccctgaatgattttgggcaagcagtagtaggctttttgatgcctaatacagaatgattaagaaataaaagttaacactgatatggactgcattctgtagtatgtgaacacaaaaaggatactttcctaattggatacagtattcaaaattccacaagttctgaagtcactgtgtgagaccacaggttacaggcttttctgagagacactctgcctccccctgcctcaccctggatgcatagcactccttgatttgtaaaatactcattccagtcaaaagggaagtgtccttttgtgatccctggcatcacttcctgtttttccttgtaaacttcccacccaagctgtggcattattgggatcattgcccgaagtaactttccattacattgacaagtcaagtgcatacatctgatttgagtgtcatccttcctccagatttcaaaaattctactgcaaattaaacaacccagctcttgtgatccctgttgaaagttttatcttcttaaagatcattctgaaaaatgaaattttttcatgtcacacaattttgattaatggatcctttttttttcctgtaacttttcagaatttgtagacttcttaaacctaatttattttaaaagcacacagtaagatgtctcttcccattaaaataaaaatatatttctcttctggattatcaacctataagctatattactaaacttttagctttacatgatttatagtagtcaaatgattactgccctaagcattaatttcactatagagctattaaaatatttaattagagtcactgagaatttaggatgtataataaaattgttgtcaaggccatgttgtaaattctgattatgtttgtagatgagtgagaaaaactaccctatgctgaaatttttataaattttgaaattatggggattatatatatatatattacatatatattttattttgtaaaataaaatatgtaaaataaatatatatatagttttttgagatggagtctcgctctgttgcccaggttggagtgcagtggtgtgatctcagctcactgcaatctccacctcctgggttcaagtgattctgctgcctcagcctcccaagtatctgggattacaggtacgtgccacagtgcccagctaatgtttgtatttttagtggcgacggggttttgccatgttagccaggctggtctcaaactcctgacctcagtgatctgcccgccttggcctcccaaagttctgggattacaggtgtgagccaccgtgctcggcctatttatttatttttaaacatttcatgtatatagtagtgaggttatgttaattgtgcataatttacgaaaatgctaaatattttgctttttaaaaatctttctgaacttgagcagtgttatctttaagtacaatgttctagtttattacaaacccaaaatgtaatcctatatcagaatctttcctttgtgttatatattttattgtctccacaaaaatgttttattaaaaaaaaaagactccaagagtctagctatagttcatgtatgcaggcaagaggtgggaattctctgtgaatgtcaaatagaagttaatacaaacccatgtagtcatgtttactcaggtgccaaaatccagatcattctgttatgagttcatcttctaaatatatggctctggctatctgcggatcatccaccctcctgttacctacttgtgcaaggaagtcaaaatgaacccacagagatggggtatctgtcggttgttctctatggtatcatacctgtttatttgtgtggctagtagagactaaacttcctcagtagatttttatgacttaaattatagggtaatatatttattctgttttaagtaactccgtgtaaatggtggccacggcgatagcttaatgtgcgtttttgtttttgtttttgttttacagataaacactgtcaactttttattgagctacctacagtatttttgctatgcatatctgtatatctcttttgcaaaattaagattgcattttcataattttataaactatttttcttacttaacaatatattgtgaaatttcacaaggcttttccccaatattgtaaagtgttttcatgaatattattttaatgtactagattgaaacatatagaattagtaatatttaatgttttttaacctatagtgtactttttttttttttttactagagaaggtttgtgtaaattagcagtacatttatttcttctcatttcagaaatagcaaaaatgtatgcaggaaatgggggaagccagaagaccttgcaacctggcagccagtggtcagatgtcatttcagagatttgggaaggtttcaactattgcttttaagatacacctatgcctaaacaccactagaaatgacacaacttatttctatcccataggcttgaaataagtaagagagagttgctatgaatttggttaaaagagtaaacctagtgagaaaaaaagtagtttagatggtcgtcattttgacatcaaatgatggcaaccaaataaggttattttcaccatcataccatcagaaaagaaagattcgggatttggaaatcaatgaaagcagccagaaaacttccctattgtgcaacaaacaagacgtggaaacactcgtgagttgactctactcagaggtccagaaaaataaaggttgacactaaaataactttggcttacatacgactcatggcaaatgctaaataatgaaaaaatatgcctttcaggtctaaaattttctgggttgtgagaaaacatgaagcataaatcatatcaaactattcctggcattaggccttcaggatgcatttgtttgaaatcaagggccaaattgcctggaagagtgaaaactgctagatgccagctgaggcggaatgccagccttggaactgacacatcatttctggagagatccatatgcacgaccctagtttgtcttcaaagtggttcccttgaattgattttgtaaattaacaatattaggccttctgtaggatagaaagtgcattagtcacactgctcttactttacccagcaaggaaatctattgttcttttgtaataaaatggttctggaaggggtgagggtgattttgccacatcaggtaaaaggaatcacatttagttttcaggcaggtttaatgaggaattttaataataagagtaaaaagtcaatgagcataacttcactaaacaactcttaaaggaaagctgagccggctcctgttttcacaaatctatgtaaccatcgttgaatgggttccaagcatcaattgttcccagtgagtaaggacataggatatggcaaaaactcacagcaatttattaccagaatgttttaaaagaaatggaggatttcagaaaaggaggagctccacggattcatgtttaaattcaccacaaatgatttatctttgtgttccatttcttgtccaaggtcggttttacacaccatgtaaaattgcttcttttgaagaaagtctgcttttttaaaaaaaaaaaaaaaaggaaagaggagggggaaaaaaaagacaatgagtctcctggaaaatacttcataaggctttttttttcacattagtgttttgttctttacttttggaggagtttaatctgaggaatattgtgcaaggaatagagtggaatataaaataaagttaaacaaacatggctactttcaataaatgatactgattttctaacaactgcctttctattttcaaagccctataagaaaagcctgggcttttaggcttttagttttctaaatcttcacatgctctgatttttgcagagggtattcacattatatatatgtgtgtatatatatgtatatatatttataatgtagattttgtatatatataatagatattagatatttagatatatataatcctatagattatatatataaaatagatactagacatatataaatatataatcctgtagaacttttttttctgaaaacctaaagacttatttatgttaatggtagaaaattttgctgtaatataaaataataatcagtttgttggcacccttagttaacaaaaatatgtttattaaaaatctaggtagaaatgaatagtttcagaatcatctactgcaacatttaaaaaaattcattgtcaattactttctttacaggatttattagtattggggtactcaatgacttaaagtctaaaccaaaactctttttgccttattgaattctaaccaagagcttctgaaagctataactgaaaaatgatttacgaatttgtttttaatcaaaatggagtttcctagaatgagtttgtttttttttttttttaaacactcctgggctccattattcctgtttgtaaacatcagtgtgtcccttcaaatatgtcttttctatttgtattaaaacctgatcatataattaaattgaatttggcaagtatatatcagccatccactatgtttagtttagttcttttagtttagtttagttctcttttctaccgctaattctacaagctgagtgaggcctgctaatttccactgatgttcatacatgttagtttaaaaaaaaagttggcttttacaaagccacaaaggggaacaaatatagctgtattgcctgtcttaaaccaaaatgctttagcaattgaaagatgggggcagtgtagacactcaagaaagctttgggatctttagatgaatggtatcatacagatgtgtattattgctaattctttgttctcaatcacttgttttcaaggacactaaaatccatgtagcccctaaaaaagataaataagggcaagtcacttttcttcctccagtcacagactaaagaaattatttcagataatatatagcccttcagccatgggagcaggaagtgtttactgctcaagtcagggtctcagttggtaaaataaacggaaacttctggtttagttttagggccttctttcaaataaaaacttcattttctctgggcaaatacattgatttaattttgtattattggtaaaatattcataaagtcaggtcagtctttaaagagtaccaaaacataactttgccgattttttctgtttaagggccagctaggtttgtttaaaaagaaaaacttaaagccaccaaaaagcctatggcatttctttctcttatgatctttaaaactggttcaggctcatctgtttggagttatttaggtgtgtccctctttgaaaatgggcccccataacacttttttaataggataaaagttgagaacatggagtcaaaatggagcaaaaagttgaatatttcacatggtataaacatttttttaatcaaaggaaaagaaaagaaagttgcaaaaaagccaaaacatgatgaaattatctaatttctcatatattcctttcttttttcgttgctttttgtaatcttccagaacacttttcagtttggagccaaacctaactctactttttacatgcatatttttcacttctataaagactcgttaattcaaaagatatttttcaagcacttacaacatgcctaaaggatgcaagtcaagtataaagaagagagataactatttttgccctcatggagcttcctttcctgtgatgaaaattgatattctgtcagtaaataaataggtaaatttcaaatagtgaaaagtattaaaaaaaaagaaaagaaagagaggaagtaacaaagtgggggtaatgtgacagtaatcaagtgacattttgacagacatgaaacagtaaatgcctgaggataatagttacaatgaggggactgctttaaaggtggaggtgagagaaggttccctgaaaaagtgctatttgagtgtggtctgaatgttaggaggagctggtgtaaaaccaggcaggaaagctggttannnnnnnnnnnnnnnnnnnnnnnnnnnnnnnnnnnnnnnnnnnnnnnnnnnnnnnnnnnnnnnnnnnnnnnnnnnnnnnnnatatacattgctgactagaagaccaagactatgttataatagaaaggtcaagagctttggaatagatttaacattgttacagatgtgcctgtgttgcctgttttgtcttcacattgttttaaaagacagggcaagtagtcatttgttaaatttcctccccttacaagcagtttagctttttttttttttaccttctcccttttattcattgacattacagctgattacagcctctgtcctgcaggcattggagtatggtagagctattcaggtcatggtataaagcgtctgagttttattctacatgtagtagaaagccatcagagcattttaacaggggatggcatgatctgatttatgttgtctaatgatcactctggctgttgtgagagaagcagttgtggggtattcctggagatgctgctgcattaagcgatcattttgagaagtgtagtggaaggagagagagaaaaaatgtgggtagttcctagatatattctaatcaatcttaccattcagatcatgtccaaggccccaaggtatatttctcaagccccatgagagtagaaagaatcccctgaaagctttctgatagattgaatgcagatagagaaaatgaaaaaatcaagaataacactcagatgtttggcatgggaaaacagatggcaggtggagccattttggggatagaggcaactgagaaaagagtgtgttggtgaggagtgtgcagggaggagggtacttcaaaagttccgtactaaggaaactaaatttgagatagctattaaacatccagatttagatgtcaagtaggcaactggatacaaaggtctggacttttgtctagtgaggtcaagactgaggatataaatttgggagccatgaacacaaatgatctttaaagttctagaactggatgaaacatctcaataagacagtgcagaaagagaaaggaaaacagcctaacatgaaaccctcagaaactacaaccctgagagaaagaactagtaaaggagatggagtagaaactgtctgtgaaataggaagcaaattagaaagtttgagccatgcaaatctgtgaaagagcatatttaaagaaagaagtattggtcagtggcacataatatcactgaagaagatagattcagagaccattgatggtcaatttgacaagaccacagaagaatgaggagatcactaacttctgtgtcatggagtgagcaccatagcagaagacaagcagatacaccatccaaataattgagatggtgaatatgtagcagggtgtttttgtttgtgtgtttaatttttctttttgttttttactaatcaatctcatcattgagatcatgtccaaggcctcagggtatatttctcaagccccatgagagtagaaaaatctcaaaagagagagatcgcacacgttgctggtaggaatgtaaaatggtactgccacgttgggaaatagtttagaagtttcttactgtatactccggcaagtcactcttaagtagttatccaagggcaatgaaaaaatagttccacaaaaagacttgtgcacacatgtttgacataccattaatcataaaatcaggacattgaaactgcacaaatatccattaatagttgaaagaataaatccctttgatattttcatgtactagaataaacaagactgaaatactgatatatgccactcaatgggcaaatctcttagagtttgtgctgagggaaagaaactggacacaaagaatccaggctctctaattatatttatatgaaattctaggacagggaaactaatctatactgattaatagaggaaaattaatctataataatcaataattatttagggttgggtggaaaaggggaaactgaaaggaggcatgaaggagctctctggggaggtggaactgctctctatctcaattagggcggtggttacatggtgtatacatttgtcaaaagttatcagcctacttaatgtgaatgaattgtatctcaataaaattgatagggagaaagagagaaagaatgagatctctatttcttctgattagcttcttttgccctaaatcattttcttatcacatttgcaagatcttgattatgttgatagcccttcatttactgtttcatgtcagtgaaaatgtcactcaattactaatttctattgcatattagatagctctttttcacagagtagctaacaataatgccgccgtgttttcagaaatatgtttcttggtacagctatttttgttttttgtttttgtgtttgtttgtttttatttttctttaagttctgggatacaaatgcagaatgtgtaggtttgttacatagctatacatgtgccatggtggttggctgcatctatcaacccatcatctaggttttaagccccacatacattagcttatttgtcctaatgctctccctcccctcacccccactcccgactggccccagtgtgtgttattcccctccctgtgtcccacttatgagtgagaacatgtggtgtttggctttctgttcctgtgtgttagtttgctgaagatgatggcttccagcttcatccatgtccctgcaaaggacatgatcgcattcctttttatggctgcatagcattccatggtgtatatataccacattttctttattgtgtctatcattgatgagcatttggattggttccatgactttgctattgtaaatagtgctgcaataaacatacatgtgcatatgtctttatagaagaatgatttatattctttgggtataaatccagtaatgggattgctgggtcaaatgctatttctggttctagatacttgaggaatcgccacactgtcttccacgatgattacactaatttacattcccaccaacagtgtaaaagcattcctattgccccacagcctcaccagcatctattgtttcttgactttttaataattgccattctgactggcgggagacaatatctcattgtggttttgatttgaatttctttaatgatcagtgatattgagctttttttcctatgtttgttagccacataaatgtcttattttgagttgtctgttcatatcctttgcccactgtttgatggggttgtttgtttttttctcgtaaatttgtttaagttccttgtagattctggatattagccctttgtcagatgggtagattgcaaaaattttctcccattctgtaggttgcctgttcactctgatgacagtttcttttgctgtgtagaagctctttagtttaattagatcccatttgtcaattttggctttttttgcaattgcttttggtgttttcatcatgaagtctttgcccatgcctatgtcctgaatggtattgcctaggttttcttctaggatttttatggttttgggttttacatttaagtctttaatccatcctgagttaattttagtgtaattcaaaataaggtgaaaggaatgggtccagtttcagttttctgcacatggctagccagattttccagcaccatttattaaatagggaatcctttccccattgctggtttttgtcaggtttgttgaagtcagatggttatagatgtgtagtgttatttctgaggtctctgttctgttccattgttctatatgtctgttttggtagcagtaccatgctgttttagttattgtggccttgtagtatagtttgaagtcaagcaatgtgacatctccagctttgtttttttttttttgcttacgattgtcttggctatacaggctcttttttggttccaaatgaaatttaaagtagttttttctaattctgtgaagaaagtcaatgtagtttgatgggaatagaattgaatctataaattactttgggcagtatggccattttcatgatattgattcttcctgtccatgatggaatgtttttctatttgtttgtgtcctctcttatttcctgaccagtggtttgtagttctccttgaagaggtccttcacatcccttgttagctaacacagatattttgatccttactttaacatataaggtaatttaaataaaatatgcctaaatatgtcctaagtgctgccattactagtttgggatatctataataatgctattagattgacattatttattacccaaatcccactgtgtctttcctttactagtaacttgactgcttgaattataaacagaagctgttatgagcttttgttttatagacagataactggagtgaaggcatttcacacaaattgtaccacaaattttaataaatgtacccaaatcttttgctatacattatatatataatataatacatattatataatgtatatataatgtaatataacattgtgtatatatacattatatattgtatatttacacacatatataaatatacacacacacacacacacacatatatatatattgctgactagaagactaagactgtgttataatagaaaggtcaagagctttggaatagatttagacatgaatctcagactcgttgccagctgtgtgagagcaggcaaattccttcctctcactgagttctaattttcttatctgtaaagaggtaaagtaataattacttttctatcttgttatagggtttaaagataacataagttaagttttcagaacagtgctgacttgttatacaggctcaagtgtgaaagttgaaattctgtatgttatttctgttttcattcacatcgtcagcgtggtcagtgggtggtgggggaacaagagctgcttctaagtttctaagggactgccaatattggttaaaatcatctctaaattctaaactatctttttgaacaacaaggtggcatttgatggagcctaacagaagacatgagacattacctaaaatttttgtatcatttgtgatttttgagcctttgaaacagaatatcaggaaaaaccaccaatacctgcactaggaagcattctccttttcttagaaatctatgtaactcttcgtctccataagtaatccacactctttctcacatttatacacatatgtacttatatgtagttttttcagggtttaagaaaattagatctttaaacctgtaccaccaggattctgaaagcaaataaaagaccttgctatccagtaaaattttagatgatcttttcttatatctatattattaaaaatagtttcttatatcagtgactgctgctcttctgattttaccagatattaattatagcttatcctctgcttaacctcaactcttactgtaaatgtgacttccgcccactgtgtatccagatgggatattctgagatagtcacttcttcctgaggatatggaattcctttccaggaaacattgagaactattcttaacctggaacgcctatccatcttgtgtcatccttcagagatactgcaccttccctgctgcttctccagacatttatatgcacactgtttatttctcagctattttaggaacacctttcttcctcaatgatgaaagcacattaccatgaagtgattagctatgaataatcttataatgcttttgtttaggaaagaagtcactatgcctcaagatatttttgttctttatgctatatcatcattttgtttactagaagtagtttcaaactgcttttaaagtcatttttattaaacatgatttttatacttaaaatctgtttaatgttttcattcaaatataataaaatcataaattatctctgagccagtgtttgttaactctggatattcactagaatcatcttggaatttgttttttatgtattatgcctgggttacacacttagaaattttgatttaataaatctggggtgggacctaggtttaatttttttttttttttttttaagaggaagtctcattcttgtcgcccatgctggagtgcgtggtgcaatctcggctcactgcaacctccgcctcctgagttcaagcgattctcctgcttcagcctcctgagcagctgggattataggcacccgcccccatgcctggctaatttttgtagtttttagtagagacggagtttcaccatgttggtcaggctggtctcaaactcctgacttcaggcaatctgcccgcgtcatcctcccaaagtgctgggattacaggcatgagccaccatgcctggccataatttttaaacactctgcaggtgatttttaagtggaaccaaagtttgagagcccatattttgatgcaaacattttttgcaagcattaaaacactataccttttgggatgatcaagagttccattagatctcagaagagtcactgaagtcataattgccaatgactgtgattattagatctttcaacttatttttcactaggatcatttttcctgcaaaaaggaattagccaaagagagtataatgtgctgatagtgcagtgaggaaaatgtgtaagatttgaccttactttcatcccagtcctgccacagacaggcttggattcctggacaagatattctctggatgagattcacaaacatgactacatcaggaaccaggatggtgacatgaaagtgtgaaacaggaagagtggacattggcaagcaggggactcacttctgttctaaagggggctgcgctactcagccccagcaagttgtttctaagggaagatgcaagttaagtgttaccaagtctttccatttttaaagagaagtagaaatttcctttttggggtgaacattttcaattattattagcatctaatcccaactttttgttcatgtgattattatttatattgtggggcttaatttggcccccaggacaccagtttgcaatatctgagttaaatgatttctaaaattcattcaattctaacactctaaaattctaagcgatctaatttggccaaaacatgaaaatactcccttaagatgagaagcttctatttgaatgtgtgtttatgtcaatcttcctcttcctgaatcctcccattttttaattaccgctgatacccttggtcctggcagcttactctttctattctgacccatcctagagttgacgtctcaagaatttaaataactctggctagtacactgtatttacaatatataggggatcccggtgttatgtcaaaggaaagccttgtcttaacttttcagaagggaatggaatgtacagtacggtgtggcctataaatcattttcaaattagtattctgtacatctggagaagagtacatttctactcatgcataaattgcctatgaacacatttcaaaaacctatgcttaatcttagcaatgaacatttcaaaaagtaaattaatatcttcaaggggaagaaatacagtatattaaacaggaacccactagaaactcgatagttaagagtctgtcagcgtttccattataaaccctgtttttgaggggtttataactcacttataaaaattcattgtaggctgagacttggcatgtaaggtcttagcctagcagcttgatgtgatattaggtctgaaagacctcagattcttgtcaacgagatactattttaagcctccaagatgaggtctaaacaaagacagggagtgatttaaacccatagcatccagggacggcagaggaaaactgaaataactgctttaagatcagcaagttgagccttggttttgcagagtcccacactgttgtctacactgaactgtacatcttgtactgcagaggatgcggtcagctttattttcctatttgggtcacactcaatgtaactttaattcctcatttggtagcttaatatattgtctgttgaggttacagatttagatgagtgtttataaataaggcgaattaacattgaacttgtaactctttttttctttccatttgataaaagatattcctaggaagtaggaatagagtataaaaatgtcttaggccattgtaaatttcttgtgtaaatagctctgtgatatgttgcatgtttaaattagcacaatatgtattcattttaaatattgatctttaaggaagtcctacaataaatctgaatactcttttgcattactgtttacattaggtctactatagattaagagacacagttgccttgtaaatttgcttgcagagtaggcaggggcatataaataattctgtttccaattatacaaaacaatgatgataaactattgggagctgtgggacaattgtgcagagcttggctgaatcacagactcagaccaggcttgtgagtaactgatgtgcagctggaaattggggctattgtctaaatcaggaaacaaatgaaaaaggggcatagaacaaaattctataaacgtagctccatcaagatgcagttcctttccagctgtaaagtttctaaagagttaccaaagctatttaaaaacataaagacagaattgtttggcttggtaatggcagcaatttgtctgtaacaatgttaagtatgttgtggtaaccttcatggggaaaaccctatggatggacttggttgtggtttagggtttccaccttctcccagtagcggttccttgggctgtggcatgaactggcctttgaacaatttgatagctcaaccaaatttcagctaggaatgttaaaacataatgattgaaaattaagaataaatttacacctaagccatataattccaaggccaagatcaacccattcttcttcacattcctatcatctattcagaagtgcagatattcacatggaaatgaggttggttgaactgtttagcttatattgggaaacatatctgctaagcagctgagaaatgtattcatttcagtctttccatttgacaaggctcattctcccaagtaaaatactaagaatgcaatgacagcaactgaagccgttccatttcctctcctgactttaatctctccctaagaaaaatatttcttgaaatgctataatgtgtgtgcattgacactcttacttagatatttaaataggcttgtcctatttattctctatgtctggcaaatttcttttaatggttatttaaaggagtgttaattattttcctgattaatgattattataatcatacagtgcattttagtttataaagtgtattcatgtgcattattatattgttacctcattgacattattataagaactttagtaaattaattggatcaatattattatttttatccctattttttaaatggtgaaaggaagttcagagaggttaagtgatatgtccatgtttactcatctagtaagtgtcaaacttagactccaatccagctatttaaacataaataccacgttctttccactgtggtattaaaatgacatgttttcaaaagggctgcatttagccgagggagtcccacaggagatgtgtgttgatcaattggcaaaatgcacatcaaggattcttgctattcatctccatgttgcttcctgtcgaggtgaagtgggcagtgtaaaccacggacagttctaaactgtagttttaatcaatggcgccaacgaagttcataggctcaccttgaccatgcttatcctcaatataccatgaaaatgactgctaaaatagtccaaaggtgagaaatgagaggaagttggtgagaaatggcaggatgatggctatgttgattccagggcttttttggtttgctattttagaactttatttgatcattctttgcagtcccttgtatattacatttcaagaatatacacctaataaatccatctgcttgcctggtggagctgattttgattcccagaaagttggacttaattgttaactcttttttttttttttttttttttgctaatggcaaggtattttaccagatgcttttagtactgaaagaacttttgggagcaagagttgggtgaaatttcttgagaagtgtggaaactgaagcagccagttgtacactccctggacattgatgtactcttacaccgtgtctggttaggtggaactgtaccatagaaataataactatattaaaaatgtaaaggcctctctgtacattatctcagggatacagagtattatgtcactacattggattaaaattttagatgctggaatcttaatgtaaaaagcttcaaaccttaacaaataatacagaatttagtctattttgtttcaaggctttgattttgtacagaatttctggccaactctaggaaggaaaacattctgcaataaagtaaaatactaatgactcaagaatactgtgtgacacctaatttggtgattgccacccaaagttatattcaccagtttaaatcaattacttggcatagttataattacattaataacactggtttgcttttccaaatccaaatgttatacgatgaaaaatactctgactctaaatggttttaattaaaaaaccaaccattttttaaaaaggtggtaagaagtatattttttgtcttcactttttgttttttgagcacatggttttcaagaaaaaggaaagtaatgattatagtaaattacaggagtcaggcagcagggtaattaacaggtaattatcaataaacaatttaaccacaaaagcttggatcccacctaccacttgtcaacaataaaagcttagtaactccacataccattggaaacagagtctacagggaacccctgaaaggactgctaatataaataaacaattctttcttgggagaatacacaaaggccaggctgtgggtgaccacatagaagaaggaaagaaaaatccagtaggaaggaaaaatattaggaaagcaaacatttggtttcagatttaggagaaaaatatgaatgtgcttgatactgaagccagaaaaattatctatgaaatgtccttctcatccatacataaattttatgtttatttaagcatgattggaaatgtacgatcgtttagccaagttggcattatgactcaggaaaaagtggactttatccagggctaaatatagccaacatgatttatatattgaatgattggtgaaaaatccaccaaaaatatatttactatggaaatgtacaactaggctttgaacccatttctaaacttcatagagaccttgattggaaccctcttcctttttaaaatgggtcaggtatctattactctagcttgagggtatgggaagtggttcctaagtagctagcgtaaaggagccatttaattcagacaaaaaaacctgaccctacctagtgtgaataatagtataaccataattttaaatttcattttggctctgttaatgtggtattgggacacaatttcaaaatagctaagtaagagattgaatttcattgtagaatagattttctctttctgaattttattttgtctacacacacacacacacacacacatcttgtctaaaatcatagttgaatatgccacaatcaaatgtacttattgaatattgtcaacaattggtgatgtgttaggcataatgcaaagtgcattaagtaaacatgttctctgtcatttaaggtgcaagaaataaaattctcataggacacacttgaaagacgtacatgcaactgaataaacattgagcagatgtacatattcaataaagacctcactatctacagggcaagggtaaatgtatattgcagagtgatgagagtaagatagcttgtgggagttataaggttagataggggagtcttaagaagtaatcaccatttgaccactgattagtcaggaaagtctttggggatgaagagttatcacatatacaatttgaatgatggtcagcaacaagcctggcacatcagagtagggaggtcttgcctgtagagggaggacagaacaatgctagaatgaagccatggtctctaggcctgggcagagaagctcagtcccgggcagatagtgtaagctgtctggggaagaccttactctaaagcaatagttttaatctttagtataatgtttagagtcctctaagacctaattgcccaaatatctgacttgactttgctctacattttgcctagactccaaactaagatcgctttcattttctgttgctcggcattatgtctgcctaaattttttccttcagattgcccacatccactttactcattagaactctgctaaatgacaagtttcccatggttttcttaattcccttttgaattttttttagacaaacctagatcttgttaaaaaacctcccactgtgtcttctgttattaaaaaataattaaataaaaagtgagtttggatacatctatcatataatttgaaattacacatgaatgtagagacgaaaagtgactttgaaagatcaattctcaaattttgatttaagaactgtgctattagctgaaagaatatgaaccaagtccattcttttgacctttgtaaagtcgaacctagtcaattattgcagcagagcagggaaccaaagaatagctttgaattggttagacccaaactgatttaagtttgcatgtggttaaatacgacattagttaaaaataattaatgctgtctttgacctttgaaatgaggaaggacattcattgtcctcccccagctcccactccattcatgtaaatctacttaactctttgcattgcctaaaacagaacacaacgttttactatatcttgatattaaatatctttaaaaacataagcagagttgtatgcttcttaaatggatggctttccaccaattttcactcagatatttagatatacagatatactcagatatttaaagtatacagtttccatggctcacagctaacctttgaaaacatggaaatatacagtgtatgtttcatgaaatgacagagtaacgctaggatgaaactatggtctcaacttatctaatccctttggtacaatttggcaagatcttcttgggattgttataagaattttattgatcattctcctttcagatttcaataagacccagaaatgggtgtagttatggtgttgtgcatgtgtaacgtaactcacagttttttagggaggtatgcctaaattgcattataatgctttgaaaccagaaagaaaaatgaagccaggttttgtgcctcacacctgtaatcccagcacttcaagaggcttaggcaggaggatcacttgaggccaggagtttgagattgtaatgagccatgattgcatcatggcactccagcctgggcgacagggtgagaacttgtttccagaaaagaaaagaaagaaaacaaaagaaaagaagttaacatgtttcctcttccatttttctccaccatttttccccacgatttttccttttctgccaatctccacttcactgtgaacaaagagggcctctatcatcaggaaatctactcagctctgctggggtgctgacggaagagaaagagcagaagtaacctcaaagcaggttctaaataaacagtctcctacttaatgtaggataagtctttattttgctcttcattgcttccaaaattaatttctacttcaaatatattctttggggtttaataagtatgctccacatgttctgaaatatcagttttaaattgacaaataaatggccagtagaggtgacattggggacacatgagtggctgtcaataaatgttcagtaaacaaatgaataactccatgtggactgttatatagaccacacttattccatcttcttcatctaaaaaactcttattctgtctcttgggtccctatttaattttttttttcacaggaaggattttcctgactgctcttcccaaattaaattatgtcccaattatttgttaccgtagcacactaaaatgctgcttgatcttttatcatattgtattgggattcactgtttaatgtctacctcctccactgcaccggcctgttatgtgtggtattctgtccccactgcctagtacagtaattggcaaatagatacttgaactaaaaattttatggggaagagtggtcaggaagtaaatttcaacttgaatcagcaaaaaagaaatgaacagtgggtaaggtatgcgaaggaaaaagaatctgtggcaagagaagaaattaaataaaagaagagatgcttggaatggaatgaggggaaggtaaataatgactttgccatcagaacttcatgcctaaaccatggaagaagtaatgggcaccaaagcaagggaaggaagtagttaaacaaaaagagagcacagaataatttacagtaataataatcagaaattaaaatagaaatgtactttaacaaggaagatttcctccacctgtttttattcctgactttttcttttccctagggaaggggagagcaatgtgaagtgaaagtttgatataaagatttgatttaagacatgagtttttcttcaaaaataaaaccttatttcatagtaagtaaatataagacattgaaccattttaataaacagggtatctatctgttgttatgaactggtcactaactcaacatcatcttttattgtcagaagaatcataagtagtttacatattttaaaaatcaagttttggtttttagcattcacatatttttaaaactccaatgttggcaaatagattctatgttttagaagtttcatgaaaatgtgttctttgtatcattttgcacaaaaggaacatgatttggtatttgtttttagcaagtctgccaaccacacggagatgttctttaccacagactttacctctgcctccaattagaaaactatagcccataagaaatatcattgaaagatcaatgataaatcaaacgcctgtcagttgctacctctttctgaggggagaaggcaaagtctgctatagcagagccaaaccagtaattttataaagagatcagtcattttcagaaatctttaacccttattctttattgagttcatcacttcacaaacctcagtttgcacacacaaaatgagggtgcacatccttatcattttgagtccatttccctttctgtagatcattcacaggagcactttttaatatacagagagaattctatgatgtaaatttaagtttcttgtgactctaaaatggatcttctggctttaaaagcatagcatttgaagtagtcactaacattatcatatgaattgccttgtaaacacataacacataaatatggctaagatcagaagctgctagaaatcagtcatgaagcctctgagtatatggatgagcagacaccaaccaaagtagactgggatatactggagactttattcatttatcatagtccgcacacactgcacttgttttattttattttattttattttatttatttatttatttatttatttttaatttttaggttcaggagtacgtgtgcaggtttgttatacaggtaaattgtgtgtcatgggggtttggtgtacagattattttgtcacccaggtaacgagcacagtactcaataggtagtttttcaaacatcatcctcctccactctccaccctaaagtgcgtcctggtgtctatagttcgcttctttgtgtcaatgagttcttgatgtttagctcccacttgtaagtgaaaacatgcagtatttggttttctgttcctgcattagttctcttaggataatgccctctagctctatccatgttgctgcagaagacattatctcattcttttttcatggctgcatagtattccatggtgtatctataccacaatttctttatctagtccactgttgatgagcatttaggttgattccatgattttgctaatgtgaatagtgctgcaattaaaatacaagtgcatgggtctttatggtagaacaatttatattcctttgggtatatacccaataatgggattgctgggtcaaatggtagttctgtttcaagttctttgagaaattgccacactgctttcccaatggctgaactaatttggattcacaccagcagtgtataagcattcttttttctctgcaaccttgccagcatcttttatgttttgacttttaataatagccatttagaactctatttttatttaaagtgtgaatgctactcattttttcttgttttgcccttattaccactgaattaggatgcttgttaataaacttctcagtaggtaatttcaaagtgagacaagtagttaatatgtgcactaagcaaatatgaaaataaaacacatgcctcatgttaaagctttatgaaaattgtgaagtattttacaatgtgagacgtgtatgtgtgtgtgtttatgaattaatcacaaaccattttgtgcctctagcaactttacttttcaaactaagtctttactattgttgttgttttaaaatttttctttcctcttagaaaatgattatctcaggacatatgatagctgagaattggggaggaaatatagaatgtctgagcatcaagtgagatatagatataaaatgccatctcatgcaggtcagccatatttaaaattatgtttcctttagaaaagaatgcacacgctgataagctatctcatataatcaatgggcatgacttcctgtgaactctattcatgctggatccctatagttcataacgataggagagaagaaacataaaaagctctcttccatttgataactatagaatcctggctaagtccaaagtttagccagagagcatattggtttcagcagactatggtaaagttaattaaggatgattaatggagcatttccttccaatgatatctgtgacagaacaaagctgtctgaggcttgtcaagcagaatttgagttgaatgagtatttatgtgatcaaatctgaaggctgcctcttgacagagcgaggattcatcaatcaattgctctggcttacagtggtgggaaattggtctatcccagtaggttctgttcccatcccccatttttttcattcaatcatccctcaggctacaatgcatctttagcttttacctctgaccaccttaaggtatatcagagaaaagtaaaggcaagagtgaaaacatctattatggtagttcttgtcttacctgaattcatacaattaatttctcttaagcagagggttataaagtgacacaggcctgaggaaggaattaactggcgttaataaaagttatctcacaacctaacaagaaatgattgtgagcctagtcaaaattatcacctttttccgttataaaattgtatgctgtttcttaagctactatagagtcagttaattctaaaaattgtctaaagaacaaacacagtttatgcggcaggtttttgctttagtcacattctacaaactgcagtcttcagacttgcattctcaatatgacggtcactggccctgcaaggaaaggccctgttgggcatcagctctggttagaccaagcattgatccacctggacagcaggctcatttcacctggggtattcaggatcttgtttaattataatggaacattgacaatgcagaggtgtgatccgggattagctaaaataggtatatttgttttacaaggttcttgcaagtgatttcatttgtattatttgatgatcacaaaaagttcatgcaaatagagcaggtatgactgttcttattatgtagatgtggaaactgaggttgaaagatgttctataacttgctagaatgatatagctgtatgtggctgagatgggacacagatccacagtcccgtctctaccatagtccttcatctctcttgtagactactgtctttctgggttgtggctgactgcttatttgcactctcaaatgatagcacaatatttgcacgcagaatgtaagtgtaattatgtatgtttttaatggtcaaagccacttaagcagcttcagtctgatactactttggcggatgctctatttaattctgaggttgaaagactgactgcaacttggagtggcaaattctggcacagcctggcactaggactcctggtgatttcagcggtaacactcaactgcatttagtttcttggcagtgtcagcatggaaaatacacaaacaaatatggctttccagatgtgtaagcccaacaattcctgagatatgttgttcaggaggaaaaaatatagtcatgcatgcctatatgattgttattgttgttgctgttatttattaagatgtttacaaacaagcttttttttaacctttaaattgcattttattttattttttattatactttaggttttagggtacatgtgcacaacgtgcaggtttgttacatatgtatacatgtgccatgttggtgtgctgcacccattaacccatcatttaacattaggtatatctcctaatgctatccttccctactccccccaccccacaacgggccccggtgtgtgatgttccccttcctgtgtccatgtgttttcattgttcaattcccacctatgagtgagaacatgcagtgacaaacaagcattttttaagatttttttatatagcagagaaggtaccttgttggtcctttatcagaaaattgcacttgttccccaaatcatgcttattcatcttgaaaggtacagtaactgattttataagctacattctcactgtctttgaaaagcatatatgagtcattattcaataaaattttcattaaattttacttaaagattttgtaatcatttgtcattacagtattagtatttggaggaaaagtttgttatctttgttatttattttcagagtgcaacatgagacataaaaaggaacattatttaataaaagaattgccaatggattaggttaatttcaattaatattcatttctctttagtcttaaacatgtaacacttaactataacccttaaactaacactaaccatagttttatatagctataacttaaattgtaacaatgacttttaatttctaaaatcaaaacttttgaaataggtgattaacattccaaaaattcaaaatgagctttagctttttagccatgtcatccttgagaattaaatattttttatttaatattttttctttaaatgtttttccatgaaaatattgaaaggccttattctcatctgcttttcctttttagatattttttgtgtaataccattgaagacccctgtgcagttctaaaacgtctttaggctaataattccttattctgtaagatattttgggataggaaaatttatttattttaactttagagaaaaaaaaatccaaagatcagaaaggaatgactgaaagacagccattggcccatttgacaatgtcttctgatattagctcactccgaattccagtgatgttcaacaaatgcagagttgagaactatttttttccttcttatgaacactatatttctatggatactcttggatgttagaagctttgtgggtaattatatcacagtctgctatagaatttgaaagtctgtcaactatgattaagtcaagtctttgtccattcagtatttagacaattgatttcttaaacctaagtgcaggattttcatgtctattaaattttaaaaattaattcagacacatagctctgacctggtaagataatttaatatctagcttctgttattttacagactctctacttttaccccatgtctgctccctcccttaggcatgtgtcatttcgatattacccctgcccccatcatccaagtcactgataaaatgtctgaatggaataggataatttctaggttgctattgagccattaattaaccctgtttgcatattcttgagcccaaacatccaacaagctccaatgataaaaataaacaacaagatatcacttctatgttttgtgtgaatgcatgacatcaccttccaagttactgtaactatgtaggtaacaataattcaggggaggtctttatgcaagtttcacaggtcgcactgcaattgcaaagtggatagtcacactgtctgtaaaagtatgaaagtacttccaattggaatgaaaatctggtcattcagtgaacatcattaattttggtgagttggacttgtttaattaaactctcttgattaatcttatgtgattggaaggaatatggcaaatgctggtttggcagttggcaatttaaaaacaaaaagaagtgtccatgcataatgtccatattcttcagtaatactttctactaggctaatcataggataatagaacatagcacatttgccataattttgtccacatggtagataaaatacattaaaattaaataaaaaaatttgaggttttaggaaatgctaagaaaacttgctcagagaggaaaacttaaatatatatttcattgaagatattagtggttatgtctgaatgatgttacatttgatatattgtgtatcactgccttgaattgctaaacgtgttttacaaggttatacctaaaagatatgggctctgttattccaattcagtatttttagaaaaaatcttcaacagaaataaataagaaagcaaataaacaaaagttagaatatgagttcttagtgaagaagttgagacttcattccagacttataataaactgttggctgtgatcctcaaacctatgcatagtatttttcatttttaggttccttaacagtccagtaaatcaagcttttccattctaagaccaggtagaatcagcagagacacaaaccggctaatgccattgaaatggtacttacaggcttactccacccactctattctctgttcagtatctccgatacacatgcttctttttttccactttttcttcacaatctgacatatatctgcagtgtacaaaattccaccaaatcagattttagtgtttttacctatgtttctcctctgtttactacacagcaaagagatttatccttccctccctttctttctttctttctttctttctttctttctttctttctttctttctttctttctttctttctttctttcttttctttctttcttctatctctttttctttccttcttctttctctctgttttttcctgtctttcttctttctctccttcatttcctccttctttccttccctccttccttcgttctttctttcttccacttctttctccctaccttcactctttccttacattctcctccctctaccaaaaacaacagaacaaaatccactcaaacatattttatccatcttaccttcagcctttattgtcctcctccatcttatctgatctattctcccttttcctttaggtctcaacgtagacctgccttcatctgggaagttttatatataccctcttggtcctcttccttcacccccatccctggtccaggcaggtgctcttctttactcctatagtcctgaatgtgcttgtttatatttctgcacccaccagcagatgataagtgccatggagctttggcctatggctgctttctttatggatgcacagcctgacatgcagtaggagctcaataaataacagggaaggaaagacaggagggggacaagtggagagaggggcaatgctgttttctaatagaaaagtatcttaagagctctctcaagttcattttcagataaagcacagctaccttccaggaatctgcagtagggatggtaaggagtcagcatcccagatgggaattggtcctgctcctggtatctgaaacagtgcaccaaatgccagcctttctatgggtaaaattgcctactctgtacatattgaaagtgtaagagtagatgtggccacctagtaagggtagatacacattgatatacaacataattggcccaaactgcctgagtagtcatttgtactgattttgtccccttatctctttgtttctggccatcttcaaactgtggactggggacctgggctgcttttatgcattgtacaatctattccaaacttctctgagttaaaatctttacctttgtttgtaagttggatgagacaccatgattaagatattaataattagcacctgtttgggagacaaaaatgtctgttcaaattttggatttatcatgtataaatgtgtgactttggacaagccacttctctgaactttactttcctcttctatatgatctggataccagttggcctgtgatgaggtttttgagatgatcagattcatgtaaatatattttgcaactctaagcagtatgaggtcacaaactgatatacattgatagcaggttcatggatattaagttgtccatcaagagtggcactgagtttcctttatcatctgatatagatcataaaataggagactttgcttaattctggagttatgaaatgggatttggaatgaggggtagctgtgtagagatattcatcagtgccatctctggttttgagtacctctggaaaagactcccgactttattttttgctaccttaaaaattcacccagatttttaaaataccttgagtcctgaaagtttagatttagattatatttatattatggttgagtacctttctttccttgcctagatatgtgaatactatttttgtgttgcaagtaagcttaaaaattgactgtctaaatatttagccagagttattttaaaagaatttcattatttatctcttttatgatttatattatcacattctgcgtctgtagttatgttttatcataagcagcccatctgctacaactgccaaattggaacattcacataagatgagttcagatatcataaacatgacaagagatggattacatttagtctttctccatgtttaaccaatttaatttgtttcctatgcagaagaggctctaaatttacttaatatatgttagcacttaggaacatagttagaaacaaggcgaaggtcttaacctattcgtaaataaatgagaagattcctgtcggagtgaaagagagagagagaatttatgtcaaacaatcaggaatttaatacatagcggtcttttaggatgtccagtttgtgtacatactcttaaggcatgattacgaataacttcacttcctataaacaatgtgactggagaaattactcacagatacaacaaaaaggggaagaaaggtaagacgttttaaccaaagccaataagtgaattactttccctgaaaaggttaaaaatggcagatttattttttgctgccataatatttgtctttgttgggccagctatctgaggtattctccagaagatgcagggctcattgatacatcaccacatgaccctaggttcaaagctacagcagagccccaaaggatttttttcccctggagtttggggactcaaggagccttaactgaaggtgaagtctgttggctgaatgaaagtattgatactgctgtagggaaagcgttcagtgattatactggatttccctctgcccctagtaaaggtcaagtagaagactttttagtgcaagcaaaagagtcattcatttttcactctttaggtaaaggacttatgtcatattattagtgaaaatgtgattaactgttaaagcaacataggtcttaatgatctataaggcaatttctctcaaagttatggattcattgctctgaagtactaaatatatgttgttctaggatcatgcgagtcatgaatactaaaagtaaaaatgaacatatttctttgatgatgatttattaccaaacaatttggggctaatacattcacattataggatgcaaatataaatgtgacataactgagtgggcctttaagatgaagtgtcattacttttggaaatatgggcagagctgcaacttcatcacagcctttgtaacataatgttttgagagactgtgactgatgtttcaacttgcagcagcttggtttctaaattctgtacttagcaagagaatggtttcattcagcttcattgatgacctaaaaacccatatgtggggatattatatgctattgtgaattagtatgcagagttggtaaaatgagattgggtggctcttttcatgtaagacactgagttcacaatgagcacaatggcagagtcatggcagcagcagacctagcaaaaaatatgatcacaacccgatgtccataaaggtaggcaccaatagctcctctgtaggctatacggaaatactcccggagtactgtgtcttggtcatacatcatagttatttttccatattaagacaaagacctgtaattacccctcggattactcagataaataaaaagctacacaaaaggtcaaattgaccttgttttcttccttaattctctatttttttcttctggtcctctccatcttctcattcgaagaccacaatttgctatttatctctctgtttctctcaatatttcttctgtttatttcctcttctcctttacctttttcttcttttattttaatctcctgtattcccccatttcatcctgtttcttgctttttgaatcagggtaggagatatgctgacattaagtatattaatagttagagtcttggcattgtcaagaacttgctcaaaggaaaaaaggttgtcaggtattgagagagaattgcattccttaaaatagtgattatgtgattttcaattttttttattcggatcactcattttattacgggaatctaagtagatcccttcatttctcagcaattttttaattggtacaataaataagatagctataatggtatttgtgcaaagctttaaaaaataagttggtaactagaaaagaggacagagggaagcaaatgatagagcaaagtacaaattatatgagcactgcagattgctatacaagttagacagccccagtgtgcgtctaatttatgtagctgataacccaagttaacagagaccctggcactattatggaggtaatattttctcaaggatgtacagtcttaaacaacttcttcctgtattaggttcatacatgcttttctttaacataaagcaggtatgtctggtctcttgttccatttcattttcttggaaaaataaatttattgtaggccagctgaatggaaattctgcttactgtttacgacagaacttgctctccccctctcctgtattacccagggaattagtttaatatagagtcttattccacacccatttctttatttttcccctctccatcctactttttagggttctgttcagaaactatattgccacagagcagctggtagcatttagcaaccacctgcacaagtagttctgtttccaatggaagaaaatttagcttacataaggcaaaaaattgtaacgtgttggcttttccatttttatttgtatttgtgtatattttcttactcattgatgaatgttctgctaagtgaaacttaactccttggtaaagaatgagaaacagtatggtgtagcagtcatttgtttcaatagcgtttggttaaattgaaactctgtcagtaaggtgagaggttgatcatagccaggaagagactcttaaaatctgcaacttctttgaagggtgagaaaggcaccctcttgaatttgaaacttctaccatgattttccaggtagtagtccccattgaagactatgaaaagcatcataatgtgtgctggattccaaagaacagcactgtacagtcagacttctaagacctaacagtaaataaattacttttctattgcttcggaacaagtttaaacctccaagtttttgttaaattgttcacctaactacctactgaatattgatcatcactgcactaccagtgactaatatatcaagtagcttgatgtccttaaatcaaggtagctattctgtaaatgaaaccctatttacaaataatatctgctgactaacctacgtaaagacgactgcagctcataagtcacctttgcttgcctctctcatttaatccccaatcatcactttattttctaggtggaggagctgagtcagagcaagactaagtgacttagtcaaggttcgttagttagcaagtgtaaactcagacagatttttaacatagtcatttgaggagaaaagttcagcaattctatttttttattgaggggtaaaagttactgggagtcacagaatatagttatgcagttattacattcagaaatctgaaccatgcaaataaatgctagatttctttttgaatccaattttaaaatggaaaagatcctagaataaatttaatatgatattttggctttatagattaacaaattacatgtatgaccaaagtcacccaatagttaatggcaatgctgaaatgggaaccaaattagttttcctccctccctccctccctnnnnnnnnnnnnnnnnnnnnctccctccctccctccctccctcccttccttccttccttccttccttccttccttccttccctccctccttccttcctttcttccttcctttccatctttccctacctttactcatgaccagctttcttcttttctcccttatttctcaaatgttttagcccatatactgagctggtcactactcatctaagctaggtattggaaataagctataactacatcagatgctttctctgcccttaggagatcaagtgagggacacagtccagtgaactgatacagtgctgtcatggcagaagcataagatactaggtatgggcaatggttgggtgagatacacaaccaagtccagagggagtcagagatagtttccttgagggaatattgtctaagccaacacctgaaagatgattattcctttattccaataaaaggaagttgtataatagcagaaaatgatgtatagtcatcagcccaaagacaaaagaaagcatggcagagcccatgaactgacataaattcagtatgagtgtgggagggcagagagaagaatgagagaaaagactcggttgaattacccttaaaggtaaattgaattcagcctggcattagatgcttgttagacatcattaggaggtgtgcaagaaaatactcttaaattatgatagaatgatctagggtagtgaatgatagaatagtaaatcccctaagagtacagattatgaacttttcttggagtttagaggcgaaagaggttattgtgaaccgtagaaaagaagccttcaaggaagacttttaaagataagtaccatatctgcaggacactaccttattgcatttcctttcttcatgagcaaatagtctttgctgtttgtctctatctcctcaatttccattcactttttatcttattgcaaacttcattttgcccacaacacctgaaaaggtatgtaacattccccagctgccaaacagagtgtcagtttttcagcccttcatcctccataactttcgtgggacaattcttgcctcttggactctatgtcctctctggcttctagaccacggttcattcacttctattctgctcagtctccttttctgggctatccttattctcccctccacagttctcaaatggtgtttcccagggtccacacttcagcaccttcatcttcctgtccttgattctcctgggtcatgtccattcaaagatactatctacttatccattatagactcctaaatcattatcgtaggctctaaacctatatttctaccctcttgcttaatatctccacctgaacgtttccgttttgccccacgtcaaataaagtgaaatatatccgccctctccttattccttttggggttaataggctcaccatctaccttatttctcaagctggaatttagatgcccaccttcccttctggcactccttttctcttctcccatgtccagtgatttgccaaatgtaatggtctgcactccagaaatatttcttgattctgcttaattcaaatcactctgcctttcccttaatttaaagccttaccacctattgctaggactgcatgtaagagtattctaaatggtctcctttccatttgagaccctcctttttaaccatcaaacctgagttaaacttttatttacttaaggcattactctggctccctgttgtccatagcagtagtttctcactgtgttctgctcagtcccaagaccccatgggacgccttaaagagtagcactggggaagggaaagccaggtggattgacctcctagctcctacctcttcctcaggaaatacaccatcactttttacttgttcaatatttctgggtttgcttaagattttgcttgaggaaaaaaaatgtattctgcactaaaacattttgaaaattagaaagccagccttgttagactgatatacatggccctccgtgatttaattccaaacgtctttagcttcatttctcccctttctctgcccctcaccctagtcatcattcagaattctcctgaaagcattgtgctccttcaccactgtgtgtctttgtttatgttcattttctccctttgaagtccatggtcacgtttattcttctttttccctaccttctctaccaggcaaattcctggtcattcaacacaaatcttactcttgtagctgtccctgagaaagtaccctgcagaaagacattcatcataaatatcttctacagtcctggccaggcgtggtggctcaagcctgtaatcccagcactttgggaggccgaggcaggtggttcacgagatcaggagattgagaccatcctggctaatgtggtgaaatcgcgtctctactaaaaatacaaaaaattagccgggtgtggtggcgggtgcctgtagtcccagctattcgggaggctgaggcaggagaatggcgtgaacccgggaggtggagcttgcagtgagccgagatcgcaccactgcactccagcctgggcaacagagggagactccgtctcactaaaaaaaaagagaaaaaagaaaaaagaaaaaaatatgtatgtgtatatatatatatatgtgtgtgtgtgtgtgtgtgtgtgtgtgtgtgtgtgtgtgtgtgtgtgtgtgtatgtatgtatcttctacagtccttaacgtatcagttgcttctacctccagattgctttctccctgccttcttggaaggcaggaagttgggagtggctcttatatttctaccccagcttatagcttagtgcctgtgaggcaggaggagctgctcagttcatatgacctctggctcctcctcctcctgctgttgctgctacaatggtgaagccaaagaacatttttcagcaaaagggtgaaatatcaatagtggcattttaggtatttaggatggttgatcttaaaagtcaagtgcaggttgggtaagaagggggaaatctaaagtcaaagagatagggatctgaaggagattcttacaatagtaaagtgtgcattagattaaaatctactacagattcattgctgaattaatgggatgagagactatgtctcacaggagaaaggtggaaggttgaaatgtgttcattgtcttcagaaatcctaccctatggcaatgagtgcatttcttcattccatggagtccagattaatccagataagctcactagccctctctatccccatcacatagctagggtaacagtagcaacagcaacaacttgcctttgttactatgtgccaaacaatgtgctatatgcttgacttgcattacctcatgagagataatgagattagcattataagtactacagtataatcttcactttagagatgagaatcatgaggttcagcaaggttaattaactcgcacaaagcctcgtacctaagaagttgtggacctagggcagaaattcatgtatgtcttagtcctgagccagacctcgactccactttctgctcaatctcaacaagctctgtttagccaagtattttttttttgtatctaatatctgaatactgataggtgttcaagtagcatctcatttattaatgcaaatcaggaaagttagagttccagagaagtgaattctcaatatatctgaagatcatctgtttgagccctgtagcttccgtaacgttgccattaaggatgaaaacttttctaaaatcattagtacagaaggccagatagccaactgggccttgtttgattcatgtcctaaatcaaagcaaattgacaccaaatgactttcttttaagaaaagtatataagctttggcacatgtgcttaatctctgtgccaccaaaattaaagggaatttctctacacttgtgagttcttggctgaatgtaattgaagttgttagatagcatccctgtaaacgtagactcacaacttgctttgctgctttaaataagttggatctctactgttttttcaaagtgtggtcagcggagctcgtgcatcaaaagctgtgatactgttttaaaatgcagattgctggacttaatcccagatttataatttagaatctttgggggtaaaacctgagagtctgcttgtttgtatgaaataacgaacaccacaaagaagagtatgctgattgtcttttgaataaagtgagaataaaagtgccaagcacagttgttaaaatatgcagacatttaataatagctgttagccttggcagctctattttatattacaccctgccaaacgcctttcaactagttactttcagaggtaattaatcgtaaacatctcagctctgtgaatatttagactcagttcaagtagctgtagcacctagcaagataattcctcttcctatccttcatcttgttatttagctttgatttgtatttttcatctccagatatagaaaaatagttttctaaggtcctcttctgagcaagaattctgtatgtgttttatcatttaattctcataataacctgcaaaaaagacattattagccccattgcacagatgagaaagctgaggcttaaatagcttaattaatgttccagggtcacagaagcagggagttggtttgaatccaagttcgcctgactccataatcctgcttttcctcaatatacagttgtttcttctcatgtgtctccttacatgatagatgcaggtataactacagtttaagtttcctatccaggacctctgggtcacactgtcactaaccctatttctatgacacatctctggtacttttggaatcctcactttactcacaaagttacacccttgggaaaagcaggtaaatggtatcatttaaagtttgaggcataattgaagtctggaattatttttagtagcaggtttttaaaaaacaaatctcactaacctagttaagagttggtgtgtggaatcaagggctgacctgttcctctggaaccattgctgattttttagtcagtgctgagaaataggactttctagaaagatgaaaatgttctatatctgcattgtccagtacagctggcattggtcacatgtggttactgacctatatggttaatggcactaaatagccaaactattaattttgattttaattaatttctgtttaaatttaaataaccacatgtggctagtagctgccgtattaggcagcataggtctggatagatctacagaaagacagttaagtcaagtagttaaggattcaaatctggagccaaactgactggctcactagcctgtgtgactttgagtaaattactgggcatctctgtttttcattcccttgaatataaagtgtgattaataatagtatgtacctcacaggttagttatgaggattacatgagtaattttataggaaaatactttgtataatacttcacacatagtaagagctcagcaaagttacagcagttattataactcttattagtttcacttcctacataatttaagtttgcttgcctttttttaagactggaaatctccttagaagtgttgataacatggtagctgctaaatatatatttattgaattaaatttttgacatctctccgatttggaacttttgatacccacagcctgatatatatatatatatatatcatctccacacacacacacatacataaagagaatactggaaaggatctcagaaaatgccttccctttttgagatatacaataagaaagtgcaagtctgtggtcaaaatgaatcagaaggaaagaaggtgaagaagctccaatacttacaaagacaaaacatgaaatcctgtcatcttttgtctcatgcaactcaaatactcaggatctttaaaaactctatttgaagtttgaaatgtatgaggaggtgatcaaggaaagggccatgttaacaggacacatgataagtagtaggaaatcatttcttatcaggtatattacaaatcaatctttgagatatttattggccagtcattatgtaagtaccttgcgcatcaaaacatacacacatggctaaagggacttgtatactacacatagtgtgtatgtatacgtgtatttgtgtgtgtctatatatatattaatattgacattaaaattagatggtaaaaccttttcatttagtgccaaccaagtctagccacgataaatcaaaaatgtgaactaccttggcaagccttagcttataaagaccttacaaatagctatacaaataattttctaaatggaaataatattgggcctgaactttaaggtattatagataggaaagagaggaaaataattgcctttttagtttgtgactatattgtaaatgccagacaacggaaaaactagtaaaattaaaaaggaattccgaaagtaaatcaacaaattggctgaaaattgtcttttttcttcatctgcattgtagattaaggttgactacattaccaatgagtcattttaatagagaacaagtcacactgcttggtttatgctgagctacaggtctaggactgatggggagtcctgggggaggggactcagcagataacatactatcaatgtgagcttatgactgcttagttgacagcttaaaaagagagaccggctgctggactgaaggaaatataatatgtccttttaacgagctgaatttgaaaaactttttgaggaaaaaagaagcaaggtattcatgaagggctttgtttatcacagttgccagtctacatctttattagcttgtaagaggtgccaagtgtagatatttgtcagtttactgtggagtaattctgtccttttaaaaacttttagtggcatgatattgagatggccctattgttacattcttgtttaattgttgactttgtgttgattttattattcgagtaggccccacctattgttttagaggtcaacgagctttttcattgcatttcatctgaactgtagcccctagtcaactgcactttcttcttaggcaaacattccgcagcagctgggttggaaactatcattccacacatcacagcaaatcttagacaacttgagtttaattattccctgttgactggctttgccattactaaaatctcttttaacacactagcattgagagtggaagtgtagggtttcttagctctcagcacaatagcttttgcattaatatctcatggcttatttcatagagcaaaggcctacttgtggtctttaaaatttgtttaaacataaattacaaagaaaggcatgggtgacacatagctatatatagagaaaagaaagcacatgagtagccttagatactttgtaaagagtgaatatttcttaaaaaataatttttttgcctttcaagtgaatgttaaagggatttttaaccacacttttgtttttcctagttttcagaaagcatttatgttttattactctgttaaataaatattgtgggcgtagtatattaaaaattgaacttttcattttacttaacaaactgtaatttcatgattaatagtgcttaatctgaatgttctgtgaaaacttcgtacagccaaaagtgttcagtgttactaaagattagccacctcacaaaagagacagttatgtaattgttttcaagaaggtttgtagtctttagagttatgagaaaaacaataaaacattggatgttggatatctagcgtaacatatcctaggatttatcacaacctagaaattaagtaatacagaggaaaagaactgaagaatttatattttaaaaattcattttgaaaaatcaaacatggcagaacctatcatgggggcactattgctttcaagattatgtggggctggtgaacattatcttgaagctggcaaacatgacctgattgcactaaatagatggccagaaacttctcttcttagctggctatacattgtcctccccaagcttcaagcttctaggttacacctgcagaaaccactggaacatggtaggatggactctgagaaactaatgtccttcttgatgatgattcctcgactctgctctatttgggagataaggcacatcactaatttcacaagcaatctgattatatctctcctctgtcaaaaccctccaggggtttcccactgtgttcatgataaagctcaaaattcgtataatcactcatgcggccctccatcatctggctcctgcaaattcttctgccatctttgtacattcttcgctcagttcctgaatttctctcagttccttaaacttgcttgcaggctttcacacatttcatatatacatgtattccttccttctttcaatatttattgaatgctgactgtgtcaggcactatgctgattgctaaaggctatgtaggagaataaaatagacatggtctgtagcctcctgaaatgtattaactactcaggaaggcagaaatgggaccaacagttacaaaacctgttctttcttctttttatcttgcgtatatctaccacattctttttctcttttttgtttttttctcctttttttttttgagaccaagtctagctcttgtcgcccaggctggagtgcagtggctgggatctcatctcaccgcaacctctgcctcccgggttcaagcaattctcctgcctcagctccccaagtagctgggattacaggctcatgccaacatgcccagctatttttttgtatttttagtagagacagtatttcaccaggttgtccaggctggtctggaactcctgacctaaggtaatctgcccgccttggcttcccaaagtgctgggattacaagcatgagcaaccgcgcctggtcctcattctttttattgttataatttttattattttttaattttactttaagttctcggatacatatgcagaaaatgcaggtttgttacataggtatatgtgtgccatgatggtttgctgcacctattgacctgtcctctaagttccttcccctcgccctccacccccaaacaggccctggtatgcattgttcccctcccctgtgtccaggtattctcgttgttcaactccccacttatgagtgagaacatgtggtgtttgattttctgttcctgtgtgttagtttgctgagaatgatggtttccagcttcatccatgtccctgcaaaggacatgatctcatttctttttaaggctgcatagtattccatggtgtatatgtaccacattttctttatccagtctatcattgatgggcatttgggttgattccatgactttgctattgtaaatagtgctgcaataaacatacgtgtgcatatgtctttatagtagaatgatttatattcctttgggtatatacccagtaagggaattgctgggtcaaatgatatttctggttctagatccttgaggaattgccatactgtcttccacactggttaaacttacttacatttccaccaacagtgtaaaagcgtttctatttctccacagcctcaccagcatctattgtttcttgacttttaaataatcgccattctgactggcatgagatggtatctcattgtgattttgatttgcatttctctaatgatcagtgatgttgagctttttttcatatgtttgttggccccataaatgtcttattttgagttgtctgttcatattctttgacaactttttaatggggttgtttgtttttttcttgtaaatttgtttaagttccttgtaaattctgggtattagacctttgttagatgggtggattgcaaaaattttccaccattctgtaggttgcctgttcactctgatgatagtttcttttgctgtgcagaagctctttagtttaattagatctcatttgtcacttttgggtttttttgaaattacttttggtgttttcatcatgaagtctttgcccatgcctgtgtcctgaatggtattgcctaggttttcttctagggtttttatggttttgggtcttacatttaagtctctaatccatcttgagttaatttttgtataaggtgtaaggaaggagtccagtttcagttttcttcatatggctagccagttttcccagcaccatttattgaataggagatcctttcctcattgcttgtttttgtcaatgcctacctcattcttatatttcatgttgcatattaaacatcctttcctgagggagacttccctgatccttcccctgtgtaagatcctcttgatatatgctaaagctagcttgtccaacctgtggcccaagatggctttaaatgaggcccaacagaaattagcaaactttcttaaaacatatgaggggttttttttttttggtgtgtatgtgtgtgtgtgtgttgtttttttttctcatcagctatcattagtgttagtgtattttatgtgtggcccaagataattcttcttccagtgtggcccagggaagccaaaagactggacattcttgtaaagaaataaaacgaaccatattagcagaaactagacctgaagaatttataaaagcctcacttgactctgtgacttctaggttcttcttcagtttttattggtcatcttccctcacttagtgatatttagctcctgtggtttaaagccatgtcgagatgtttgcatgagggtctgccatagaaggaagagaagaatacatctgaaaagcatagagggaattattattgagtacctacccatcttaaatattttactcctattaaagtatttagtctttatacaaacattgtgcgacgggtctggagaacatagcacaagagcacagaactctagaaatggtccacttaaatcagattctgctgctgggacctttccgtttcttcagttgtaaatgggaaataatacaggttgagtgtccattatccaaaatgctttggaccagagtgtttcagattcttttggattttggaatatttgcatatacataatgagatatcttggggatgggacccaaatctaaacacaaaatttatttgttttatatataccttatgcacataacctgaaggtaattttatagaatatttttagtaattttgtgcatgaaacaaagtttgcaggcattgaattgtcagaaagcaaaggtatcactgttttagccacctatataaggacaatctgtggtgtcatataggcactcaaaaatgtcatattttggagcatttcagactttatatttttggattaggaatgctcaacttgtagtatttatttcttaagactattgggtgacttaaatgcaataatagatgcaaagccatgaaaacatgcctgatatgttgtaagtgcgggcttttgttattctcatgttatatatgaggaaaaagacttgtgagttgggtaacttgaaaattgtagagctagaaacagaaagcaacagaggtgggattggaacacagttctgtccaatttcagactctagtatctattctctataccagatgggtaaatacccaccccgattgacaaaaaaggcaatcaataggtaccagatgagacagagtctgattttaaaagcctgagttttaagaagttgtcttcatgtctgcttttcatgaataaagttgtgcttgatctcttatgtaatgagtagcagtggtcatttgagtaatgtggtagatggtggcataaatccctaggaagcagaatattcttctgtttaattttaaaatgctgtgtgtcaggttcagaagagaagaaagaaatgacctcgtcttatgctaacaagttgctttctcctaacatactttcaggtggatgctatttttcagaatttccgatccaatatcttagagtgtgcaagaaatcatgatttagcaataaaatccctgcattaacctgatatggataaaatatgtctttaaacaattgtcaatactgaagtattttgatataactgatgtttgggcataaacttgagtctagatttttctttttataaagaggtttttactcaagatttttcttgcatcacattctttgcaattataatttttctacctgtccttgtagtccagagtaattagaaaggaaacctctgtagttttgatgtcatgcattcattcttgtccattacattagtaatgtatcagtgccagaaggaagtgcttggtggtaggatcattgccaatttgttcaaaatttagttccactttaattatctaatataagccagagacaaaggtccctaagacatttttttctggtcttggaaatactagagtttactggcaaaatgtatatacatgaatagatacatttaaaaataatacgtagacttccaattgtgaaactgtggaagcataccaaaatgcccatcactgggagtttgaaaatttgccatcatttctggagatgaaatctttaaaatgataagcatgagttagcctggcaagtcaagggtagacaggatatgctgggcaaagagacatttgccaaagtaaaggctcataagctaaaactttggttcaggtaaatattcaggtgaatatgaggacttacaatcccattagtacttataaagtccaaagtattacatagaaagtaacagagcatgaatgtgacatggtggttgaggctacatggagtgccttaaatgtcctgtgaagttccttggccttcagcccgtcagtgtaggtagtcacatacagatagtcattcaaggactttaagcagggaattaacgtgatttgatttttacacaagataaagtactctggctatatttggcagaatggatcgcacctgagcaagtctggatgcaaggagctgggtgctataaaatgggagaagacaagcaatagtgagaagcatttgatacgagaaatattttggaaatgcaatcgacaaagcttgaggattggctggatttgggatctgagagagtcatagaggctaagatagtacaagccagagaaagagagtgaacacaaaatgttttcagagttgccagactgaatttaagatgcctctgggacaacaggataaaccagtttggagttcagaggtgagcttgtggttagaagtattgtcagggaattaccagcattggggagagagggaggattaaagctttgagagttgttggaagagagcctagtgggcatgttaaagggagaataggctgaggataaaatcttggaggaaattcagcatttcctcagctagcagagaaaatgatcccaggagagcatcctgaaaaataatccagagaagtagaaaatgaaccaggagagggtgggtcataaatgccaaacaaggagatcatttcaagaaggaggaagtggttgttagtatcaaatgctgtaattttcataaatattttatatttgttcttaagctcattttttattgcatttattggtgatagaaataggtattacatgaatggggccaaaatgaaaataatacatccttttcttagagtaaactatggaaaaatcacattttgtgtaaatataataattataataacaatcctttaactggtagttatatagtatgtagggtttataaagtgtcctcatttccagtgtcatttgattttcacgagaatccaataagacaagcattgggaccttatttttctccttttttcaattgtagaagctgatgcacattgaagccaagcaacttgtcagggcttgctgccggttagctgtagagcttgcacagcacagtattatgtccttagccccctgacccactgagggttcatgataccatgttagaaatccaaacatgactaattgtcctttagcctaaggacacaaaatcttcacatccattcctcaggtttattctttcctcttagtcattatcattcaaaatcttcagtttcataaagttgcaatagtcaaaatatcaattactattttatctaatctcttgtgttccatttttcctatgtatgggtaaaattacagctgtgatttgtttcttctgagattaagtttattgggggataatttttatatggataggcctttaattttatatatgtatacacacacacacacacacacacacacacacacacatacaagggtacctgcggaagtaaatgaagtgaaaacctgtgatacagtggaaagtaagaaaagacattgacatttgtcagtattttgtataacattgggagataatatcctgaataaaataaataataaactgtaaaaaaacaagaaaaagttaaatccatgtttattggagatagcatgattatattacttgatacaaacatctaccatccagttcttacacatgaattacatttttctttcagatcgaatcatgggaagattttttttttttggtattttttcatatatcactcttagtaaaaatttatagtatccagaacaaagggagaatttctattctttttattcctcagttctttctacatcagtattgcctgtttcatacagatttcacaggagtttctctgtcttatggtctactttggatagaacccattgaatgttggtttaatttcctattgctcattctggaatgacctggcattcctttagtatctatgtttcctctcttgggagctttctattttgttagagtcagttctctgtcttcccttgagaaaagtaaggccaaaagttttcccctgccctgccccttcatctgtattttaatagtttgctcttctaggccagttttcctgtttctctttgtggtctttcccattttacaatagttgaggaatagcttcttatccttgttattatatattttcatcattgccttcctttggaagtaatataaaataagtgcttgacaaatgattatcaaatgatttattccaataattatttatttcatttataattattttcattttttggataaatttctaaataccattttaaggtcattttttactactctttttaaaggattacaatagctatggtataaatgttaaagagctttataactctgtcataaaacaatatttctaatttattttctcaaatatgtattggatacctactatgtacaaatcactggataagacatgaagagagacataacgccaagggtcctgtctttaacaagaataaaggttaatagagagtccagagtggatgaaaatctggcagcctaccttgagttactggttcttattaataggtttattcatgagaaccaaagcaattcaattcattctcatatattcagtaaatgttcctaactaatagaaaaggacaatagcatcttacaacatatttttcttctaaaccttcattattgtttctttgccacaaaaggtattttctgatagaaaattagtatgtataacattaaattatgcatgtgtatacttagagaagagaaatattcttaaaataatgctaataatttataagcatacagtgacataaaaaagaaattccaggagtacctttgaaatcttcctattaatttagcaacattgaaagcagaatatccattttggggttttatcatatctatatggaaggctgttctgtaatgtataaatgaaacactgcccagtggatttagaatttagaattcaaaattgagaatcaaattgtctatggtgtgaaaaaggacattatgggtagaacctcaaaaccatcaataagttcacttttaaatgggttaatagaattccttttcggctgttgagttcaacagtgtcaaggggaaaagctccccagctgatatttttatttgagggaacacctagttctcccaatcctatgtaaattactgtggggattccctgtgaagctttgtggaatgttgcccagaattagagaaactggctcataatgtagactagagaaaaaaaccatagttctagccactttgtgttgaatggaaaaaaaatattggccaagtacacatattcagcatccacgaaagtgtatatacatttgagctgtgacttcatctgacttgctacaattaagtacattgggaaacaatgtaattcgagggttgcttctgagagaatgcagacgcttagctttgatttttttttttttttttttttttttgacagagtcttgctctgtcgctgggctggagtgcagtggtgcgatcttggctcactgcaacctccgcctcccgggttcaggggattctcctgcctcagcctcccaagtagctgggactacatgcgccaccacacccagctaatatttgtatttttagtagagatggggtttcaccatgttggccaggatggtctcgatctcttgacctcgtgatccacccgccttggcctcccaaagtgctgggattacaggtgtgagccaccacgcctggactagctttgacttttaaggtctgatttagaacagacagttttaatgattaaaataaacatctaaatccacagaggtaaaaatagagtggtttgatcaaaagagagtttgtaggcatgtatatgaaatagcttttgtgatagtctggggatttcatttccagtaggaactacataaatgcctaaatataattttcctaaaatattacttaattaggccagtagtaagatatcatctaggcctttgtattttggctggctggtatttgcttctttcccatgggaaaaaaaaaaaaaagtagaactgtagaactgctctcatatagaattgaatagaacagagtatcttgctgaccctctctgtttattaaaataaacttctgataagatggttaaccaggaagttgaagtagttcagggaaactaaaggttacttcttgctctcactatctggtgcacattatttcacattttggaattatattctgaaggttttttttaagtacaagaggtactgagttttggatgacacttaggtttcttttccatgggtactgaataagtgagaaaaaatgtcaatatttttatttgtattaacactcctgagatcagagcaaacatttagtaatatgagagaaagtatgccacctggattctggaatgtctgcaaagaacatagcagaacatgtttgaaagtaaaatcaccatcatttacattcataaataattgtcatatcatattgattatttcagtttgaagtaatgaggttaatttaacttattttgataactgcgaagactgattttcttatcatagtttcaagtctttcttctacttagtattactgacccagggaaaggtttgacctgtgacccagaatatgatattaagtattgtgtttctgctaaaaatcatgtgtaattattttccctacactaaatgataacgtagaaaacaaattctttttgaaagccattttcctcaggtaatgcacactgttaaatttaatttagtatgtgtttatggagtgaactagtgctagatgaagaggaaacattacctataactttttaaaaagtggaaaccaaaacctgagcaaatataattttatttttgcctgcatatttttctattaataatatgtctaaattttatctatattatatgaagatattttatctataacaatctattctatttttatctaaattttctctatcattttatagataattttatctataataacctattctaaattataaatgttttgattttattttctttgagtttttctttatgttaaataatgtacttttgtatacaaatttgcatttttcccctagtattccaacttttttttgagatttgccaattgtctggttccaaccagaagagttccctcaatgaaaactaacatactatttatttatagccccctctgactataaggttcaaggaccaagaatctaacaaagtgaactaatgatctctccaagacagtttttcttttttaaaaaaagattacatgtagagtcatatagaacttttaattctgtataagaagtgtatttataactttttgatttgcccataactaatcattatgcaattgatattaacaaatctgacctaacaggattttaatgtaaaaactggcaaaatttattgatttcaaagctacaattctttaaactcatctctctcagccaaatgaagataacataataccataatttaataaagaaccaagtagtttaatttgaagaaatggaaccaaaaaaaaaaaaaaaaaagcaggccaagtgtggtgactcatgcctgtaatcccagaactttgggagactgaagcaaggggatcacttgagtccagcctgagcaactaagcgagaccctgtctctaaaaacaaataaacaaacaaaaaacacaacaaaaaacagattatactgtaaggtaaaaaactattggcattatctccacaatctaaagcatttctaaataaaactgattatgaaaagtctaaaactagttttaaaatttcttctaaaaaatgatcaaattttttaacaatagaattgcaattgttttcacgtctttttaaacccaggccatgtttacatgtgacaagctgctattccctctcattgctcatggatgtagaagaatgttttaaagatatattcttttaccgaatcagagtcagtcactgggtggatactaacactgttaattgaaataggcaacccgaaaggacaagtactcaaaagtcattcagagtatagatgtagatttgtgtagattctagtatgttttattaaaagcaattttgaagctgtgtgtgtgtgtttgtgtgtgtgtgtgagtgtctgtgtatgtgtatatgtcaaacatacacaatcaatttttctatattagggttacatgtctattcatagaagtatagatcacatatctgtaaagtatactttcaattatccaagaagacattgactttttatggaggaggagttagaagatggtggttatggtgaaaagcaattatagaggatttgcaaaagtaatttaaactactgttaatcatctgaatcatctacatattgggagttgtttattgtgtagaaccgcatggtagataataaataccatggtgtcttttcttccatcatgcgggaccttgagttccttgaccaatcacacacatcttggagtaatgctctatttctccactccctgcccatccttagcccatagcaatggctgaccacatagaaaaggctggaaagcccaatggcttgcagtccaactggaggagttatgtgaggaggagaaggcacagggggtgaatatgcagctgggaatttccatctaatggaacttctaaatgagaaacaaatagatgcagaaaaaagtgaaagccactatgaaacaaacaataaataacaacctaggcaacatggtgagaccccgtctctacaaaaatttttttaaaaattagccagacacggtagcatgcacctgtggtttcggctacttgggaggctgaggtgagaggattgcttgagcctggaaagttaaggcatcagtatgccatgattgtaccactggactccagcctgtctctggcaaatttactgatctcacagctacaattctttaaactcatctctctcagccaaatgaagataacataatacaataatttataaagaaccaagtagtttaatttgaagaaacgtaataaaaaaagggccaagtgcagtggcttacggctgtaatcccaatcctgtctcaatcaatcaataattataaaaatagacaataacatttttgttatttttttgccaagcagtttacacaattatgtacatttatgaacacagtttatttttgtagtttgcatatttagtgcatgcaaatgtttgaactcttagtttactcttttggatataaaacagtatacctattgttaaatgtaagatgcaatttaactcgtacatttgcagtaaataacaatattctgtctctgtttttacatggattatttttggttttatattgatttgacatattgcatgattgctattcactccctcttcattaccttgcttatagtcacataaataagtacatagatgtattatcatgcacatttttacctgggaaggatttgaaaataatttaaaaatattaatttgttttgaaaaactcttgtgcatttgttcggagtgacgttaaaagagtgataaaaatttagacaattcagataatgagccctggaatgctcagtaattagcacctttgagaaggctagagtcctgaaaataagcaacgcactccccgcttccctaccatgctgttattattattgttccagtgtacattaacctgttgttttctacagccaccacacaataaatagaaagccattggcattttttgaagaaaagttttatgtttcattcaagaataaattctgtcagcaaccgctgctgcaagcgttacctatgaaaaacctgtgatactaatgggaagctattaagatgaacaagtgaaagaacaggaattaaaaagagaatttctccctacagttagggaggtgggatccttcagtgaagagtggaattcatgatagacatagtatgacccagctgtttgggaacattaaaaatcccttcacttaagctgttgaaagctgaaaaaaagaccaaatgttttccatctcaaaacacattttacttagctatgttttgaaagctgctatctaaacattttttaaaaaaataacccagcatattttaacatgattctttccttgggtgcaaatcagcagttataatttaatttaggaaagagagtgaaaaatgtagaaggaagagccacattttattcctctaccttcttgtttatctttccttaaagtacttaaaggacataaaacaaggaaataaaaaagtcactagcatacagttttgttagcttatcttgtgaacatttaacattatgcctcaaatttcgtatggtacataaagtgttttgccttgcaagatcgtgtatacagcacttcaaaaaagccagggggacagctcactaaatgtaatagatgtgtaacagcagatctttagatctcttgtatttagcatgacaatgttgggttctgtaggtgctttaaacatgatctctaaaaccacatacttttttcctagtgatgaaaaacatagactaattacacacttctggtatgctatagatggcttgaccatccggtacaattgcaatgtttggttatattgcatctccttttgtcactgaaatcaatcaattttacaacttcattttcttagtgcattttcatgttaattttcactagaatgaatgctcaacttaagcttagttacggtttggaaatgtttgtcaaatggtgcagtaaacagtttacttctattaatagttttaagaggtgaaatcttagatctttccgatgacatgtatctatatgtgtcttcaccaaaatatttaagaactttcactaagcgttttcaaaagatgtactgaaacagaggaaccaattcccaccttaagactcactttcataaaccaatttatttcctgtgaaaacctatgttgactactatgtagacaaaacttttgtcagggaactttactaggaatgtagctcagacaaggaatatgacatgaggtcagtgtcatccacccaggatgcagaccacaagtgctttttgatgataaaagtacaaggaagtttaaaatagtgtaaataatcagataaggaaacaaatagcaaggacagatatgctagatttaggaggaaaccaccactaacaaccccaaatgaccttccctgagctatgagacataattatggtttaatgacataatgttaaaatcaaatataattgtttttattagcatacattttatgacatagattcatagctggggacaaaaaaaattattttgccttcttttatttttacctttgtgtttttagggaaatctaagtgaaaaatgtaagatgaagatagatgatttttttgtagggtcacttttgagaaccttagtagatcaaaattttacttccaagaagtgcctctctccctgtattaagtactgaattccttttcgcgtgtatcttttcctaaaagactgttgtattagtcggttttcatgccgctgataaagatatacccaagactgggcaatttacaaaagaaagaggtttattagacataccattccacatagctagggaggcctcacaacagggtggaaggcaaggaggagcaagtcacatcttatgtggatggcagcaggcagagagagagcttgtgcagggaaactcctgttttaaaaactatcagatctcgtgaaactcattcactgtcatgaggatggtgcaggacagacccaccctcataattcaatcatctcccactgggtccctcccacaacatgtgagaattatgggaactacaagatgagatttaggaggggacacagagccaaaccatatcaactataatttaaatatatttaatcaatgagaagctaattgaaaaaatagcatgatgccacaaaccaaacattggttcaaatttgttcttactttgattaagattgagccttggcaaaatcatgttgcttcgctggcctccatttaattactagtacacagcatagattccctgatgtccccagagtatattttggtcttgaaaatacccccagtggtgtttcttttattaatctaatgtttattactaaactgagattaggggtcctaagagtccctgtcagtcagtggttggctcggagtgaccttaaatgccaactcccaattaccaaggacatagtatctttggcatcttaacagaccagtctttcaggtcattatgtctgaaataatgtagccttggaaaagaacatggcagaatatacaggcagattgatcagggtttgaatcccatttttaatacctaccagttgggtgactttgggctacttctatactcaatcttattgagttcagttttgtcatctgtaaaacaaggataataatcaccttatagtcagtgagttgttacatgaaatgatgtatactaagctttctacatagaataggcacttaataaagattgtattataattactattttttatcatcttgccagtgtctattacttctattacttcaatgacttgctaattggtcacccaggatccacttgccctgcccctaccccaatacacttgccacattgttgccagtggagttttcaaagatgagaatttggcaaggattatgtctgatttgtttctgaaagaaggagtacatgagtgaaattaacacgactgactaatgttagtaataaaatatttaagtacacttgctttaaaagaaaaaaaatgaatggatatcttttgcctacatatccaatcttagccaaattacttacaaagaagttaaatccaggggcctatttttaagtaactacagcacagaaaactgcactgaatagtatatatttaggcattatgcttatgatttaaaagtgttttgtgctttttattattattattatcattattgcaaatgagttgaatataatgtagatataaagtccttggttgttaaacaaaataggaagacccattatctgaaataaaatatttctagtttgcctacaaaacgttatgcctggatatgaacctttagtgtgttagtaattattagattaaaaaaagaattactcttactgctttcatattttaccagaagaattatttctaaattttcctttaatttattctgacagattcacccagcactgagtatgaaactgtctggtatattggaatccatcggaaaattaatctatctgtttggaacacacatatgaagataaacatacctaacctactacaatctatatttttaaaatatgtgaggatgattacgtgaggatgattttacacacctaatgaacaatagtatgctgggttttttgcaaagcagttaaatgaacgttgaaaatatgtttcgcctaagctcccagtaatattattttccgcttttgcctatcttttgaatgacagcaggtctcacctctttcatgaagcttcccctaccatgccatcctttatccatctcccttctgtttgaatctctgcagcacttaacattcgaatgacataatttagtacttaatgacgtacagtcttgtactatttgccgttctttcaagtagcttagtcttgtctctctaaatagattgcatgggacttaacagcagggacaatggtttaatattaattttttgtttcctctgccttctaaaccttatcctgcagcatgtttggtttggtaattttcaacctgtgagtcaaaagccaaggaatcagagagagtgctgtggggccagggaaatatcccagagctattctctgatggtctgaggacatcaggcaactgaattctccgtatccaccaaagagctgtggctggtgtgcttggtatctattgctgccccacaaattatcccaaaacttaatggttgaaaacaacagtaaacatttagtgttctcagtttctatggtttaggaattcaggggtggctcagctagctgggcagttgtggtccagggtctcatcaggtcacagggaaaatggcagcttcagtcacctaaaaatgggactgaggctggataatttgttttccaaggccactctttcacatagctggcacatcctaattgttccccgcataggcctttctacaggctgcatcatatccacagaacatgaatgacagggagagagagagagagagagactcttcttttttataatcaaatttcaaaactcacatagcatccctttctcctcattctgtttatcggaagtgtgtcactaagctcagcttatattcaacatgaggagaattagaccactttttgaagaaggggagagaaaatttaaaatttcttaatatattttaaaaccatcacagatgggtattcagtatatttatcttctctctttaccatcaacgtggtacctggaacatggagaggataaatgagtgaatggtttgtctttaatctgtgaccagtattttttttaatcaggaaaaaaaagtcttttgtcttcttttaggtctgtccatatcctctaaattctgaactgttggctcagggaatttgtaaatatccaggtcagaccccttttgatggcagtgtcaaggtaagaatgcaaaaataagactgtgcctctcttgctgtatataaggatgctgaggctcagctgccattgccagcacttatattagggttggtcttcccagtagtggcaatgattccccaggatccatgcatggttcagttcccttatgactaactatagggtgtggtatgtaaccaatggccaacacaatagatttttttcattggattttaaagctacttaaaggtggtgaccatgacttaatcatcaatgtacactaaatgtcaaatgatgtgccaggatatagaagattcctcataaatacttgtggagcaaattgaactaagttggtttacgtgttgaactcattgtcctgctttgcaacataaactcccagccagcagaaccaatttttgcacccaaaattgaacagcgtctactgaggtcctctggattcacactaatgttttatcttgtatattgtccttccttttctgtgaatgttttgtcttctttttaccacattctgaagaaatgtatatttttaaaacatttttaatttttaatttttgtgggtacatagcaggtgtatgtatttatggggtacatgagatattttgatccaggcatataatgcataataatatcatcaggttaaatgagggtatcaataacttcaagcattcagcctttttttgttttacaaacaactcagttatactcttttagttatttcaaaatgtacaatatattattttagttattttaaaatgtacaataatatattgtacaataatatattgtacattttaaaataactaatatattattgttaaatatataatatatatttaaaataactaatatattattatacaatatattattgtacatttaaaaataactaaaagttacaccctgtagtcaccctgttgtgctatcaagtactagatcttattcatttagcttacttcaaatattgaggaaaatgtagtttaaacataatttctgttcaaggtttattttaaaaaacacatatcatttctagcgtaattttgaagattcttatttttcttcattttttttttatctgtctccaaaaaaatcctttctcagaaaatgtttttccccattcggattgcaattcctggcttagtgtttagacaccattatgaatttgtattcctatcacttattttggttattcttctctggctctatatgtttccatctctgtttctcagaagcaaattgctgcctgagtgaccagaaaataaattaaagggacaaaatatttgtttctcttttgatataaagatggctatataaaaatccaccaccaacaaaaaaaaccacagagggcatttgcataggaagtaccaacgattttattgagttagaactccatttaaaaatagctcatgcttattaggtgcttagtatgtgctagacactaaattaagtgctgtgcatggattacctcatttcatcctctcaatagccctatgagatactttttatcattatactcattttacaaaggaggaaaccaagctgataagtaactttacatatgtcacaccccaagcacatagcgaagctgtgatttgaatccaggctgccccactgcagattctgtgttgttagtcactatcctaaacttcttttttaaaatttttatttggatttatgctatctctccaagtactgtacttctttatgagtctctatttaccagatattacactaagtgctttatatacttcacctcaattgtttaaccctaataacttcttagaagtcccattattgcaattttatttatttatttttttgagacggaatctcgcactgttgcccgggctggatgcagtggcgtgatcttggctcgccgcaacttctgcctcccgggttcaagcaattctcctgcctcagcctcccaagcagctgggattacaggtgcccaccaccatgcccagctaattttttgtatttttagtagagacagggtttcactatgttggtcaggctcgtctcaaactcctgacctcgtgatctgcccaccttggcgtcccagagtcctggaatgattacaggcatgaacatgcctggcctgcaattttagagatactaaaagagaggctgaagaagttgaagcaactttctcactattacataactagaagcagactccctcaagggtgtaacatcagaaggctatggtctagcaggaaactgtggatgaaactgattgctcatgaggccaagtgttttcctttttgctgagaggaagcttgtagtttactgggccctaggaagaaaacttcctacctcattatggcagtttaccatgttcagcccatcaccttccctgtgaaaggccatgggagacaggaagtttgtgaaaacagatgactggcacttcttcctaggtacgggtgattcgagagttgaattatgagagccatgaacctcggttatcacctggaccacacacaaaaaattttgggggcgagaataattagagaagtgctggtctgcaccccactacgcataaaaacacactgtctcaattacttatcttgtcattgcaatggaatatttttcataaatgaaaccaaattcagtgaatttacatcttactgagagcttaggttctacagtgagcaggtaattgaaaatcaagtataatcaaatttttcctctgctcagctctgctcttgaaccatccagtgttggaatggaccaccgtggcttcggccgagcaccagaggaagtggtatatttgcattcagaggatgcatggtgtgaaaaatacacatctttaaacccgagagtcacacttgatggaacacgatactcatagtacaaaaggcatttgaacactgattccttttgaggaaacagatgattcgtgtttccgtctcatgctctttcctgggtaaaggctcattcattctccctccctctttctctctcatccatactccctgccttccgtttccctctgtttgtaatagttgtaagtcttgaacgtgtatatgttgtgacttcactgtgttttccaagattaaaattcagcaaaatatattttatgaagacttttataatgaccttcttgaaatcttccaacactgattaccaaggagattatatacggacaatgataaacagttttatggtaatttctccagggacgacaaccaccaccacattttttaaaagttacgtagctaaaacacttagtgagtcatttaaatttaattaatcaacactttttttgagaaattttgaacctcgccagctcttgtagaatggatgtggggtggaggaatataaaattgtataaggcacaatgtaatattagacaaaagtatgagtttaaaatgttaaacctgtagtcatttcaatcaccttcctaggctcatcatttcaatgttctccacatcatgatccagctctatggtttatttataaattggcagtccagattatatgtggagagaaattatgtgtgaatcagggtgcatatttttctttcctctttaagtatttccattcatgtcccttctggcatcccccccttctagttgtagggcactgtgttagcaaacttggatttgttttccagccaagaactacatagaaaacacaaatacctttgagaatctgcttcttggaagttgaccagtacttaattctggattctatagacaggctatattaagattttatttgaagttgaagaatttactcaacaacatttacagaaagatattttcaaagctacagttgaaatcaatgtccatattttcacaatgatatagagattgtattggtactttaattgctattggaatattttgacattttaccatttgatatgtatcataagatgtgacactcactaaatggattataaactaaacatacttttctggctctgtagtgttgttactttattttttaagtgtttggctacagtcattgaaatagtgaaatgaaattttaggatttccaatgtagagaaaggataaatgtttcatgaaatcattgataatgacttaacacattcattgtttcttaacgctgtaacagacatcataaccaagtataagtaatatgcagcatccaccatcagagatttggggtggggcaattattctgaggccagaattgcctgactaagccttcttccttcctttagtatacacctttttaggtgtactttcaatagaagcaagcacgttcaatagaacacaaattaatcacagccattagtgttctttgcagagaagactgtgtggtcgctcctatgaaatgttctgtttctcaggatgagttaattcatctggaacaacattagttcatcaaggtttgtggtttatctaaagatcaaattcctgtaattttgtatgccatctgatttaatgtccagttagtttcgtggttagacagtcatgggcaggcataacacatgaatctaatatcaaaaactggaaaaaaggtgaattcttaaaggtttaattcaggcatccttagatggagattgcactgctgcttttctttctcctagggaaatgcatatctagataatgccaaatcttattaagaaaagtctaaataatataaaacattgcatgtgaatatgcccatggtaaaaatctctgctttggaaggacttttaatggaggaggataggaagaagtgggttgatcttgaaatgagattgtatatattcctttggaaggttctcaggccgtgtactcaaatacaattgtaatagtttacaggcaaaggatcgattggctagagtttactgataacctactttctttgtgatctttatagactttccaaatgctttcaatttgaataaaatgtggaagcttcattttgtctttatttatttatgactgttttgtggggacttttttttatcaagagttgagaacagtcagttgatagaaaaatatatgtatggggaatatttatgcttttctgaaacaaagtaatataaaactttatttacaaaattgttttccttaggtgttccagtggaagaggagagaggctttcacataagtttaattacctacgatgatgcctggtcgaataagccaaataggtctctttactaaaggatttcctagacttttagagttttagacttaagtgtatttagcacattggtgctcattgtgaagctccaagagggagctatctttatccattgggtgaagttagctctctgagttgacctcagagccaatttccagggaatatctgataataacttttctaataaccaattagaaaatgctggtgtgaaggatgtttcctgccatcaaacagtatacaggtagattggctgatcacagaaatatcccaaactattttaagaataatgactaattagtgaatgcttttaatattacatactgtaaaaatttcaagaaagagggcctggaaggctttgcaggagcttgatgaatggaactatcactttgcctacttgatctattgtttcatctcctgaacgctgtcagtgtcagaggtaagagaagtgaaggacctacctcagcacagttgaagggccaagagcttctattcatatttccagttgttaaccagtgctaaagatttgtgtagaggaaacaagcaggaaatgggcctagaaagacgataaatttgacatcaaattgtaaaagaggagattgcattttggattaggggctttattttctagcaaattgggatccattggagtttttgttagtgcggtttttcttctgttttttgctctttaccttttgtttttaggtaaagcaaagcattgttataactttgttattttaggaagactaatgtttggtgtaaaaatgccacaaaaactcaggcctaaaaggacaatagccttcactagaccagtgccagtgggaaaatgagcaccctgtagaaacagtttaacagaccaactgaaccaatgactatttattggggacaagggaaggagaggagtccaagatactgtccaggatttgtgcccagagaaaggagagagatggtaaagaaatggaaacatggggtaaggcaagtatggcaatattgtgctatctggagaggcagcagtggtaggaattcctttctaaatccctgaaaaagaatcatcactgcatcaactgattcctaagggggaatagtgttaagtaaccaactttgcttggatgtaaataaagtaattccccatacatttagccataattaatttattcttacaaaaagtctcaaagacagtttagtttatgatggaaagctgttattgaagatatcagtaggaacaaaacttgattccgtccttaaaaatcttacaatggtccttaggaggacaagagcattaaagacacacctgtaagtaaggaagaactggctataaaccaggagagaagcacagataatttgggttgaaggatggaaaggtcaagcctgggtggtaaaaatcagcagacataaaaaatggttggtttagaagtatagataagattttatctatgataaccaaggcaaaataaattataggctgagcaataataatgatagcaattaaaattataatagcaataccaataataatagctattttctattgactatatcctatatcctcttcatgattctaagtgatttacctacattgcctcattgaattctcaaaaaaaatggaatgaatttatactgaattgttaggcaatcggaactcactgaaaaactgtgagcaagggaataagtaacagcagatggttgagaggattaacatcaaggactttaaactggtgggagagtgaatggtggtcagaggatctggcaggagatcattgcaataattcagactagaggtaacaggcatccaaattaggcattcaaactaggtgagaatggaagtcaaggaaggacctgatccatttttttttcaacaaacatctactaaatacttgatgtcatgcattatggtagactctgggcaacaggggcaaaaaagatagacccaattcctgccctcttggtacttaaagtctgtctaccaggagacattgtagagaataaatttcctggccttggtaacaaatattgacctaaaactagtccaagatgtgtgtgtgtgtgttcctaccctcgtttttagggctctggaactcaatggtattccacctttgctgcagaatactctctcttactgactggcagagaacacagtgggtagaacagaacaaactcagctgcaagccagacagagacggacatcttcatgggtagcacagcttgagagaaaaaaaacacttttcttaaaattcttcccttccaaggtcagggtaaggattagggcaactgacactggaatggaagaaagaggaaacaaaactacttacactttgctgttccccaaagtataggccagactatcttcctcattgtgcatgtatgtaagtttactgtaacccgttacacaaacacaaatactgtgaaacttatagtattttgacctgttcccatgaactcagggcagttcacactcacgttacccaatttattttcccaacactcgtaatagtctgatattatgaaactgtcatggaaaccaactcaaaggttaagtgacttacccaaaggtacacagctaggcgtggagagaggaggaaaatcaagcttccaacaaactttccccacaagattatgagtctaaaagcactcttagatggtgtatctaaagctcgagggaagaatctgatcctggagttattgcataatgtgctaaatactatattgaaagattgaattaattaaaattaataaaataatgaaaaatgaattccttatagagttgaggttttttccaaaagcacttactacctcactaatttagtccgaagttaaaaagaatgagggatttcaccttttgagactaatgataatcgtaagcaaagttatcttttataaaataaaaagataatagtaaatttttcctagtgatataaaacaaccagttgtctgaacaaccagattgatatgttatgcattttttgtgactgtctcagtttttgtatttattttttcatcatttatttcttgaatatatcttgtaataaatacacatcaaagagttaaacatccctacttttgggaaatatttctctattgtctctattttgctaccaaagttttacagtattttattaacatttttattttatcataatattttcatttaaacttggtataaatttgttgctgtgcattaaccactcagcatcatagcttaggactgaaacacatcaaaatagtccagcaaaaaatattttaaatatggcaaccttaactggagtttaaaaaataaaactttgagtataataatttattcaccagagcggttgtttcagcaaagtacttcatcttagtttccaaagagctgctagttgttactaaatatattttaaaatagaagcaaaaaagaaatctgctctcattctggccaaatatactataaaatattaaactgttaaaatctttggcattttggagaaagatcagctaggtgattatgcttgtatagttaattaataagaaaggaagtaggtaatggttcactggggaaacttttgttatcaccatgtctatttatgaaggatcccatgctgtagggacaataacggggtgctaattctgaacgcacacagtgccgtcctacaaagacatcaagatttgtaggaaatcaaccctccagcagtcctggcaagccagactgaccccagcaaatgaaaataatcaaaagtaattagaagcgtgctggactactcctcggagagccgaataggagagtaaacatgcctgaatcctcgagccactgcaaaggcccatgtctgagctgttaggtgccctgaccttgtccacataaagatgtgatttatgaagtgcagggcacagcagcagggcttctgtcttctcctggagaaccaaattactgaggtggagattaacatgctttcagtcgggcccatttccagaccaagggaaattttttatttaaatttgttttatctttaatttcctcttttctaacagcacaccccaatagataaaaaaaataataatttaaaaaaaataaaaaaaggcagagtccaccaagagtcaccagtaatctctcttcagtgcagttgtgatatgtgtgtggggctacggacagtcacagcatttttgttggtaaatttgtattgtgctggactgtttcactggatctgtctgatcaaagcatcacagaattcacattcatgcttagagaacaaagcttgcaaaatacttattaaattaaaaaacagaaattattaaaattaaacagaatatcaccttagatttcatggctttctgatctagtttatcttgcctaaaggtcatgcttcattacaaagtttactctattaaataaaaagatttgggaaaagaaattgtgggtggtagagaatttagaggagtaggagaaagacaaattgggagaaatatttatatatgaatcagtgggaagtctcttgagtcctaaaagacatacttacattatttcttatctttgtgtcagttaggttaggtaagattttacaaaatcctattctgacatggaaaaggaagcattgattttctttttaaacacacatcaatatctatacacgaagctaatttaattagcaggcacttattgttcagccaaatgtcaatttctcagattatttcatgcttcttgacatgaactgtatgaaacaggatttaacagaatctccatgaataaaactccacttgagaaatgtaaaaatgcacatgtacgttcttgaaaagctacaaaaaaatagagttaaaacaaagatgttaggcttggagtttagtgtatatttagccacctcaagaaacccaaagctgcagaattaagggaatttagactgaggttataaagtgccttcctctataaactaaaaacataatgtcagggtgaatgggaacatactttattaactttacggtattgaaaactgccagcaagttgtcttgtttttaaatattgtcctctgcagagtgttacagtgctgtttgtccacaggaagcctattaaaagtggacagtgcagtcatttcatctggctttggctggactgcttttctttcctttaatgatgtgctggaatgtaccatgcccatagggtctccattagcagaacttttacttctgggacgaccatgaagtttaaggcttaaaagaggcatcagtttacagtcttgtgggaatcacttgaatactggagcactaacttcttactgctttaactaatatattgacttattttaaataaacagttacacaatgaaggcagagccagtggccttattggaaatctttgggctttttaaagattctgcaatccacacagctggggaaggaaggaaggggcctgaggagggtttatgcccttttcaaaccaggaagaaaacacattaacctctcccaccccagccctgccatcagccaaagggggatctttacaactcctagaaaatctatcagcccacactcaaccctcatatttttccaatgcccttttcctggtaaacaacaattaacagatcaagaaagaaaaaataatcattccttctggaaaaatgtttttaaaatctggttctctttttaaacatcactgatgaatcattccatttttttctttccccgaagctatacatttgttttagtttgttctcctactccatccccttaatatttagatcatctgtcctgatacatgtttgcaaattaaagctggtttgagattacagtaaaaccattatttttaatagcccatttcaagggcagtgctaaacactgcagaacacgcatgttactgattactgctgagcagacagcggcttttgcagattaatttgtaactgggaactactgtaaacagatttcaccagaaatcccaaggaataaagggaattggtgatggtatttggctccttgtatttatttattgttttagaaaccttctgatggaaagcaagctaacaggggaagaagcaagccccttgcaaaatccttttcctctaaccttctttcctgtttcattcacttattggggaagatggatcaggtcttctaaataattcttatttaaatagcaagaagaccctttcatgagaaacaaggccagtctaactactgtgggatttcagaaccctatctttaaactttaagttgtgtgaagaaaaagtgagatgactctgcctttacatgaagttattgttatatacctaaaggagaaagggagtgggatggggtgggggagaggggagggagagacagacagacagacagacagacagacacacacacacacacacacacacacacacacacacacacacacagagagagagaaagagagattaagatttagtgttttgttagcttcctttgcccaggtccttctgatgatttcctttagtctttttcacaatttattcagtggagaacaagactgatgatgacgataatgatgatattaatataataataatgatgatgcaatgaattctccattcttctaggtacatcttccaaggtctcggagggtaagcgttcactcttggttgtatttggggaagagaagctcagacgtaggaatagccttctctcaggctgatgtctacatgcctggactgcagtgtgccttcctctcgtagctcggaaggacgcggaacggcgggcgaggcggaaggcagagctgtgttgccggcgcctggcgggcagaggcgggttcacctgggtggctggagccgccggcgctgcgctttatttcggagcgcaatgccatctaccggcgtcctgccgtacctgcaagtatccagaccttgaaagtcgctccgcctccccccacccgaagccaatataggggaaaaaactcggaggccctttccacgaaatcctaatttagccaggacctgccaatgattccagacgaccttttgttttcctaccgacgtttcctcgttttgaaagcagttttgtaaagggcaaggaggtgggggccgcagggttggggcgctgagctcccagaccccctgatcaggccgcactgtctgaagcaatcggttccccagattacttgtatttaatacacaatgcatcataaaacaaatccctcatcctgacaggaagaaaatagaacagctcatagctcgagccggtccaatttatggctaaattaaaaaaaaaaaaaaaaaaaagaaagctccgacaatgggcaagttgagggagggcaggaaatcaatggccacgaaccaggagctcttaaaggttctcaagcgcccaactctacgggaatatctgaccgggttttaggttatttacaaaggatttttcctgtcctacctaccactgctgtgcgattttctctcaaacaatggccattatctgaaataacagttcaatgtcacagataacaggccaccgaaacaaattagtcaccacctcttgtcattttctctcccccaatccctcccttttgctactatttttgtttttaaatcaatattttgggaaaatatagttctactggatttacacgtttatttgcacttggagaaaacaaaaagtgggtggcacttgtgttatcccgtttgcagctaaagtttaaccgtcagcacactttccagcccctcttgccccacctctcccccgcaagtgtccctagactcgcttactttgcttaactttccattgttgagctggggagttggattttgtccatttgtttttatgaatggagttttgtgataaaaacgcgtttacttccatttagccagtgggatttactaaatcttacaaagttggccatgaataaatctgtagacccttttgttttgctatgtatccccttattctttcttccaatgtcttttctacaatgtattggtttaaatgtacccaaggtatattagaaagttattaaacataggatagtaccgattactaaaagcagcatttatgatgttaaacgttcaaaaataatctgagtcgtcaaattgcttattgcacgttttggcgttcaaggtgttttaattaatgtatcaaagaaaatggcaaagactcaccagacagtcatcaatctctctaaacccataatatgctgtttgggcgggttatatgccaataatttttcagattttaaaatatctttaaagaaaaatatggtttgaaaattttgcacgcccttcctctgacctagctacaagaatgaagggaataaattagagtatgagtttcaattaaaaaaattttttttaatgcttagcagaaaactggaaatgtacatgtcaacttttcactcttgaggttgctgttttctgagaatttctaaactatttatatttagtctgaactagcgtccctataccctaagctttatcctccccactccagcactacctctcccccctacccccgccccctcctgcctcggtgcacacaccctcacacccctgaaagcacttctctacccttccccatccctcccatcccccatctctctctctctcacacacacacatgcacacacacactcgcgcgcacacacacacacacacaccacacttgtgctttcaagacatcgaaacggaggctatttccctggggaaagaaatcctgcctggcgagatctccccattggttgtttacccggagaaatctacatgtttaagggggatggtgcatccataatcagtctgtccctataggacttgggtcttggcgacctttttgtgacctctcccgccagaggaggctgctgtcactttaaaaatttaaaagaggagcccgtctggcttccgatcagatcactctgggcggcgggagatagctccctttctccctcgccccgggttctttctggatggccgagcagatcctctttaaagagacagttcatgaaatagaaacccggcggctgagcttggagttgcgaaaggggacgatcccgtgagggtccaggacccgcgaaggcgctgcggaggatctgaaagggggatagagctcccctcgcctccccaggccccccaccttttcaaactctcctcctcctgcttgttttcccccattggaactgggaaggagaagtagaagttttagtgggtttcagataactttcattacacatcgggctgataagagcaagagaaagtgagaaaagagggaggtgatgtgaacca

SEQ ID NO: 13979 - DNA, 9527 bp, Human
tttcgctatgttgccacctgaacataaatgctattttctttttcttttcttttcttttttttgagacggagtccgtagcccaggctggggtgtggtggcaccattttggctcactacagcctccgcctcccaggttcaagcgattctcctgcctcagcctcccaagtagctgggactacaggcgtgcacccctgtgcccagctaatttttgtatttttagtagagacggggtttcaccatgttgaccaggctaatctcaaactcctgacctcaagtgatctgcctgccttggtctcccaaagtgctgggattacaggtgtgagccactgcgcctggcccataaatgcgattttcattcccattttccaacaaggcgactgaggtatacattgaaggtgaattactaggacaaaagaaagatggcattttacttcaataacagtttgttacaacctgtactgctacctatctgccatgggagtgcgcctttccccacactgacaccagtgctggaagttatcaacctccttcatctttgccaacctgataggtcaaaagtgatcatggaagatccacactcgctttttttttttttttttttgagataggggtctcactatttctttttcttttttcagagatggggggtctcactatttctttttctttttttcagagatgggggtctcactatgttgcctaagctggttttgaacttctgggctcaagtgattctcctgccttgacctcccaaagtgctgggattacaggtgtgagccgccttgcttagcccttactgtcgttttttttgtttgtttttgtttttgtttttttgttttgttttgttttgtttttgagacagagtctcgctctgtcgcccaggctggagtgcggtggtgcgatcttggctcactgcaacctctgcctcccgggttccagtgattctcctgcctcagcctcccaagtagctgggattacaggcacccgccaccacacctggctaatttttgtatttttaatagagatggggtttcaccatgttggccaggctggtcttgaacttctgaccttaggtgatccatccatctcagcctcccaaagtgctgggattacaggcgtgagccaccttgcctggcccttactgttggtttaatgccactctcccttagggtgaccaaccaatccagtttgcctgggaccattctggctctagcactgaaagtcctatgttccaagaaacacccacctctcctccatcctgggcaaagagggacggttggtcaacctgcagtcctgggttataagtgaggctgagcgtgtttgcccatggtcacagaaagaagggatcttggatgagggtgtgtaacaggatcagatttgttttgtttttttcttagagtcttgctgtgtcacccaggctggagtgcaatggcctgaacacagctcactgcagccccaaactcctgggctcaagtgatcctcccacctcagcctcctgggtagctgggattacaggcatgcatcaccacacccagttaactttttaaagaacactttttttttttttttaagagacagggtcttgctatgttgctcaggctggtctcaaactcctgggctcaagtgatcctcccgccttggcctcccaaagtgctgggatgacagatgtgagccattgtgcctagccaggacgagatttttagagggtagagtaggaataagagcttgcacttatgaggcacatgatggcttcagctgtctgctttgcagagtctcaagaaagctctgagaaccttaagcagaggccattttacatgtgaggacacagaggtacagagaggtgagataaatggccaaggtcacatacctaagaggagaaggaggcaggatttgaatcgcagcctgcacgtcaccccatggtgagtaactggtaagtgagtgagcatccctcctcttctcttgcaggccccctgacttgggcctcagtgtccccgaagatcatgatggcgtatatgaacccggggccccactattctgtcaacgccttggccctaagtggccccagtgtggatctgatgcaccaggctgtgccctacccaagtgagtacagtcgtttctcttggcaccccaggctggcctcatctcttggaggacctctggggtccctttgcccccaggaagaaggcaatcacaggggcgacttcagggccatacaccagccctctgggttcatctgaaatgtatgtcacttagaaaaacattagcagtcctagaaattcaggacagaggttccttttggggtgaggaagaggggatgtaatctggaaggggaatcaagaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggccgggggtgcactttttttttttaattttatttttgagacagggtctcactctgttgcccactctgaagtgcaatggtgcaatcacagctcactacagcctcgaactcctgggctcaagcgatccttttgccttggcctcccaaatagctaggattacaggtgcacgccaccatgcctggctaacttttttaagtttttgtagattttgcaggatctggattatacaaaacatagaaaaaattattattattattttttttgtagagattgggtctccctatgttgcccaggctggtctcaaactcttgggttcaaataatccgcctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctcattgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgttttttttttttttttttttcaagaccgagccttgttctgttaccaggctggagtgcagtggcataatcttggctcactgcaacctctgccttctgggttcaagcgattctcctccctcagcctcccaagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgtcgagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccaggcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtggggtggtgggtccctggacccctcccgacacttcctgtgatctcaggaggcctgcccggaacaaagagtgatgggaggagggagagatcacagagtgacagccaaagttataaaggggacaataatccctctccccaccatcccactgaccgcctcatggctctcattgcccctcgctcctctccagctgcgctggcccagacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgatggaccctcagagtagtagaaaatggttaatacatgtttattaactgactgaatagacggatggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgcgtgtatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccggatgggtgtatttatgtatatatgagtgtatgcatgtatatatgattggacagataaataaaatgtgtgtgttagtatgattgtatataggtatgactggatggattaatgtatatgtatgcatgatgtatgtgtgtatgatgtatgggtgtataattgtatatatatgtttgtataatcgggatggatgaacatgcatatgatgtatgtatgattagatagatccattaatgcatgtatgatgtatgtgtgtatgacctatgtttatataattatatgtataagatagatggatgaatctatgtatgatgtatgtgtgtacaattgtatgtatcatcagatggataagtctatgtatgatgtatgtatgatcagatggactggtgaatgtgtgtatgacatatatatgtgtgaggtatgtatgtatgatcagatggatgtctacataatgtatgtgtgtatggtgtatgtatgataattgtatgcgtgtatgtttgtatgctgtaggtatgatgttacatatatgtgcatacacacgtgtgtatgattggaaggataaatgaaatatgtatgtttgtgtgattgtatgtatgtatgattagatagattagtgcgtagctatgtgtgctgtatgtgtgtacaatgtatgtgcctataattgtatatttgtatgtctgtatgatcagatggatgaatatgtgtatgatgtatgtatgatcagatagctggataaatgtatgcatgatgcatgtgtgtatgtgtatgcatgtataattgtatgtgtgtatgtttgcattagatggataaatgcctgtaggtatcatgtatgtatgcatacatgcatgattggatgactggatgggtttatttatgtatatatgagtgtacgcatgtatgtataattagatggataaatgaaatgtgtgtctgcatgattgtatgtatggattaatgtgtatatatgtatgatgtatgtgtgtacaatgtatgtatgtataattgtatgtttgtatgatcagatggatggatgaatgtgtatgatgtatatatgtatgatcagatggctccattaatgcatgtatgatgtatgcatgtatgatgcatgtacacttgcatgtatgatcagatgagccagtgaatgtatgtatgatgtatatgtgtatgatgtatgtatgtatgatcagatagatgggtaaacgtatgcatgatgtatgtgcgtatggtgtatgtatgtataattgtatgtgtgcatgtttgtattagatgggtggatgaatatatgtatgatgtatgtatgatcatatagatgggtaaatgcaggcatgatgtatgtgcgtatggtgtatgtatgtataattgtatgtgtgcatgtttgtattggatggatgaaaatgtgtatgatgtacgtatgatcatatagatgggtaaatgtatgcatgatatatgtgcgtatggtgtatatatgtataactgtacgtgtgcatgtttgtattagatgggtggatgaatatgtgtatgatgtatgtatgatcatatcgatgggtaaatgcaggcatgatgtatgtgcgtatggtgtatgcatgtataattgtacgtgtgcatgtttgcattagacggatgggatgaatgcacatgggtatgatgtatgcatgtgttcatgcacacatgcaggtatgattggatggatagatggatggatgggtgaatagacgccccacagctggatgcaaagtagacagatgtgaacccagcacctctcaccaataagtgtcctcatccccgggcaccctgcggctctcctgggcctcttccccacttacccacccccatctccgctcttatcccccaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagtcaaaccaaacttgcagttgatttggggtcatgtttaggtcagaatcaccgtgcccttgaacaagcaggtaggggggcttgattccttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagacgcccaccaccacgcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtatatttggtagggaaatgaaaggcaccttgcctgttccatctctactccttttttcttttgttttaggattttctaaaggtgagacactggtggaactggggtagctgcatgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaagtagggcaggaagacagtggtgtgctggcagaggtctaacaatgggctctccaaggaagaggaaaaggttggttgtggagtgtttgtcagtttccgtggtgtaaa

SEQ ID NO: 13980 - DNA, 4411 bp, Human
tttcctcctgcactttatttgtaaatgtaaaagacagggtttctgggcacagctgatttcctagttcaacagaaaagaggaacatgagggagctcaagcggcaccttcacaattctaaggaaatacagggtaaaagccacctttctttctcaaacagcttcctgaagtgtttctaggtggaatgaggaaaaaaaaatagaaagttcttgccccaaaaatgtggttggcgagggagagaaaggaacagaaaggacagctacagaaagagtaaaatataaggaaaagaatagagaaccaaatttgagaaaggtgaggaatcccaccttggagctatcatcaggcgtcgtcttttgcagtcagccactccataggctgatcacttcgagtttgtacggaagcagtttctacacgctatttcacaaatgcccgaaacgactgtgattacccctctagagatggcgccatttgattccagcagccacaaagcactagaacaatcgatgctaagaggtgacaggaaaaacaggctgcaaagacccagacaatggaatgcagcggtggtcagcctaaaacactgtagaagggcaagatgagctgagtaatttttaactgggcatcatttttagaaactggagtttaagtacccccttttccattttttcctgaagtcgtgggcagggcgcaaggtctgtgaatcggccgaccggatgcagctggtgtggagagttcccaatcaggtccgatttattactatataaagtactgctgcgaggcttgccgtgttgcattttgtttagtacaagacatgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctgagtgttttacttacttacacggttcctcaaaggcccttctcagggccacccatgaagtctgtgaaagagctgtagactaaagatagttaatttcttaagaacacttaaacgtatggcagttttggcaaattagcgattccacataagcagtcgctgaagtttgaggttcggtgcccctttcagcattacttagtggttaaaagtgccggcttctctgatacacggccaaatctataacgcctctctggtttttgcaaaagtcataatgaaacagccggtctcatttatcttgtatcgattactttaccgctaccaatgcgagggctgtgtaactatgacactgtggtccgcaacgcccaaaatgttttaatatcgccctttacagaaaaagtcggccaacttctaaaacattaagtacgtttaaatttgagaaatactggcataccacaacgctcgaatttcatatccccttcaatgcctccatttacaaatttactctagtttcacttttcctttacgttctttaactttttgtcaaatcagtaatgacacctcgtaattaaaatagtgcaaggcaagtttagatttatcaagcttatatttaaacaggattttgatgcatgaaaaatcctagacttttgggggatttttttttgtttccgtttttgtttttctttagctagcaaaaccattttacgtttcttgacccaaaacagaggcggaatgtctccctttcactagcagattaaactgggagccaattccgtgtgtgagacgtggcatggcacagtctactgtccaatcagaacgcgagggcagctataaataccgggatgatcagtttttttctctcatttgtgttgagtaggtacgtctacttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctcaattgtcaccaaaaggaagctgtagcttttgagacgtgtcttagctccatgttaaatacaagctgtggacaaaacgtggtagtggcccaacacactataatgcaggagtcaggtcacaggctgttggtatgctaaatcaatttcacatacagaacctgttcctactgataaggattatcactcaaaaaagacatgtcatggggtcaattttacagatgaagtttagttttgaaaagtattcctgtttttatccttgaggaatgtgtctcctgcgtatctacctgcccctactgaagggaacaagtagcacaatgagtgtccacaggctctggtgaggccgaggcaggcggatcacaaggtcaggagatcaagaccatcctggctaacacggtgaaacccccctgtccactaaaaaaaagactgccggccgtggtggcacgcgcctgtagtcccagctactcgggaggctgaggcaggaggatcgcttgaacctggcaggcagaggttgcagtgagccgagatcgcgccactgccctccagcctgggctacagagcgagactccgcctcaaaaatacaaaaaacaacaggctctaaaaactacacacatgagagtggaacaatagacaataaggactcagaagggaggaaagaatgaatgataagttacttaattggtacaatgtaagctatttagctcttgtatagcccatgtaacttgaccaccttggagcatatgcacataacaaagttgccatcgtaccccatgcaagtaacagttttgacaaaaagctcgacacttttgttctgtttcaatgtaatgtttagcaagccatgtgttaggtagtgggcctctgaggagggatactttaacctactgcatgctgtcatctatgaaatgaacttctagctctaagtggaccttaaaaaatattttcctgtcatttcaccatatgcttgtcatagactgtggagttggattttcatgagattttttctttctttttttttttcagagagaatcagtctgggtattaaacttcaagtggtattttaaagctcttcctggtttctaaccaaacttttccattatttccagctgttttagagtttcctcatgtgctctacatatgtgactatcatgacctcattttgctcttaaactttttgaagcacacatcttgacctaggagatatctggcagagatgtgaaggcaatttttctccctagtgctctcagccagctcagcctcatatctgtgccttcctttctcatattggattcactcttgcaaagaggcatgtatcccagcaactggtgcagcggtgtccgatcttttgtcttccctgggccacgttggaagaagaattgtcttgggccacacctaaaatacaggatcactaaagatagctgacgaaagaaaacaaaggaaggaaggaaggaagggaggaaggaaggaaaaaggaagggcgcagtggctcacatctgtaatcccagcactttgcattttgggaggccgatgcgggcgaatcacgaggtcaggagttccagaccagcctggccaacatggtgaagccacgtctctactaaaaatacaaaaaattagctgggcatagtggcaggcgcctgtagtcccagctccttgggaggctgaggttgcagtgagccgagatcacgctactgcactccagtcctggtgacagagtgagactctgtctcaaaaaaaaaaaaaaaaaaaaaaaaggaaggaagggaaagaaagaaaagtctgtgcataatttttgtgatatccaccatcacagatgaacaaaaaagtcctcacattcaaagggttggatacaggtataaagtttttggaaacttaagatttgattcagaaaaacaaacaacaaaaaaacacttttgatccatggggccagaagcctcttcccacaattaactt

SEQ ID NO: 13981 - DNA, 5752 bp, Human
aaactgaaaacaaacatgttcacttctagaaagtgccggcagttttgggttgcgttacctcaatttatagccttgccttggatgctggtcatctgtagcaggtttgggtggatgtttcagattttactcggtgtctcgttgggcaaaggggtctgtgcatttgtctgtgtgattcagcaatgagggcctgtgaggaagaaccagcaggtggcacagagagggactccatggtctgcactctcagcagtggtgccagcctcaggaggagagagagccctgggagctggccaagggcagggccgggcactgcttcccaaactgactgtgccctgcagtaacagcacatctcacacctgacacacacaatgcgaatcattatttatccttactacgggtgatgcacactaattttaatttcattcgaaaggaaagtactggcctatgacccacaagtgggtggtcaggagcagttcagaaaacactggaccaggctgggcgcggtggctcacgcttgtaatcccagcactttgggaggccaaggcgggcagatcatgaggtcaggaaattgagaccagcctggctaacatggtgaaactctgtctctactaaaaatacagaaaattagctgggcatggtggccagcgcctgtagtcccaggtacttggaggctgaggcaggagaattgcttgaacccgggagatggagattgcagtgagccaagatcatgccactgtactccagcgtgggtgacagagcgagactccatccaaaaacaaaaagaaaacactggtccaggctgggggcggtggctcacacctgtaattccagcactttgggaggccgaggtgggtggatcacctgaggtcgggagttcgagaccagcatgaccaacatggagaatctccgtctctactaaaaatacaaaattagccaggcgtggtggcacatgcccgtaatcccagctactcgagaggctgaggcaggagaatcacttgaacccgggagccagaggttgcggtgagccgagatcacaccattgcactccagcctgggcaacaagagcgagactccatctcaaaaaaagaaaacactggaccatcaagagttcgagaccagcctggccaacgtggtgaaaccctgtccctacaaaaaatacaaaaattagccaggcatggtggcgggtgcctgtaatcccagctacttgggaggctgaggcaggagaatcacttgaacccaggaggcggaggttgcagtgagttgagcgcgccattgcaccccagcctgggtgggccagagcccggctgccccagggccagcagtgcctgggtgcttgttggaaatgcagctctcaactcctccctgccccagtgcatcaggacctgcctgcaaagtgatccgtctgcacttcagtttgagaaggcctggcctagaggacagtgggtctggcatgctgggctgagaggcagtactgggagcgattcttggggcctccttgctgacaattgggtgaaaccagcggatacgatcgtagcgtctctgagcccccattgcctccttgtttctctgcccatagtagaagaatgtctctgaaattactggatgagtttcagtcatactttcacatgggcacaatttcacattcaagctccttatcctaggctaattttatattatgttaaatcacttgtttttgttctcacggcttcctgcctgctataggcataattacgaggaagcagaacttctccagaagcaagcgcacatgcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgaggtgagtacagtcccgacgtggccacacgctagcccactctctgtctcttgttggctttttggcctgcatggtgtgtgtgtgtgcacgtgtgttgcacttcacagcttggacaggacacacggctcaactttgtagtgttcttggctggcccgaggtactgggatgccgcattcagaccactgatcctcagttacatgtcccaacccatgaagcctgctggaaacctgtgcagctcaaggagggccctccgtcgggtgtctgggaaaggggaagcgagtgtacccgtccactgcagggcaggcgtggagctgcgacagcccttccagagccttcagttatacatagcacaggctcccactggctcagagtaattggcatcattacattttccgttgtgagaatttgtaacttcgtgaggtgattgattgttcttttttccattttgagaaagttccaagaaagggtatataaagttgagcattaaaaatggatttttctctaaaattaccagatgagtttcaggcaggccatttatcagcagattactcccagaagctttctaaggaatttgaaaaaccagaatataacgtttgtttcagtcccatcgtctcagaaagcaacttgtgaacatccaggagtgtggccaaaggtgggagaatgagtaaattagcctgatccaactccgggcttctcagctgccagtcactgaggggaaaatggcagatttcccgacctctcctaattaaggaccttagcagagtatggagcaaaaccaggtttcttcccttgacttaaaatgaccaacttttctctaattaaagcaatttctttaaggtattctcttcactttctcatcctcatccgttaaatggaaatgaggcttatcgctatggagcatcttttcattttaatattttctttctcttttctccagggtagtcttttagatcatttttttttttaagtaaggaggagattgcatatctttgaatgcttgctgcctgagccagattgctgagttttctttcctttgccatctgcttctctttaaaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaattcttttcatggattatagcttcagatttgctttgggaggaatgaaggctacccacagaatttttttttttttgagacggagtctagctgtcacccaggctggagtgctatggcgcggtctcagctcactgcaacttccgcctcccaggttcatgtgattctcctgcctcagcctcctgcgtagctgggactacagcatgcgcttccatgcctggctaattttttttttttttttttttttagatggagtttcgcttttgttgcccaggctggagtgctatggcacggtctcagctcactgcggcttccgcctccgaggttcaagtgactctcctgcctcagcctcccaagtagctgggactacaggcacacaccaccacgcctggctaatttttgtatttttagtagagacggggtttctccatgttggtcaggctggtctcgaactcctggcttcaggtgatccacctgccttggcctcagaaagtgctgggattaccagcgtgagccactgcgcctggccatgaaggtttttcgatgctaaacttcattgggaaaaccagcaaaggctggctggaggacacgggaatattctcttctctggacaccaggggagcggactccctgagaatggctgctgaccgtccgttgttttctgccgagctgagctcatattcataattactagctgaataaagtataatgtgatggaagagacttaatagcatccacgtttccaaacacagcagctttaggagaccaggaattgggtcagtgcactggtggaagatgcctgcctgaaaggccagctaaccttccagaactttgttttttttaaagattttttctagaaagaagccatgcttattgtttttcagtttttaaattggggtcggcagggcgcggtggctcatgcctgtaatcccagcactgtgggaggttgaggcaggcagatcacttgaggccaggagttcgagaccagcctggccaacatgatgaaaccctgtctcgactaaaaatacaaaaattacccaggcgtgatggtgcacccctgtaatcccagctacttgggaggctgaggcacgagaatcacttgagcctgggaggcggaagttgtagtgagccgaggtcatgccactgtactccagcctgggtgacagaacgagactctgtctcaaaaataatagtaaaataagataaaataggggctgggcgtggtggctcacacctgtaatcccagcaccttgggaggccgagctgggtggatcacctgaggtcgggtgttcaagaccagcctgatcaacgtggtgaaaccctgtctctactaaaaacaccaaaaattagccgggcttggtggcacatacctgtaatcccagctactcaggaggctgaggcaggagaatcaccttaacccgggaggcagagattgcagtgagccaagattgtgccactgcactccagcctgggcgacagagtgagactccgtctcaaaaaataaaatacattggggtcatccacacagacttttaagattggggattttaccttttaactaagtagttatctgtaggataatgaggctctactagtgctactgccaggaaattcaagtctaagcctaccttagttcaggggacttcatacgacattaactggcatcagctgcatgttagaccagatgaatatgcttgtgattaataaatcagggtaaaatggtcatttcccaccatctggtttttggtggcctt

SEQ ID NO: 13982 - DNA, 40342 bp, Human
  misc_feature (1)...(40342): n = A,T,C or G
gccaggcatctaagtcccctctggggctttgaggagacagtcgctgtctttcctggtggtaccaccaccttccttcattcaacgccgccgcatctgacaaccctgggcacaggaatctgcaccccaggtctccacggtgaatccagcagtcaattttcagagcttgtcctgcctgccccatccacaccgcttggcacatgggtcagcccgcctttacttaccttcttcatctggcttcccggatgtcacatctcttggtttttggttggtttttccagttggcttttccaatttatacctgcagcatggatctctcctctgaactccagatacataaatctgtctatttgacattgccttggatgtctagaaggcatttcaaacttagcaggtcccacacttagctcctaattgtcagtcctgcctccagcacacgcccctctcggtgttccccatcgcagtcgaggacaactgcattcttctagtttctcaggcctcaaaccttagaatcatccgagactcctgtctctcacatatctcatctgtcaacgaatcccatcagctctaccttcaaaatatgtccagaatccaccacctccactgctaacacctggctcactatctcctagtaacctggagggcactgtcttcagtctgatcttcacacagtagccgcagtatgaagacacagggtagaccatgcctctcttcttctccaaactctccagtgggttcctcctagtcaaagtcaaacctcacttggccctctagacctcacctctgcatcctcccgctggccttatctcctccacctctgacccttgctagctctatttcagctccaccggtctcctggccattccctgaacctgaaacatggtctcctaccccagggcctgtgcactggctctcccggtgaggaaaccgctctccttcccatctccaccggcgcgttgcatccttcacctctttgctcacatatccctttctcagagaagcttttactgaggcctctgctcaccctcttctcccctccacattccgtgtcttccttttctatttcgtttctctctatggtacttatggcttatgtaacaaactaatctattgtttatatatttatttttactgtttctctgtgaaaacgtacactcgaaaagggcaggagttttgtctgtttggatcaggctccacccctggaaggtaggacagtgttcagcacagcaggtgctcaataggtgttgttccgtgaatcagcacatcaattgcagcattgtggctaccagggggtcaggatgcgggcggtggagccctctggcctttgtgtggtagccgaggactctgtgtcagcgaccgttttccgggaaacttccgggcgagactcacatcttggaaattcaaatactcaatagctctcgaattctaggaatcttgagaagaggcctggattaaggattcagacgtgggccctcagatgggtgagaaacggggactctgtgtctcctagcggggacagaagggccaggtgacaggccaggcagagtggacggggcttgggcagggggcgggggcaggcagccacacggggcaggagctgcagagctaaagccaggccatgtggactggctgcgggtttcgctgcctagctggtggcattgagcaagttacttaacctttctgaacttccgttttatgattttggaggaaacagtcatagctttctctctggcagagtccgatggcccgagtcccgctccacagtgcgggtggagggcacggaggggtgtgtgtggggggcgacagcccaggaagtctagggggcggcagggcgcgtgggggcgggggttgggagaccgcagggaggatccccgaccttgtctgaagatccaagcaggcggagccgcggtctggtccgcggggtaggcggggcgcaagagtgttcccgggggcggggggccgacccgcgtctaaaggtttccgcgattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctgtgagtcgggccttgggcggtgggccccgtcctgtctgtctgcctggggagcctgcccggcgggctgacgttgggccctctgagcctcctgccgtcagcctctgtctgtccgtctgatgtctgagcgcctctctcgctctctgtctggtagcccctctctccagaagctggctcagcctcactcaagtcctcatctcctcccttgaccttggaggggcccacctgggggtccgtctcacaggtgtacacctgattccatcttgcattcctcttctctgccctgagcagcctgcctcgtacccctctcagccggccaagtgtgggcacctggcctgcccgtcatacccgccctagcctcagacaggaaagtgctagctcaggtgccttccttccccatttcttctttgtcctccttcactctttctgcaattagggacccaagtcaggtttctaatccagttatctctgacctgaaacaagacctgttaggagcgagtgtcccccccgccccccccgcaagcaggctgggaggtctcctgtgtgtccagagcctttaggagcagcagggcttgtgtgcaaaggagctcccgtgggctgccccttgctgggacagttgccatgctgtgccagaaacaggaaacacccagggcttcaaaacccctatcgatttgcaatgatggtgtgtgcagcctctgcccaattagtggaaagctcaaaagtggtttgtagaatggttctgaatgcgctatggagtgcatctcgaacgtcactgggcacaggaatcatttggggatcttggtaagatgtgtgccctccttccatagctctgggacaggtcctgagattctgcatttctaagaagttctcctgtggtgggtgctgcccatcagatactgtttgtctactcatcacattgtgagtagcaaggggtcaagtggagtggagactcaaaggaccccttcttgtgaggttttttgtaagtcacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccatacactttagtaacattccccgcacttatgcacactataataatgacacatgaatgggctgggcgcgtaggctatagcctgtcatcccagcactttgggaggccaaaacaggtggattgcctgaggtcaggagttcaagaccaacttgatcaacatggtgaaaccccgtctctaccaaaaattagctgggtgtggtggcaggcgcctgtaatcccagctactcgggaggctgaggaaggagaattgcttgaacccaggaggcagaggttgcagtgagcagagatcgcatcattgccctccaagccctgcgcgacaagagcgtgactttgtcttaaaaaaaaaaaaaaaagacgcatgatgctcagagctgacctgaacaaatacaaccctgctacttgggtttggaatgcatttctccattcttaaaaactcttctccgccccgcatcctgcaatctagattccttttcttactggcaggctgtctggctttggtcccacagtatggactggtggaggtaattcatgtaaaggagtggtatgatcacatttatttttgaatattaagcagacatgttaaggaaggtgatgactccattactgttgcctctggcccctcttaataatacattcctaaggattcttattttagaaacatacccaggtgaaatcttaagctttaatttacagctagtataggtggctcacagctttaactgcctttgaggaccagggatatattttaaaaagagggcttgtcgactgggtgtggtggctcacacctgtaatcccagcactttgggaggctgagacgggtagatcactcaaagtccaggtgtttgagaccagcctggccaacatggtgaaaccctgtctctactaaaaacacaaaaattagccaggcatggtggcaggcgcctgtaatcccagctacttgggaggctgaggcaggagaattgcttgaacccgggaggcggaggttgcagtgagcccagatcgtgccactctactccagcctggcgaccgagtaagactctgtctcaaaaaaagaaaaaaaagggcttgtcatgtctgatattgtttaaaaaatgtgtcagtacctttcacacccctagagagactgagaaatgtaagatgtgttttgaggtgtcccactgtctaagtaaccttagacagtgggaccttggatagtgagattttgatggtggggcctggatgaagcatgttaattttggctacgtaaggtatgcgttttatttatttatttattttgagatagggtcgcactctgttgcccaggctggagtgcagtggtgtgataatggctcactgcagcctcaacctcccaggctgaattggtgctcccacctcagcctcccctgtagctgggactacaggcatgtgccaccatgccggataatttttgtgtttttgtagagatggggttttgttatgttgcccaggctggtctcaaattcctgggctcaagcgatctgcccaccttggcctcccaaaatgctgggattacaggtatgagccactgtgcctggccaatatgtgtacttttatactagatagttgtgaataccaggttttaaagaaatactatgttgcactcattgacaaaaatttaaaccattcaaaagaattcaagggaagagtgaaacccaccccctatatatcccatggggtatccactgcaaataatttactgcttatttttccggatactcttttacagtcatataagtttacacatgaacacatatttacatatgcctataatagcagacaaaatgggatcacaatacacatttctgtagtttgctttgttatttaacattattcaagaaacatccattaatatcgggacatctacatctacctccttttaactgctgtgtgctgctcccctgcacacatcatgaggtattgaagtttttctctattttggggcactttggtttttactagcctttgggtattacagtgctgtacccttggaactggtgtgcatgcctggttgttggggtagctgacaggactagatgctggacactgaggtgatcttgtgggaagttcagcgtttggccattttcagtatcacatgtcatcaggcaggtagcatgattctcaagccaggcccccaacctacattcattccaggcattgaaatccagaaagaaaaaccagcattcctgcaaagatcttgttagtgctgaagaccggacctagaagagcatgtacccagagggacggggtgattgcagatttgcaggaacctcactggagccagtttagggagctcacccaggatcattatggaaacatcaggagtttaagcacagagcctggtgtaacctaaagttgctattgtagtcactttcattgctcctgttaaaatgttcatggaatcattgagttttagactgaaagagactcaacagtcagctagtctatcacctcctcatacagaagaggaccctgagaccgaggaagatgagatgacttggcctgtggccgggatctcaggaaccccggattggaggtcttttggccacactacacatctcttcctttattttttagaaatcaattagaattcaccaaactctaaatctcatctattagttaactggtttttttttttttttttttttttgagacagggcctcactctcactcaggctggtgtgcagtggtgcaatctcagcttactgcaacctctgcctcccgggttcaagtgattctcctgcctcaatttcccgagtagctgagattacaggcgtacactaccatacctggctaatttttgtatttttagtagagatgggattttgccaagttgaccagggtcgaactggcctcaagtgatccacctgcctcggcctcccaaagtgctgggattagaagtgtgagccactgcgcccggcctaatttttgtatttttagtagagacagggtttagccatgttggccaggcgacatttttgatgtgaattcaggcttagataccaaggagtcattgctttgggcaaatgtgccctgggagacttccctctgggcttctggctccctccatccactcttgggagagaaactgtgcagatcagaacagtctgcaacttgaagtcaagctgatgaagttgtggttcaaatgtcaaattcgagtgttgtccactttgcattcctttgggagaaagtggtgctccagtggcttcaggttttttgttttgtggagttgacttccctttgtatccatttccaaatcactgactgaagaattcactgatttcattcaattaacaaaatattactgaacatccaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgccactgcactccagcctgggcgacatagggagactccgtctcaaaaaaaaaagaaagatgctttcatagaggtgccaaaaatacgattcatggtgaaggactgtggagcgccaagaatgggcacgtgcaggggaagcaaaaggcccggcggctggaccgcagttcaggctggaggtcacagggggaggagtcctgaggtgggaaagtgtttctggaaaagttgcccactcaatttgaccaaagcatggagtactcatggtagggcgttcgtggatgtgaaattgtgggtacattggggaagcatcaaatggcaagggtgaacactttacacttttgggggtatagaaaaggagagatcaaggattttgaaagttttttgagtggggcagttgcgtgactggagacaaatctggagaaggtgtggctggaagtatatcggaagagcgaaagataggatatgggaaaaccagtggcaagggggagccgtcagttgagtagccagcagagctgcagccttggaggggagaggaaggatttggaagaagtctgagcatggattagatgagaagggctgtgagggagtttctgaaatcgctggtcctagcaattgaatgcagagcccatgccaccacaaaacaaaacaacacaaaaacaaaaacaaggaggagctggtttttagtctggggaaggagggaagatgatcccaacattttggaaacgctgaacttgagatgttagagggtgatctgttgggagatgctgtccagctgcaggctgttttgcctgtctgttttggcacgcttgccctgaggcagagaaaagaggaggagatctggaccagtttagcagacaggaatgtgcagggattcagagcacgttttggagagagatggagccaagcttagattcctggccctgccattcaacatctgtgaggattgggctgttgatgtgacatcactgaacctgtttctccaattgttaagatggagacagcctcagagactcataggaggatcaattaagtttactaattgggtaccaatgttattaatatcattgttttcctgaaggctatatttctttatttttcagacagagtctagctctgtcacccaggctggagggctgtggtgtggtgtgatctcggttcactgcaacctccacctccaaggttcaggtgattttcctgcctcagccttccaggtagctgggattataggttcctgccaccacactcaactaatttttgtatttttagtagagacggggtttcactatgttggccagtctggtcttgaactcctcacttcgtcatccacccgcctcagcctcccaaagtgctgggcttacaagtgtgagccaccgtgcctggtctattttattttcatttttttgtaaacttttatttgcatgttttgttcttcatttcttagcagtagcctgtatgctatcagcagggagagagtccaggctagcatgttacatattagaacaatgttgcacccaagagtggctgcaggaaatgtcctcccatcagactcatattatgtccagaagagttacttttatatatggggtcctctcagctgtttgacagaagaaataataaagagcttcagatttcgttttagaatgacacgtcagctaatacacgtttaggcttatcttccaatttgcagtttttggcattaagcttttagaaactttaccagatttattttatgtttcttgaattctcttctccacatgaccaaggagtgaaattgcaagtttgtttgcataaaagaagcgcagacagccacgttccatcctgtttaccagtttaggccccggtgaatgcaagcagaggcaggtatttgtgacctttgaaagcagctctcactagcacctcttcaatgtatttctgaacctttggatgttcctggctgggcaaatggttgattaccatggaatcaagcagtaacaagccagtcttacctttgactttagtgataaggattaagtaataatctccctcccttttggttgagctgcgtgttccgagcccgagtctggttcttctgtgtgctgtgtgaagtgttgctgctgcaatcgtgttactcagtcacagtgacttcgggaggagatggtcctaagtcagcagatccaggcagccctggagggctctagttctgtcagcccctggctccaatccttgtgtccttcagtgttttagagatgctgtggaaggcagcctcccccaatcatcacaaatctgcatgttcagtgtcacaaagtccatggctgtgaaatggttcattctgttttagaaaccatttgtaaacttggaaaacaatgctaaaatttaattaaaatatccaaggatttcaaaatactggccacattaatctatgcttctaaggtgttctccatcatatgaattaaaatgacttagagctctttaaatttttcagtgggatttacagtaaaagtaaagaagagatattataggcagtttctccagttgagttctgctccccaaactccaggaagagctccttcgtatctctggggctggaaagggaaaggacacagagacttcaaccctgcctggtgcttttccactttacttgggctgcagggccaactaatttgaataaaattgaagtgaaatgtcaagaacatctcaaataaataatattcccagtgagattttatcaaatgtaaacttggagcacttttttcttcttttgccagttccttattggctgtcctccaagaagttgcctgcaaaactggtttagagatacctccccttcccccaatccccagatcaacccacacttacttagtggatgcctgcggggctctattgtcatgtggctgccttggtggggagtactatgaaccaggtgcaccgcgcgcattatccatgatccccacaaacatggccagaaacagccactcaggggctttgcacaacttgatgtcacatcatcagtaagaagcaaaggcagaatttgaactgaggtctttctggtgctgagttcttgcttctccgcatggttgtgttatgccaagggagctagaggtggaaacggtaatatttcttgcacacttgcctatgcaccaggcacttttctgaccactttacctgtatcaactcagttatgccccctctctgtagactatgaagcagacacactacattcccatattgcagatgaaccagaggtcacagatgctaagtgactttccccggctgctgagcatggagcagagctgggattggaaccctggtggtgtagagtgccagcctggggccttgaccattacactctagtttcctgaggaaccgggtgaaaggccattgcatttgtctaacgctaagtttgcacagcaaacacacttttaccaagaagctatgctaatctggagggtttttttcaggagttgggagtgttggatggtagaggttatgcaggcaggcattaccaataccactgggtctaatggagtttatgatcttaggaattcttggatccttttattactctctaaatttattcatccatttacattgagaacttactatgtgcaggcattgttctaggtgctaaggatacatggtgaacaaaatattcttttttccaggatcaagactgataggtctttcttcctccagaggcacattcagatgtgccatgtttatgtaagagtttcggtccccttggagtatacactcggcatttacctggtgccctgtacttttgcttcagacctcactagaaaaacctctggctgcctgtaaggttctaatttcgaatgtcccaggtagagggctgtgccatcctcaggatggcccaacaggtgaggtgagctcagaggccctccactcttggcattcttgtacaaagcaggttgggcccaggcctcttaagatcgaggttttaggtagcatttccaggggtggcagccctgtctgtgccctccctcccagtggctcttagaagagagtgggccattcctaaggccatgaagacaatgccccataaaggtcatgcttccatgcctgagggctctcccggtcctctcttggtgggggttgagagactagaccctcccccctacctccccaggagtgggggttatgtgatgtcaccaatgctggtgtctcactcttgcacacattttccaggctcctggcaccatggaagatctcctggaggctggtgccttcagcttcaggctctgatccttccttgttgctttaattatccgtcttaccacccaaatcaattaacaggcttcctagttaacaggcttccattttctaggccaaggcttgagaggtgaattagttcttccaagcagctgtggttttatttccagaagcgcccccatatcaacagctgtgcctattcaatggccatggatctgtgaagggcacgagcaggactcatgctaatcagctctgctttttctatattaaaaaaaacctttggccaggtgtggtggctcacgcctgtaatcccagcactttgggaggccaagatgggcggatcgtggggtcaggagttcgacaccagcctggtcaacatggtgagaccctgtctctactaaaaatacaaaaattagccaggtgtggtggcaggtgcctgtaatcccagctactcgggaggctgagacaggagaatcgcttgaacccgggagggggaggttgcagtaagccaagatctcgccattgcactccagcctgggtgacggagcgagactctgtctcaaaacaaacaaaaaacaacaacaaaaagcctttaattgaaattacccaatagattgcatgtaatatatacttgttttataaacttgatacaacatagaacgagattttaaagtatttaaatatagtgtgaatcatgattagtgtttcctcatcattgttctctttgctattctcaagaaaatctcagcttcaacttggatatatggaaaccaaatatccgggtctctggaacagtgcaatttaaaagcatgtcctagaattttcagccgtggtttgaaagccacctattgattcacacatgcctggaagtagctgacatttgtgcaacactgtgccctgattcggctggggctctggggttctatgcagcccgtttggcctccttgctgtgaggtgcggggcatttaaattctgttgccaacagtagcggccagtggtgctctggcctcagcaggtgccctgttctcttgtttgctgcctgctacttctcaaggaaggcctcaagccactttgctccttatgctctgacatttctcctcttaggcccaatacagaaaaggtggagaaaacctcacaatgttgcctttcccctctatgataaatttttttttttttttttgagacagagtctctgtggcccagtctagagtgcagtggtgtgacctcggctcactgcaacctttgcctcctgggttcaagcaattcttgtgcctcggccttccaagtagctgggattgtaggcatgtgccaccacacctggctaatttttgtatttttagtagaggtgggctttgaccatgttggcaggctggtctcgaactcctgtcctcaagtgatccacatgccttggcctcccaaaatgttgggatcacaggcatgagccactgtgtctggccacctctgtgataacttttattcagaaaacatttccttggcagatcaagtcactggctcaatcaaaattgcccttcctgcccctgcatgatcagcccccaactgctactgttgactccttttctggcagtggggctgaggggcagagcaggggagggaggtaggggaagggagctaggcctggaggtttacatctggctcagttcagcccatgtcttggccatttcacctgttcctctcctttaattgtaaggcacagttggcctggggagggcttttttggacagggtcgtgtgatggtttcccatatccctccagcctcatttgctgccttttcccatccctagagaatggcaaattgggagctgatctagaagggagctgggtggtgtgtgcaaggctccagtcgagtcccacggagggtagttggtgtcatcacctctggttcacagctgcctcctggaaacgccttccaaggcaggatggtcttctggatccactgggctctcctggagtcttcctagaacttcagacgggggatggcagccgctgcattcgctagggctcagggctgtctcaccaggagctgagacccacacctgctattgactctaggctgctgagcccgccctctctaggtggtgattggaatatagagtgaatgctcttgttaatctatccttcagggccattcaggaatgatgactgatcagcaggcagacatttataatttcttttctttttctttctgaggtggaatttcactcttttttgcccaggctggagtgcagtggtgtgatctcggctcactgcaacctccgcctcccgggttcaggtgactctcctatctcagcctccctactagctgggattacaggcgcccgccaccacgcccggctaatttttttttttttttttgagatggagtttcactcttgttgcccaggctggagtgcaatagcgtgatctcagcttactgcaacctctgcctcccgggttcaagcgattctcctgcctcagcctcctgagtagctgggattacaggcacatgccaccatacccagctaagtttgtatttttagtagagacagggtttctccatgttggtcaggctggtcttgaactcccagcctcaggtgatccacctgcctcagcctcccaaagtgttgggattacaggtgtgagccaccgcgactggccaatttttgtatttttagtagagatgggatttcaccatgttggccaggctggtctcgaaatcctgaacctcaggtaatccgcctgccttagcttcccaaagtgctgagattacaggtgtgagccactgtgcctggccagacatttagtatttctaagggggcttctgaaaacttatggagaaaataaactgcatgtgatcttcagctaattaagtccttgagcttgtttctgaggactttttcctctctcagaatcacggaagccttgcctgcttgccacttttcattgacctgtgtaaatgtgttactcggggaaatctcaagcccttcttagggtccccgaggtgtgacgggggaggcttgatggagcctgcgtctggtcctgactgctcatcatggctgtgcagccctgacaggactaagccagggtggtgggaccagcacggtgtggccagcttaactcactgcggctcagaggagacctggagacatgagggacacctggacattgttgctatcaacatggcagcatagttggctggcagccgggggaatttattctcttgacccactgtttctaccttaggatccttttcctgtgcttttctggaagcttttcctaacgccaggattaaccaggagaagccttccctcaagatatcttagcaaagttataaagtacgtgaacattgagttggagcagcccagagtaatctatcttcatgtgttctcttacacttcaaagacaactggaggatagctggagaagggtccttcctgctagaagaggggagggacgcttactgggggtaaagagaagaggcgttcccaagaaaggggcaggaaccagcttaacgcatctgtcaccacccagcggggtcatggaaacgcaaagcaggtggagcccatttcctgccgtggtttggtggacgcaggcagccccatccatgcaggtgctaaaggccctgtgtggcttggtggatgcaggcagccctgtccatggaggtgctgagggtcctgcgtgatttggtggatgcgggcggccctgtccttgcaggtggtgagggtcctgcgtggtttggtggacgcgggcagctccgtcattctttctttttgacggagtctcgctctgtcgcccaggctggagcgcaggggcgccatctgggctcactgcaagctccacttcccgggttcacgcctttctcctgcctcagcctcccgagtagctgggaccacaggcgcctgccaccgtccccggctaattttttgtatttttagtagagacggggtttcactgtgttagccaggatggtctcgatctcctgacctcgtgatccgctcgcctcggcctcccaaagtgctgggattacaggcgtgagccactgtgcccggccccagccctgtcagttctgtggcgagggcctgcatggcttggtggatgcgggcagccccgtcagttctgtggtgagagccccgcatggcttggtggatgcgggccgccctgtccatgcaggtgctgaggaccctgtgccatgcgtccttgcagagtgctgtgtggccccacaagcctaccatcgtgaacggtgtaccaccccttctgtggccctcagcttctctgtgttggttcctctgtgtgccaagggtaggagccatctgagactcttggaatggcagtggggagggctggctggtggtcatgatttgctaagtcacccaccctgacactgactgtaacctctcgtaggtctgggcatgatctggggcaacagaagttgcttctcactttaatctggccaactgctgagtctgcaagctcggaaaatgcagtccactgcatgaggaaatagcctactttcatttaatcccacaaaacaagtcacggtgcccctgtgtttgggacacagttacaggataacttgtctgtctctgggtggtggggctggcccaggagtactgcaaatcagagccatccttacaaggactttctccctccggtctcctctctctgaatttagatgcttcctggatccaggcatcacaggaaaaagacctcaggctttacaaaattacttgtataaatgtgcacatagtacccactcccttccatttggaaatatgtgaaaaatgtacttactgtttcctttggctaaattgctaacaaacagctcttctctggagtcattactagctgacttatttgggcttctttagggctttttcatttcctcccattctttcttttttttatttttttgagacagcgtttcgctcttgttgcccaggctggagtgcaatggtgcgatctcggctcactgcaacctccgcctcctgggttcaagggattctcctgcctcagcttcccaagtagctgggattacagacatgtgccaccacgcccagctaatttttatgtatttagtagagataggacttcaccatattggtcaggctggtctcaattttctgacctcaggggatccacccgccttggcctcccaaagtgctgggattacaggcgtgagccaccgtgcctggcccatttcctcctgttcttttttttttttttttttgagatggagtctcgctttgtcgcccaggctggagtgcagtgacgcaatctcggctcactgcaagctccgcctcccgggttcacgccattcttctgcctcagcctcctgagtagctgggactacaggtgcccgccaccatgcccggctaattttttgtgtttttagtagagagagggcttcaccatgttgatcaggctggtctcgatctcctgacctcaggtggatccacccacctcggcctcccaaagtgctgggattacaggcatgagccaccgtgcccggcctatttcctcccattcttacgaaaaacattcaaagtaccattcagcttgaatgcccccctagagatcttcctgaccatctaaattaaccatctagcctctcatctccctctcctgtcaccttgtttttgttttatgtcagcgagcatctgtcactatctgacatatctttttcattccaaaacacttatttatttcttgtttgtgctcaccccagtagaatatacgctccacaagggcgggatctgatctaccgtgttcggcactgtaaccccagcatctagaacggttccccgtgcacagcaggtccctggtgaatatttgtagaataaatgagcactcagatagctgtctaggaagattttgagtaaaagagaccacatggcctgaatgttcctgagggaagtgcctgagcagatgggacttgggccaaaaggtaatataggactttccttctgcacctgcctcagtgcctcatccgtgtccagtgccttcggcccctctgcccagccctcccggccccccgagctgtccctgtcaggctgcacctattagtgctaggccttttgtgtatgtcatctcatgcaatcctctgacagccgcgtgggggcagacttcacttccctctttggacacatgtgaaagggagggaggctcagaaagagcaggggagcctgggagctgaggcctggacctggtctctgccttgaagcccttcttctggtccatcggtgctatttgccctccggaatcagaagtgagtttgacagtgggctgggcacggtggctcatgcctgtaatcccagcactttgggaggctgaggtgggtggatcacttgaggtcaggagttcgagaccagcctggccaacatggtgaaaccctgtctgtactaaaaatacaaaaattagctggatgtggtggcatacggctatagtcccagctactcaggagggtgaggcacgagaatcgcttgaacctgggaggcggaggttgcagtgagccgagatcacgcaactgcacaccagcctggacaacagagtgacactgtctccaaaaataaaaataaaaataaaaataaaaataatcataaagtgactttgacagtgcaactctcaggctggaaaggagagagcactgctgctagtggggtcaccgagggagctgcatttgagctggtgggccctgccaagtccctctggcctcccagattttggctgccttcttcctgcacaagccccagcctcacaattggggtcagaaaaagatcatgtggaaataggatcgaaagcccagggacatggggtggagctcaaagctcgatagacatcttggtcttttactcatgaaataggagtgatgggtgaaaagagaagcagcaggaggagggctggtgggatgagatgtgctttgcaggctggaaagggaatgatgccaagagtggctgaaagacgctgacaggcgggcccgagaagacagccggagctagctcctgagatagtcaggccggaccaggcatgtgggtttggatggtttctaggaggggctcagttttgcccagccagtcacagcgagttatgttttgggcaaatgcacttgcaggagctgaagcagtcacggccactggatcagggaccgtcagttcccaggcgagcgcacatcgccatcatggccaagggcgcgggtgtgcccttaccacccactttcagaggcttgctggtgtcttcaaagacccatcttttccccttcccacatcaaggctctcgccttgctctgtgcatccttcctgtgagacgtctccctcctttctgtgttcagggcaaccccaggctatgacaacctgccgcttctgtaagtctaagaagctaggctgcgtttagacaagccactggattctgggaattctataattactgacttgcaggttgcttaaaaatagtgaaaactccaggatccctgcaacttccatgccctaggactcctgccaggggcccagggtgtcaccaagagagccctggcctgggagtcataggcagggtctcgcctccaccctctgcctgggagtcataggcagcgtctcacttctaccctctgcctgtgtggagaagtccacaggagtcttgggtctgagttttctcctctatgaaatgaggcagaggggccggttgatgctttgtttcttttagggtctttttagttataaagccataaaccccttggcttggctcgaaactcaggctacccccgacccaggcttccttgcttgctgggtctctctattgattcgtttaacccgtgtgtttgggggccaacactggttctttctgggcaaaaccaaaaacacccgcaaactttttatgtaaaaagcactgagacacatactgcaataaacagatatctactatatctgtagtattaaaaatatttcatgggggagtatggttgaggaaaaaatgttctaaaaagctccctaggggaatcataatgaaaacaaagttaagaaacactgatttaaccacaaaagtgtgcagggcaccatgacaggttcgaggtgaagaggcagatgatagtatctcctcctctctagggtctgtccagaccttcctgccttgttctcccaagctgatgtcctccttcctttcttctaaatatatatatatatatatttttttttagacggaatcttgctctgtcgcccaggctggagtgcagtggtgcgatctcggctcactgcaagctccacctcccgggttcacaccattctcctgcctcagcatcctgaatagctgggactacgggcgcccgccaccacacccggctaattttttgtatttttttttttttttttttttttgagacggagtctcgctctgtcgcccaggctggcatgcagtggcacgatctcggctcactgcaagctccgcctcctgggttcacgccattctcctgcctcagcctcccaagtagctgggactacaggcacccaccaccacacccggctacttttttgtattttttaatagagacggggtttcaccatgttagccaggatggtctcgatcccctgacctcgtgatccacccgcctcagcctcccaaagtgctgggattacaggcgtgagccaccacgcccggcccttttttaaaaaaattattattatactttaagttctgggatacacatgcagaatgcgtaggtttgttacataggtataaacatgccatggtggtttgctgcacccatcaatctgtcatctacattaggtatttctcctaatgctctccctcccctagtccccagctccctgagaggccccagtgtgtgatgttcccctccctgtgtctatgtgttctcattgttcaactcccatttatgagtgagaacatgtggtgtttggttttctgttcctgtattagtttgctgagaatgatggattccagcttcatccatgtccctgcaaaggacatgaactctttcttctaaatcttaccgaacactcacttttggtgggtttatggactcatctacatgttctggtggtcatggcttattttttgtggcttttgttccctgtagctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaagggtgggtctgtacttccaccattgagggttttaatgtagccggtcttcttcccagcttcataattgactccacttgttcagctgagctgggtttctgggagtccctctagatccctgctgtggtcttttcatagcttccacctcactgctgccatctctcgaatcctccctgagccactgtgcagatgagtgttgtggctcacgccgccttctccccagtggactcccacaaactcatctccatttctaactttttattgccatgtttaaggctcttcaaaccctggcttctgttggtcacctcttgtactacatccctatccaccaaattcctgaccttcacactgaccctcctgttgacctagactgcttgaaacttccatccctgatgcacgcattggagtccctattggtctgtctctgcttcttttttttttttttgagacagtgttttgctcttgttgcccagtctggtgtacagtggtgtgatcttggctcactgcaacctccgcctcctgggttcaagcgattctcctgcctcagcctcctgagtagctaggattacaggttcccgccaccacacctggctaatttttgtatttttagtggagatgaggtttcaccatgttggccaggctggccttgaactcctgacctcaagtgacccgcccaccttggcctcccaaagtgctgggattacaggtgtgagccaccacgcctggcgttatctctgctttttgagagcagaaaatgaatcttatttgtctctgtgtcccagtgtctagtgcaatgcctggcacattggagggcctcaacaacaaatgactgttgaaaaagattgttaaatgaaagagtattcccagcttttataaaacaacaattgtaattagaaaaaaaaacttctgagattagaagtgcagttatatgggcttactatctttcccagtttgagaggaactgggaacatgaaggagtagaattaggaaaaaacaatgagaagatgaagaggctgcctgtcctcaccctattaagagggcaggagccacatctgatgaagttgtttttcatcattcctaaaatagccgtacatgccagacttgaagttcatgtttttctcagctgggcctttcaaggtctttggcagctttaggcgtatggcttagatttgttgtttaatattctccatcactcacgccggacttctcttgtctatcatgggccttcatgataggcagcttcctgtgttccagtttccagttcctcctgcattagtgagggtggtctgtgaagagcaagagggcagggaatcatgttaatctgctacagacatttaaaaacgacattgtaaagtggctaatttggagatggaaaactcccagtgatgtgctggtaaactgggtctcaaagcaaacaaacaagtctctgatatgtccacttgcctctgtcaatggtgtgaatactctcccatcgttgattttaagctaccaatgtgatatcactgaaggcagagttgggaagagatgtgcaccgttagctcctgagagccgataccagccagctcctgcacaccactgaaaatcccactcaaaacaggaatctgcggtattcccactaccactgaaagttatctactttgggaattacgctagaaatttgttttgtttagttttgtttttagagacagggcctcattctgtcacccagactggagtgcacagtcatggctcactgcagcctcgaactcctggctcaagtgatacctcctgtctcagcctcctgagtagctgggactacagatgtgcagcatcatgcccagctaattgaattttttttttttttttttttttttttttttacagaaggagtctctctatgctgcccaggctggtctcaaactcctgggctcaagcaatcctcctgtcttagcctcccaaagtgctaggattaggcatgagccaccgtgcccagccaggatatttttgaaaactctatgcaccccaacctcaaggggcatctgtaagacctccatgagaagtttcttatagatctcaaccctagcaaagtctctgcttcacctaaggaattatttttttccttacaaataaaggaaaatgagtgactaaccttctttttcctttggctgccaggaaactcaatgcaaaattatgatttgattatatcaacaatataggaaatcatgacttatctgtattccattaccttcatctgcacctcttaagtggtattttctctgtttaatggtcttgtgtgtatgtgtgtgtatctgtgcattctgtatgccatctcatgccttccatgacagtacaaataaataagacccacattttttgaactttcttctaaattcccattcttagcccctaatgtatactcctttagtgtatcttgctataacattttaaggttgtatttcttttttctgtgctcagggtaaatatgtggtctgttttgatccccttgatggatcttccaacatcgattgccttgtgtccgttggaaccatttttggcatctatagaaaggtaaaacgtgatatcttaagcacttggtttggggacagaagttaagattgagcatccagtcctatttcactgtggcagagcagccggagtggagatcatgaaactgtgagactgaagtagatttgtatctcaagttctgagcttttcagcactaattgcatgacgaagacccactagattgttgaaagagaatatagggtaaaatatgggtgggaagagaaggatatttcactctttttactatgtcttactttttatgatagaaaatgagatttaaaaaagaggcagtagagggtaagtatagtgatgatacgatgtgaactcagagttgagagtgtaagacaacaatagagactatgtcaaaactgtcctttaagtcccctagtcaatggtctataagctatgagccccgggctgagtccagcctgtggcctaatgtgtacagcctgtgaacaaagaataaccatttttacatttttaaatagttgaaaaaaactaaagaacaaagtttcgtgatccattttaagttttactcttcacgaatgaagctttaattggcatttggtcacattcattttttcacatactgcctttggctgattctctgctgcactgtcaaagttttgtagttatgatagagactgtatggcccataaaactgaaaaatttactatctgtctgtctgtagaaacagtttactgagctttgctctaagtcgtagaaagcacacagcataggatgagaatccagccctgctcgggtctcctaacacctgactcgggcagtcacccctcctccagagctgctttttctgagagagagagagagagagaaagagagagagagagaggagagagaggagagggaggaggaggaggagagggaggagagggagagggagaggtgctcaattatacaaataagtgaaaaatagaatgaaaacccatccacccatcaggaaacatgataaaatccaaggtacatcctcttagctttagctcttgttttgttttattttttcaaagtatatattttaggccggatgcggtggctcacgcctgtaatcccagcactttgggaggccgaggtgggtggatcacaaggtcaggagattgagactgccttggctaacactgtgaaaccccgtctctactaaaaatacaaaaaaacagccaggcatggtggtgggcgcctgtagtcccgggaggctgaggcaggagaatcgcttgaacctgggaggtggaggttgcagtgagccgagatcacaccactgcactccagcctgggcaacagaacaagactccgtctcaaaaaaaaaagtatatatatatatagttttaacagctttggggggtacaaatagtttttggtgacatgaatgaattgtatagtggtgaagtactgagattttagtttatacctcacgagaatagtatatattgtatccaatatgcagtttttttatccctcatcccctcccatcacccccttctaagtctccaaagtctaccataccattctatattcagctcttgtttatttcagaactgaaacctcacaggctggaatcgactgaagaggttggttcagctgaactctgttctaggacacaaaggcattaacttaagaactgagacccttggcctagcgagatggctcacgcctgtaatcccagcactttgggaggccgaggtgggcggatcatgaggtcaggagattgagaccatcctggctaacacggtgaaaccccgtctctactaaaaattacaaaaaattaactgggcatggtggcgggcgcctgtagtcccaggtactcaggaggctgaggcaggagaatggcatgaacctgggaggtggaggttgcagtgagccaagatcgcgctactggactccagtccgggtgacagagctagactccgtctcaaaaaaaaaaaaaagaactgagacccaaatttgcactttatctctaaaagtgacttattgtctagtattatacataatttcctttcaaatatgtgaaaagtagagcccccatggcacagttatctttggtcattggaacgtattttgctttttatcttgggtaagaggcagatccacatcacaatcagtttgaggaatagaagattcaaattctcatactagaaaggcaaaaaggcaacaatttatccattttccaagtcatgccaaggaacataccatttctgttgtagacatggaagaatgcaattttccttgcaaaatatcaaatccacagaatagcaggagaggtttgtagcaaaattcttccttgcagaggaagacatctggctaatgtgttaaccacaactaaagcagtgttgatgtttactaagcccattctccatctcagtccccccaaataatactttttaaggaaaaaaaacctgggaaattgagagacattggctatcaactaaaaaaaaaaaatcaagccagcttgcaacagcagcttgaattatgaatgacagaattctcaacaataaggctcggctgtcttctcaataaaccagaagtgacttttttaaaagacagaaagtggggcctggtgcggtggctcaccccggtaatcccagcactttgggaggcccaggcgggcggatcacgaggtcaggagattgcgaccatcctggctaacacggtgaaaccccatctccaccaaaaatacaaaaaatcagccgggtgtggtggcaggcccctgtagtcccagctacctgggaggctgaggcaggagaatggtgtgaacctgggaggcggagcttgcagtgagccgagatcgcgccactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttttttctttttttgagatggagtctcctgtgtcgcccaggctggagtgcagtagcacgatctcggctcactgcaagccctgcctcccgggttcacgccattctcctgcctcagcctcccgagtagctgggactacaggcgcccgccaccacgcttggctaattttttttgtatttttagtagagacggggtttcaccgtgtgttagccaggatggtggcaatctcctgacctcgtgatccgcccgcctcggcctcccaaagtgctaggattacaggcgtgagccactgcgtccggcctttttttttttcttcttttttttctttttttttgagacaaggtctcactctgtcgcccaggctgagagcagtggcgccatcatggctcactgcagcctcaccctcccgggtttaagccatcctcctacctcagcctcctgagtggctgggactacaggtgcaccaccacacctggctaatttttgtattgtctgtagagacaagggggtctcgctatgtttcccaggctggtgttgaactcctgggctgaggcgatcctcccgcctcgacctcccaaagtgttgggattacgggcatgagccacggtgcctggccccaccagtgtctggctggagacatcctgacagggcgaattctcctgcaaagctgggtaaccatcatggtttgtccaaatattgagttgaaatctgtttcattttgctcacttggctgtttagagcataagaaaataagattctttgacatgtttggaaacagtgtttctgccctcccaataatgcccaccacacccactttttttccctttaagctgaacatctttcacaggagagggatctgagacttctctctagcctgatcaccctctactggacatactctaacttgcaatgtcctttacagctcccaccacaaaagcagagattcagaaaagtagggtttggtttctgctccgaggaaagaccactgtggacgtgacagtctctcctcccccaggccctccgtttctgtgcctacttctccttatgtgatgacatggaataatatgtgatgacatggagccagtgcctacagcaggtggtggcctcagataggcagagaaaggaagggtccagaggtttctgattttgccaagtgctccgtgctcattggtccctgggcatctgcaggagaatggaatatgtttcccttggaggaaaggcatgcattgctgagcatttggaggaaggaattagaaagggggctgatcccagctctttgggaggctgaggcaggcggatcacctgaggtccagagttcgagaccatcttggccaacatggtgaaaccccatctctactaaaaataaaaaaaaaaattagccaggcgtggtggtgggcgcctgtaatcccagctacttgggaggctgaggcaggagaatcacttgaacccaagaggtggaggttgtagtgagccaagattgtgccactgcactccagcctggcgatagagcaagactctgtctccaaaaaaaaaaaaaaaaaaaagttgggggctgggctagaaaagaattcctccaaatccatggctcagtgggataattttctcttcgttttgagtatgtgggtcatagacaagtattactattattttttattccgtgcgaggaagtgtataaatgtagagcatttggtgaccgtatgtcagggaagggctgtttacttttgcacctttgccacaggccggcacggatggttctgggcgaggtgaatctctgggaaaaggggcctttattggcagagaactggttacttgaagcctgcagtgggaggagaggagagttagagtcctgagtccacccactgtgtacctggcttcaagggaagctggtgattgttaaaatgagcctctgacaggcagcgcatgttgacaaaggccattaatttcatttttcaaggttgtgcattggcaaaacttggaattattccctcaaagttttgatcctgtaagtttagtctgtgtttagctccactgtactgtctggtgaatacaaaccaaactgaatcaaataacccagtgcaaccagctaactaaccacctccccaggtgaaaactaggaggggcagggaagcggtggaaagaaatgggtttgtggttttctggtttgtggttttctcatttatatgagtagttgttatgcttgaatgtgaagttcttacacttgagtgtgaaggtcaccccttcacattgcatagtgcaatgcagattctcaggccccgccatggaaagtctgacagtgtgtctaggctgtagccccagaatatgcatttcttttctttttcttaaagaggcaggttctcattctgtcacccaggcatgtgcagtggaatgataatggctcactgcagcctcgacctcccaggttcaagtgatccttcagcctcagcctccttagtagccacaggcacatgccaccatgcctggctaattaaaaaaaaattttttttcgtagagatggggtctcccagtgttgcacaaactggtctcaaactccttgcctcaaatgatcctcctaccttagcctcccaaagtgctgggattatagggatgagtcatgaccccggctgtgaatgtgcatttttaataaatatcccaggtgattctaatgcaggtgctctgtgggccacccttttgaaagttatgggaagaaattacctggaatgttttgctgggatgacttccttctccagctgcgtgatacagatgcccctgcttacgctcagctgcaggaatctaggaaaagaataagtgaagttcgagaaattgcatatttttatttctgcttaattcaagcagagagtagttaagctgaaagatttgtttggggctgtcttgatgaccaaagaggtcaatccagtgttaataaagaagatcaggctgggcgcagtggctcacgcctgtaatcccagcactttgggaggccgaggcaggtggatcacgaggtcaggaaatagagaccatcctggctaacacggtgaaaccccctctctactaaaaatacaaaaaattaactgggtgtggtggcaggcgcctgtactcccagctacttgggaggctgaggcaggagaatggtgtgaacccgcgaggcggagcttgcagtgagccgagatagcaccactgcactccagcctgggcgacagagcgagactccgtgtcaaaaaaaaaaaaaaagaagaaaatcattaatagtaagaaatcagtggttaggagctgtctccttaaggggctcccttccctagtgttagaaaaactctggaccacatgacccagtgggctgtgtttttaatgaaaaaatggattacggcacatgccacgttctaagtgtaggtattattttggtaactttttggtgtgtgtgtgggggcactggtttgtgatgtaaaatgtgcttcttcccatgcatcacggttaaaacactggacagcatctgctctaccccataatgactctggggagatattctgagttcctacgtttctgagaatttccctgacgtgtgagtgatatagaccacatgctcagcagagtatgggctgcagcggcaagagctcacaaaactgatttcctccgcagactggctgccctgcagcccagtgttaatttatttaaataaagatggagtaggcaggtgacagagatggatgcccgtaataagattaaattagtgggaactggcaagaaggcatgctcttttttggaactgatagtggagagatgagggaatatcacattagaaaaattggaggagggccctaattggaaagaggaatccagatgcaggaaatctgggttctggtgggaaggctgccgtgataatctaatcaggatattgctgatgtgtaggggaaggcccctctgggaagatgccctatttcattagaagagcaccttgagaatgcctcctgttaatggttgaactgtaaaaaagaatcacaaaacaaaacaaaaacattctttgatttctttcttgctctagaaatcaactgatgagccttctgagaaggatgctctgcaaccaggccggaacctggtggcagccggctacgcactgtatggcagtgccaccatgctggtccttgccatggactgtggggtcaactgcttcatgctggacccggtgagagacctcacaggaggctgggggcttggctggtgtctgtgagcaaatgaatgatatgtgtgggggattggcaggggtatgtggaggtgggaggtgatgcccatggagggacagagatgatgatgtgtggtggaaagggggcaggagaccaagagagagtgtatgcctcccgagcagactatggaggtgagaaatgccatctcagactggcacaagagggggtctttgttccaatgtgaattcctcagagcagctgttactcaaatgacccaaatgccaggtccaggcaggccatagggatgatgaagtgtgctggggaaggaaggccggggggcaagggtggaactggggtgaactgaagagttccagcaattacaattgggaggagggggcccgccttgccaaggcttctattaatgcttcaagaaacactggattgtaaaaaacataatgtttctgcatgtgtgcaacactatgctggccaactaaaatgcatttatggacctgatggggctgtagatattctgtttgccataaactgtatccatccatttctagcttttctactttagtcaccaaaaggctgttttcctgagacgaatgggtgtgccaactgaagcagtggacgacattgcttcttcaaaaatagctcccacatttattcgtgtacatttacacaaaccttcagttaactggtgcagtctttctttctttcttttttttttttctgagatgtagtcttgccctgtctcccaggctggagtgcagtggcgtgatctcggctcactgcaagttctgcctcctgggttcgagcgattctcctgcctcagctcctgagtagctgggactacaggcgcctgccaccacacttgtatttttagtagagacggggtttcgccatgttggtcaggctggtcgcgaactcctaacctcaggtgatctgcccgcctcagcctcccaaagtgctgggattacaggcatgagccaccatgcctggccaacttttttaacttttagagatgtcctcctatgacattagtgaactatgtgtaaagtgctttttgctggcaaactgaaccccaggaacagacaaggaataggaaccttctgtgcgagataggctgctggaggtgaggccgggtctgtgtgtggcaggaaggctaactcaacacaggctgcctttgtcccaggctgtcagggaagtggactttcacctccttggaagcatgggcacttaacaaataaacaagggtagggtaatagcactagttaaagtcgccaaatgtggtgacctgggtaggggtggggtgggggagttagtggcagaaccagagcaaagttccacctgagcccaggatggaatttcgggcaccactgatgtttgctgactgtgatttgccgggccctgactgcttcccattcttctggtgccttctcttgttacctttgagttggtggaagcagagaaaacattcaatcccttcttgtttccagattgcaggggagcatccctgtagggaagcttctgtgtgtttgatagtcttttgccctcctcagtcctgaatgtttggaagcgcaatgcagggctgctgggatttgattccagcccttctgtctgcggtgcctgacggggctgagcctcccgccagggaggtgctaagtgcttcctctttgtttgcgcttgctgcaaagccaggctgacggtttctgctgaaaacactgctacagctgtactcgggtttccagcggcttcaactttctgggagcttttatgttttgtctctgtacacagacttccctcctttgcaccatggacagtctggctgggccctgcgctctgcacccagcaactgttgtgagatggctttcttttctatatagttttttgaaagacatttatttatttatttttctaccaacgataaaagaatattccggtatacttgtggtcaaaaattttgaaaatattaaaaaaggcataaaagtaagaaagaagaatcacttccagtgacacctttcaatggccactgtgaattctcccctccctttctccctgtctgtctggtttcaacgtattccatatgggtaggaaccaatttctgctgtggaataaatggctaggtagagaggtgtcggtgggccttttttcttttcaactcttgtgtcaacgtcaagcccctcctaaatgggcagagcctcgatcaccctcttgccaaaaacacacaggaacccataacaatcctcaatccggagcaataggacttctgcaacacttttcccccaaattcaaatctcctttgaagagcctaaagcttaaaggcataagcttaaccctgggctatgtgggaagaggcagtctgagaaaaacttcacacgccagcgagcaaaggccatcggaagttacgtacgccagactcaaaactcagggttctactttgttctataagaacgcccagaaaggagaactcccatcaaggtagaaatgtaaagccgagaacagcgctgagcacttgggtgtaactcagggactgatcctgcggtggcccgtctctcctgagagcccacctcccgcctgaaccaacccttttttctgtttggtaaaggcatacacatcttatattgctttggacacacggttcttactctcttgcaggcttagcagttgtttcacaagtctgctctccctatttttgtgtggtttctttcttgtttgactgaaatcatatgcaaacaaagtcgaaagtgtctgttatcaccctgatggcttctgcagcattgtcttgcttcccctcaccccattcacagttcccagagagcctggcaggtgtctcggggccccaagatgagtggtgcccgtgcgccgcgaccccagcccagcgtagcccagcccatcgctcgcctcatccaggcctgggggacccagtgcgctcgtcatctctccacctttccttccttgtctaaaaaggccatcggggagttcattttggtggacaaggatgtgaagataaaaaagaaaggtaaaatctacagccttaacgagggctacgccaaggactttgaccctgccgtcactgagtacatccagaggaagaagttccccccagtaagtgagggcccggggagggtggtgcaggttctgggcatctggcaccagaggccgttctggaggcaggggcatcccccggagatgaaagggatccttgggatcgagggccttgggcctcatgtggggctcctgagcagtgtggaaatctattggttgatgacttaccctaaaggtgaaaggaagcagggatggagtggattgggcttccgtctacactgagcccacgatgaagttctcacctcagtactggagactggaattctcaccctgagacatcaaaaatcagtctccatgtcagcctttgctactttctcttggcagaagaaaattaggataataaagttaaacaaatgaatgaattcatggcagtaaaacatcttcccttctggggtccatggtcccagatgggatgaaatgtggttcccccactcaaatgcccgtcaagtggtgtctgccccttgctaggcctgcctgaggtgcatctatcagttatctcgagaccgagagtgcccatcgtgacatctccctaaagaggttacaagctagtgaatatgaagagaagaaatggctgtgtggagcttgctctatatggaatatctgattttgtcctttctttgtttaaaagccatcgatggctgctgtttgctagagatgaagctcaaatgtttgcaggacgttcaaggaggcctcagatctgccccaggctctctctccagcttactcatctctcctttcaccttatcctggattcccctcctgcccccaagctccgcacacgcacacccgagtcccgcaggctcctcctccaggaccatatccctctccacattgctaagcagacacttgtgcagtttcctctcctgtaaattacacactgcctcccacccctgcccggttccttagcttggtaacaaactttctcagcctttaaggtgttactaaatggtacagtttctgtaatgcctgcctcagccccataaccagaatcaaccataccctcgttggggcttctgtgggtaatctgacctattgtgagatgatgagaggctgtctccatttttccattttctatttattgggaacaggattctcatcacattttttagcacagccccaaatacataccttgtaggtgctcggtgaatggatgtggaatcaaagaaacttaggagacaccaagaaaactctctttcttattttctgcaatcctaattcttgctggtcttaacttgcaggataattcagctccttatggggcccggtatgtgggctccatggtggctgatgttcatcgcactctggtctacggagggatatttctgtaccccgctaacaagaagagccccaatggaaaggtaagggtgtcccctggagagggagtgaggagcagatttcacttgcagcccacgcgatttagtttaggaagaagaaaggttttgctagctattacgctccatgctaggttgctacgtgtgtctgtagcatattcttttgtggattaaaggtaaagccagacgatatcaactaaagataaaaatagtctcttgagagcccttccagtgctatggcaaaagagaatgaacggtcaggacgaggactgaaagtccttagggcttccagtggatacagggcttggctggggcaaaatgaattccattcataaagtgaaatgaaacaacccagcctcacttccaaggcagcgaatcaaatgtgtatcctcagtagaagtcttctttgattgctttcaaaaggtgtaaaacagaggtaactagtgagtcaacatccactacttggaaaacgataccttttaggggaggaaagaatctctggggaaacctagagctttcaggtgagccgtcaccaccgactcactagtccaagcccatggtgttcccagcaggctgcagggtggctgtgctccctcacgctcgctcagagctgccctgctttccttctgccagggtgacagtgtgcttccttcccaagtattgtgtccttcttatgttttcccagtggacagatggctttttaggcagagtcttactcgtcgcccaggctggagtgcagtggcgcgatctcagctcactgcagcctctgcctcctgggttcaagtgattctcctgcctcagcattctgagtagctgggattacaggtgcccgccaccacgcccgactaatttttatatttttagtagagacggggtttcaccatgttgaccaggctggtcctgaacttctgacctcaagtgatccacccgccacagcctcccaaagtgctgggattacaggcatgagccaccacgcgtggctgcctttttttttttttttaatgcaagaggagaacaggaacaacagttcccttaaacacaaaacctgtgtgtttggatgtatttgggtctgtttgcagcatgtggcatccagaatgaaggcatttctatttactgaaaccatcatccagctgtagctgcctcgggcatatcaacctgtgtggttagcctgctttccagcacttttctctaaagtcccccgaaattgttcctgaacacaaatattgaggctccttcttttttttttggtttttcaaaactagccatgacacctatgtggaaatagactcaggaaacacctgcagaaagctgtcgctcagtaggcagactgcatgaaaaggcatacaataaaaaagttaatatttaaaagtgaatgccaagacgtataatacactgaattccaacccaaaagccttcggagaatcgtaaaaggaatgcacacagagttgcaaacaatatcacactgtttggaggagccggtctgctttccagatgtctgtagccagacaccaccatggattttttttattgcttttagaataggcgaagctccatccaacacacacagaatcactcattaagtccagtttccatggtataaagagaaggcaatgatcgcttctgccaaaatgtcattctgtccagtatgcaggtggtctgtctcacatttgcatcgggtaatctattgctggcactggcttgatgaatggttgaatttaaccaaatggttaactgttttgtctcagatgcaacctggggtgggaggaaacttttacagcctcacaggaaggaaaaatacagtattcgttcccttggaaactcccaccagctctgcatgttttgctgcagaaaagtctcttttttacgcaataccttctgatacaaggaggccgctacccggtcttgttttccagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaagtctcccttgctttgtgtcaaataataatgatgatgacaataataactgctgatgcatataacattagataactcatttaatcttcacaataacccaatgaatcagatactctgaataatccattttatagatgacaaaatggacgaggagaggtgaagtaattggctcaaggcttccagccaatgagtggcagtgtggggacctgaatgcaggcagcctggccactgtgagccagcatacggcttctccttcatgtcgtcccgttcaggcctggcccatcattccccagccttgttcaggattgcagctgaggaaccatgcagcctgaacatggcgactcacgccctcctagaaatgggggagctaatggcttagtggtggtaactgcatgtgaccctctggcctcccaaacatggatgtaaccatctgaatcccaagtgaaagtttactgtttacccagtggtgatttttctttttctttctttctttctttctttttttttttttttttttgacgcggagtcttactctgtctcccaggctggagtgcagtggcgcaatctcggctcactgcaacctctgcctcctgggttcaagcgattctcctgcctcagcctcccgagtagctgggataacaggcacccatcaccacacccagctaatttttgtatttttagtagagacggggtttcaccatattggccaggctggtctcaaactcctgacctcatgatctgcctgcctcagcctcccaaagtgctgggattacaggtgtgagccactgcgcccagccacccagtggtgatttttctataaaagcacggcacttaactcacaaaggctaatagttcctacagtctagttaccataagaaaaaggattcactacaagaacagggtttaaggaaatgcaatttgttgcaagcaagcaggcttctcactaaactctctatagaaacagtttctccctccgctaaccctggtcttactggaccagagtccaagatcgtggcaagctctgtcaggcactaagtaacacctgtggccctccttgagctctagatataaaatggatctatccatatgattccacttgggaactgaaaacatgtgtgtatgtgaatcctgcttcttcccctccaaacactccccattcatttcacattttcccagcaggaaattgatcttgagcattggatctgcttctgcccactgaccagacagacccaaagccaatatttctccactccagctggggctgccctctgggaaagtcccctgacgcacaaagcacctcttgagttttaaacttcttgtaactcagctggcatctggttctcaaagcatgaagggagagaaatatggtctgggagccttttccatatatatatatcagggtgcagtggctcacgcctgtaatcccagcactttgggaggccaaggcgggcgggcggatcacaaggtcaggagatcaagaccatcctggctaacacagtgaaaccccgtctctactaaaaatacaaaaaatagttgggcgtggtggcgggcgcctgtagtcccagctactcaggaggctgaggcaggagaatggcatgaacccgggaggcagagcttgcagtgagccgagatcacaccactgcactgcagcctgggcgacagagcgagactcgtctcaaaaaaaaaaaaaaaaaaaagaaaaaagaatgagggtctttgcagatctaattaaagtaaggattaagatgagatgagcctagattacctacattaggatgggtcctcctctgaagccatgcatttttgtacaggttcatgacatggcaggagcctggaggcctaagccaccgccatgtcgatgtcagcctgggaccagaaggagagacaaacctttgctgtgctaagccgtggggatttcaggtttatttgttgctgcacgataacatacgctatcctgactaaactagaccaagcttggcaatatttttaacctctctgagtctc

SEQ ID NO: 13983 - DNA, 57320 bp, Human
  misc_feature (1)...(57320): n = A,T,C or G
tgaagtcaggtaggtagtgtgatgcctccagctttgttccttttgcttacgattgccttggctacgtgggctcaatacccctgatgaacattgatgcgaaaatactcaataaaatactggcaaaccgaatccagcagcacatcaaaaaagcttatccaccaagatcaagtcggcttcatccctgggatgcaaggctgcttcaacatatgcaaatcaataaatgtaatccatcacataaacagaaccaatgacaaaaaccacatgattatctcaatagatgcagaaaaggcttcgacaaaattcaacagcccttcatgctaaaaactctcaataaactaggcattgatggaatgtatctcaaaataataagagctatttacgacaaacccacagccaatatcatactgaatgggcgaaaactggaatgaaggattctttttattttttatttttttttattttgagatggagtctcgctctgtcccctaggctggggtggagtgcagtgtcgccatctcggttcactgcaagctccaactcccgggttcacgccattctcctgcctcagcctcccgagtagctgggactacaggggcctgccaccatgcctggctaattttttgtatttttttttttttagtagagacagggtttcactgtgttagccaagatggtcttgatcttctgacctcgtgatccgcccgcctccgcctcccaaagtgctgggatccatgcccggccaaaagcattccctttgaaagccggcacaagacaaagatgccctctctcaccactcctattcaacatagtattggaagttctggccagggcaatcaggcaagagaaagaaataaagggtattcaattaggaaaagaggaagtcaaattgtctctgtttgcagatgacatgattgtatatttagaaaaccccatagtctcagccccaaatcttcttaagctgacaagcaacttcagcaaagtctcaggatacaaaatcaatgtgcaaaaatcacaagcattcctatacactaataacagacaaacagagagccaaatcatgagtgaactcccattcacaattgctacaaagagaataaaaatacctaggaatacaacctacaagggatgtgaaaaatcttttttttttttttttttcagttttatgtagagactaggtatcactatgttgtccaagctggtctcaaagtcttgggttcaagccatcctcctgcctcagcctcccaaagtgttaggattacagaagtgagcttcggcgcccagcctgtattactttcctttttctttctttctttttttttttgaaatggagtctccctctgttgcccaggctggagtgcagcgatttctgctcactgcagcctcacctcttgggctcacgtgaccctcccacctcagcatccctagctgttcaaatttattgtccaactcttttgaatcgtttatcaacgcaaatctgtcaatgcccacttatttttatttatttttttgaggcggagtctcgctctgttgtccaggctggagtgcagtggcgcaatcgcggctcattgcccctccgcctccccggttcaaacgattctcgtgcctcagcctcccaaatagctgggattacaggcgcgcgccaccacgtccggctaatttttgtatttttagtagagacggggtttcgccatgttggccaggctggtttcgaactcctgacctcgggtgatccgatcgcctcggcctcccaaagtgctgggattacagacgtgagccaccgcgcccggccctcatgaacttattctttagcgtttcattttgagagcgggattcacaagggaattgcggaaacagcagcgaggccccgcgacccctcggcccacgtgcgcgctgtccctcgggtcgccccgcgcccgccgggggcggagtccgctgtgacgcgtgcagggcggcgcgctcccggaagtgacgcgcgacggttcgtgcgtgcgtgcgggcggctgcgtcgggctgcaggagaagatggcggtctccacaggtcggttcccgggccgggctgcgtgattttccgctccgacccggctctgcccctccgtctgctgctggcgcccgagcgctgaccgtgcgggagaagcccgagtgcgctgtctcgaatgccgcgctctccgcagagcgtagcctgggaccgggtgggaccggcgccgaggccccggcggccgtcgggttggcgggtcgtgctcgcgcgtcggccgcgcgccggcgggctgggggcggggtggctcccgcgcgggcgcccccgtaggttccggcgggcgcgggtccgagttgtaggctgaaggctctacgggagggaggcgaggaggcccaaggtgggcgggtgtcaacctccggcaccgaagatgggtcaggccaaccggcaccgaagatgggtcaggccaagaggtgtcctggatcagagtaggggtcccattcctttggactctccttgacatgggttggggagtagaggacgattgctccttaaaataagagcgagaggatctttcttacctgactgaatacgtgtgatctttttattatttatgaggaaaactgcagtgcaaacaaaataaaagaccagagcaagatgaaagctaattgaagaacaagtggtttcttagataagctgttcaactcctctttcctactgaatacaatgtttggtttcctgtgagcacacaagtattaacgttgaggttttagacattagaccatttcagaaatgttaaaaacgttaagctttagtttacatttaaaaatgttaacccgtgtgatctgcctttttcttttcttttctttttttttttttttttgagtcagaggctcaccctgttgcccagttggaatgcagtggtgtgatctcggctcactgcaacctccacctcccaggttcaagtgattctcctgcctcagcctcccaagtagctgggattacaggcgcgtgccaccaggcccggctaatttttgtatttttagtagagacggggttttgtcatgttggccagactggtctcgaactcctgacctcaggtgatccgcccacttcggcctcccagagtgctggaattacaggtgtgagccaccgcgctcggcctgatctgccttttcctagtcttcgttgaaacaagagtatagagcagtgtgatttaatagtttatgccatcattgcataataaaatgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagtatacatacttgggtcagctagctagtaaggcaaggattgttttaaaagtggaattttagtgttatgactttactgtgcttgctgaaatctaatctgtgctcgttaacggggccatatctttataacagttgtgcttaggacctcttatagatttttgaaaatttagtaataaaataatgcattttaatttaatacttttcattttccttttgtgggttgcattattaaacacaattttttcataacactatacatgagtgtatgttaatattttgaaaagaccaaaggttagatgatattaatggcaaatactttttgttaatcacttttagttgttttggaagttgaatataaattataaagattactgataaattattagcatattgtacatagggagtctgtattttttttttttttttgagatggagtctcgctgcattgcccaggctggagtgcagtggcatgatcttggctcactgcaccctcctcacctcaggtgatccacccgcctcagcctcccaaagtgctggattacaggggtgagccaccgttcccatctactagttttttttttttttttttttgagacgcagtcttgctctgtcacccaggctggagtgcagtggcgcgatctcggctcactgcaacctccgcctcccgggctcaagcgattctcctgcctcagtctcctgagtagctgggacaacaggcgcgtgccaccatgcccagctaattttttgtatatttagtagagacggggtttcaccatattggccaggatggtcttgatctcttgacctcgtgatccggcctcccaaattgctgggattacaggtgtgagccactgcgcctgggtttgtttgtttttttttttttttgagactgagtctctcgcttctttgcccaggctggagtgcaagggcatgatctcggctcactgcaacttccacctccctggttcaagcaattcctctgcctcagcctcttgagtagctgggattacaggtgcatgccaccacgcccagcaaatttttttgtatatatatattttttttgtatttttttttttttttttagtagggacaggttttcatcatgttgtccagactggtctcaaactcctgaccccaggcaatccgcccaccttggcctcccaaagtgctgggattacaggtgtgagccacagtgcccagcctattaattagttttaattttactattagctatacttttgtttgctttttggtaacatgggaagtaaatagtacctgtgtatttgtgaaagcagcatgatacagcttaaaatttaaaattagatgagctacatcgatgtaatgcacgtgtttgtttgaaacggagtctcgccttgttgctcaggctggagtgcaatggtgcgatctcggctgactgcagcctcttcctcctgggtttaagcaattctcctgcctcagcattctgagtagctgggtttacaggcatgcaccaccacgcccagctaatttattgtatatatattttttctagtagagatggggtttcaccatgttggccaggctggtctcaaactgctaacctcaggtaatccatctgctccggcctcccaaagttctgggattacaggcataaaccactgagcttggtctaatacacgtgttttttatttaagccaaagtatctcgataacagttgtttaagaggccaaaaagaaaaaccctgacaaatatgttttgatctttagttcagtgtgcatcatataccttagcccctttaacccttccttctactggaagagaattttggaaggaaaaaacttttaattagactgagactttttgagacggagtcttgctgtgttgcccaggttggaatgcagtggcatgcgatcatggctcactgcagcctcgacctgctggggtcaggtgatcctcctacctcagcctcccgagtagctgcgaacacaggcacgcattgccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtctgatgcgctctccattatgaagaactctgaatttggaatatttctcagaacatgaatcttaattactccctttcacacttcccttcttagcacaatccttgtttcagactcttagatccttcttatggatgaaaggggaacgtagccctcaccagctaggttctccttttccaagagacagagttacccatgcaattcaagagtatttcacaggacagaggttaagaagctactctcgggaatagaaatttgatactgtttagtactcatgattcaaaattttattagattccagcattaataataacaattagtttagatagaaaagtatgtgcaggccgggtggggtggctcacacctgtaatcccagcactttgggaggccgaggtgggcggattacctgaggtcgggaggttgagaccagctggaccaacatggagaaaccatgtctctactaaaaatacaaaattatccgggcgtggtggcacatgcctgtaattccagctactcggaaggctgaggcaggagaatctcttgaacccgggaggcagaggttgtggtgagccgagagcacgccattgcattccagcctgggtaagaagagtgagactccatctcagaaaaaaaaagaaaaaaagcgtgtgcaatagttttaaaaaaatacaatagttttagttttacagaaaagttgtgaagatagtacagaaagtttccatgcacctcacattcagttttccctgtcaatttcctttttttttctttcgggatggagtcttgctctgtcgcccaggctagagagcagtggcgtgatctgggctcactgcaacctctgcctcctgggttcaagtgattctcctgcctcagcctcccgagtagctgggattacaggtgtgtgctgtcacacccggataattttttgtatttttagtagagacagggtttcaccatgttggccaggctggtttcaaactcctggcctcatgatccgcccgccttggcctcccaaagtgctgggatcactggtgtgagccactgcatctggcttcgctgttaatttcttatattggtatggtacacttgtcacaattaaggaaccaatattgacacatttattattaactaaagttcagatttccttagtttttctttaatgtacttttgctgtcctaggacttcatccaggataccacattacattgtaacgtgaaactttttttttttttttgagatgaagtctcgctctgtggcccaggctggagtgcagtggcgtgatcttggctcactgcaagcactgcctcctgggttcatgccattctgtggcctcagcctccgaagtagctgggactataggcgcctgccaccatgcccggttaattttttttgtatttttagtagaagtggggtttcaccgtgttagccgggatggtctcgatctcctgacctcgtgatccatccgcctcggcctcccaaagtgctgggattacaggcgtgagccaccgcgcccggcccacatgaaacgttttacatttatcacttaggtaatattaatggtacagtgaagctctagtctctgactgtagatgcctggaaaatgtctttgagtaatgagaaactcagaaaaaattgatgaaagaatatgttttctgctatgtaggcagaaaacaaaaccaaaatataacctactaattgccttcttcagaagtgggtagcattgtatatactggaagaactagtttagcagtgttctgagttccctgctgcccctgacagactactgtgccaccatgggcatgtcagttaatcactaaacattgcttttcccatcccatctgtgaaaagattggacaacatcatcttgttttcctctttagatgaagatacttggatatggacagaactcgggtgtggtgatagaagagaattacatagtttaaatcataacctagaacttgggaactaaacgatagaagagctgaactatggtagtctagtgtatttccctcttgaggcttccataactggcctggttgatttttctaggtcatttgggagcctgaattctcttgataaacatgcttttgataatatggtacaacctcactgtacaggcagtcctttgaacggcagttggcagaggtaaaaatggccatgcaaaaaactacccaaagcagtcttaataattgggaaaattatggttattctgagaccttcaaaaatgtcaacacattaagaactctccctgtttagaaatatgcaggaaagggccgggcatggtggctcacgcctgtaatcccagcactttgggaggctgaggggggcggatcacgaggtcaggagatgggagaccatcctggctaacacagtgaaaccctatctctactaaaaatacaaaaaattagccgagtgtggtgatgggcgcctgtagtcccagctactcgggaggctgaggcaggagaatggtgtgaacctgggagtcgaagcttgcagtgagctgagattgctccactgcactccagtctgggcaacagagagagactctgcctcaaaaaaaaaaaaaaaaaaaatgtgcaggaaaatgaaaccagtaaaattaatatttagtatgtcataatttaaagtatcagatattaagaattaaaatgttttatttcattaaaaaaagcttgttggctgggcgtggtggctcacgcccgtaatcctagcactttgggaggccgaggtgggtggttcacgaagtcaagagatcaagaccatcctggctaacatggtgaaaccccgtctctaccaaaaatacaaaaaactagccgggcgtggtgacaggcacctgtagtcctggctactggggagactgaagcagtagaatggcatgaacccgggaggcggagcttgcagtgagctgagattgtgccactgcactccagcccgagtgacagagcgagactccatctccaaaaaaaaaaaaaaaaaaaaataaggcttgtcaagagtagcttgaggctgggtgcagtggcttccacctgtagtcccagcactttgggaggtcgaggtgggtggattactagagcctaggagttcaagaccagcctgggcaatacaagaaaatcccatctctacaaaaaatgcaaaaattagctgggtgtggtgatgtgcacctgcagtcccagctacttgggaggctgaggtagagtatgggttgagcctgggaggttgaggctgcagtgagctgtgatcgtgtcactgcactcctgcctgggcgacagagcaagacactgtgtcaaaaaaaaaattaatttgaacaatgcttgctaatgttttgaagtacattatctgtacattgtggaatggttaaatctagctaattaccaaatacattatctcacatagttatcatttttgtggtgagaatacttaatagctactgagtatttttcaagaatacagtatgttgttaactaatcaccatgctatacagtagtgctcttaaacttgttcctcctgactgtaattacgtatcctttgtctaacatcttcccaatccccacccccgtaaccccaaccatcctaacctctggtaaccaccatctcctgtctacttctgtgagatcaattttgactccatatatgagtgagataatatgtatttgtctttctgtgcctgtgttatttcagttaacataatgttctccaggttcatccatgttgttggaaatgagagaatttccttcttttttatgattggaacagtgtcccactgtatacgtataccacatgttctttatccatttgtctgtgtggttttttttttttttttttttgagacggagtctcactctgtcacccaggctggagtgcagtggcgcgttctcagctcactgcaacctccacctcctgggttcaagcaattctcctgcctcaggctccctagtagctgggattactggcacccgccgccaagcccggctaatttttgtattttagtagagatggggtttcaccatattggccaggttggtctcaaactcctgacctcaagcaatccatctgcctcggcctcccaaagtatggggattacaggcgtgagccaccgcgctcagcctatccatttgttggttgatggatacttaggttgattctatatcttgcatattttgagtagtgctgcaataaaatgggagtgcaggcctctctttgacatactgattttattttctttggctatatatgcagtagcaggattactggatcatacggtagctctgtttttaggtttttgaggaactccatactcttctttctccatatggttgtactaattcacattcccaccaacagcatgcttagattatcctttatcaccacatactcaccaacacttgttatctgtcatctttttttttttgagacggagtttggctcttgttgcccaggctggagtgcaatggcatgatctcggctcattgcaacctccacctcctgggttcaagcaattctcctgcctcagcctcccgagtagctgggattacagccacgcaccaccatgcctggctaattttgtatttttattagagacggggtttctccatgttggtgaggctgctctcgaactcccaacctcaggtgatcttcccaccttggcctcccaaggtactgggattacaggcgtgagccgccgtgcccagcctttttttttttttttttttaattgagacagagtctcgctctgtcgcctaggctggagtgcagtggcgagatgtcagttgactgcaacctccacctccaggttcaagcgattctcctgtcttagcctcccgagtagctgggattacaggcacccgccaccatgcctggctaattttcatattgttagtagagacatgatttcaccatgttggccaggctaggctggtctcaaacgcccgacctcaggtgatccacctgccttggcctcccaaagtgctgggattacaggcgtgagccactgcgcttggcctcatctttcatccttttgattatagccattttaatgggagtgaggtgatacctcatgtgggtttttttttgcatttctttgatgattagtgatgttgagaatttttttcatatacctcttggccatttgtatgtcttttgagaaatgtctattcagatcttttacccatttttacatgaggttattttcttggtattgaatggagttccttatatattttggttattaaccccttatcagatatatagtttacgagtatagtgaaccattctgtatgttctctctctcttttttttttttttggtggagtttcgctcttgttgcccaggctggagtgcaatggcacgatctcagctcactgcaagctctgcctcctgggttcaagggattctcctgcttcagcctcctaagtagctgggattacaggcatgtgccaccatgcactgctaattttgtatttttagtagagacgggatttctccatgttggtcaggctggtaataaactcccgacctcaggtggtctgcctgcctcagcctcccaaagtgctaggattacaggcgagagccaccgcgcctgccagttctctctttattgtttcctttgcagtgcaggagatttttagttttatgtgatccaaattgtctgtttttgcttttgttgagtgtgcttttgaggtcatatcctccaaaaatcattgcccagaccaatgccattgacttttcttcctgttttctagtagtttcatagattgcctttttttttttttttttcctgagacagtctcaacctgtcacccaggctggagtgcagtggcatagtcacggctcgctgcagcctcaacttcccaggctctcacctcagcctcccgagtagctgggactacaggtgcacgccaccatacctggctaatgttttgtatttttagtagagatggggtttcgccatgttggccaggctggtctcgaactcctgacctcaggtgatccacacgcctcggcctcccaaagtgctgggattacaggtgtgagccaccatgcccagctgcacaatgcccaattttgccacttctgttcaacataatactggaagtcctagaaagagcaataagacaagagaaagaaatacaaggcatcttaattggaaaagaagttaaactgttcctgtttgcagaagacatatgatgtcagtgtttattgttataaaaacttctgtcttaaaactgcttttgctgtattccataggctttgtatgctgtgtgtttcagttttcatttttttcaataaacttcctaatttgttttttaatatcttcattgacctattggttgttcaagagcatgtgtttaacttccatgtttttgtgaattttctgaagatcctcctgttaatgatttctagttttataccattgtggtcagaaaagatatttgatatgatttccatcttcttaaatttgttaagacttattttgtggcttgacatatgatctatccttgagaatgttccatgtgcagcttaaaataatgtattatgccactgttgaatggtatgttctgtgtatgtcttttaggtccatttgttctatagtgtagcttaagtctcatgtttccttgttggctttctgtctgcatgatctgtgcattgctaattgtgaggtgtgaaaatctcctactgttactgtagtacaacctatctttcagatctgttaatatttgctttatatatttaggtgctttgatgttgggtgcatatatatttacaattattctcttgctaaattgacccctttgttattacataatgaccttctctatcttttttttacagtttttgatttaaaaatctattttattgggggccaggcatagtggctcatgcctgtaatcccagcactttgggaggccgaggcgggcggatcacttgagatcaggagttcaagaccaacctggccaacatggcgaaatcccatctctattaaaaatacaaaaattggaccaggagcggtggctcacacctgtaatcccagcactttgagaggccaaggcaggtggagcacgaggttgggagttcaagaccagcctggccaaaatggtgaaaccccatctctactaaaaatacaaaaattagccaggtgtggtggcgggcgcctgtgaccccagctacttgggaggctgaggcagagaattgcttgaacctgggaggcagaggttgcagtaagccgagatcacggcactgcactccagcctgggtgacagaacaagactcctgctcaaaacaaaacaaacaaaaattgggcgtggtggtgggctcctgtagtaccagctactcgggaggctgaggcaggagaatcgtgtgaacctgggagtcgggagattgcagtgagccttgattgcgccactgccctccagcctgggcaacagagcgagactgtctcaaaaaaacggcagggcatggtggctcatgcctgtaatcccagcactttgggaggctgaggctggcggatcatgaggttaggagtttgagaacagcctgaccaacatggtgaaaccccgtctctactaaaaatacaaaaattagccaggcgtggtggcacatgcctgtaatcccagctactcaggaggctgaggcaggagaatcacgtgaacctgggaggtggaggctgcagtgagccgagattgcgccactgcacttcagcctgggtgacagagctagactccgtttcaaaaaaaaaaattagccaggcatggtgccatatgcctataattccacttgggaggctgaggcaggataattgcttgaactcaggaggtggaggttacagtgagccaagatcctgcgactgtactccaacctgggcaacagagtgagtgagactctgtctaaaaagaaaaacaaaaataattttatctgatataagtgaagcaattcttgggctttctctctctctgtctctctttttttttttttttgagacaaggtctccctatctaggctagagtgcagtggcgtgaacatggctcactgcagccttgaactattgagatcagtgattttcctacctcagcctcctgtgtagctgaccacagatgcatgccactatgccttgctaattttttatattttttgtagagatggggtctcaacatgttgctcaggatgctttcaaactcctgggctcaaacaattttccctccttggcctttcagaatgctgggattatagggtcttgttctctcttgatttccatttgcatggcatatctttttccattccttcaccttcagtctacatgtgtccgtacaggtgaggtgagtcttttattggcagcatatagttgggtcttgttttttttaaccattcagtcactctatgtcttgattaaataatttaattcatttacatttagagtaattattgatagatgagttaatactgccatcctgttaattgtttcctatttgttttgtagctcctttcttcctctcctatggtcttctttggtggttgattttctctagtagtatgtttttgattcctcgcctttttattttttgagacagtgtgttgctctgacctggtcatagctcactataacctccaactcatgggctcaagccgtcttcttgcctcagcctttggagtagctaggactataggtgtgtgccaccaaacctggctaattttattttcttgtagatacggggtcttgccatgttgcgcaagcgggtttgaactcctgggctggagtgatcctcctgcctcagcctcctgagtagctaggaatgcaggcatgtgccacgatgcccagctaattttttttttttttttaatttttgtagagacaacgtcttgctatattgcccaggctagctttgaactcctggcctcaagtgcttctcccaccttgggctccagagcactggggtttcaggcatgatccactctgctggcttgttattgctttttatgttttatctattataggtttttttttttttttttaagatggattttcactcttgtttcccaggctggagtgcaatggcgtgatcccggctcactgcaacctctgcctcctgggttcaagcaattctcctgtctcagcctccttagtagttgggcttacaggtggccgccaccacgcccagctaattttttgtatttttagtagagacagggtttcactgtgttggctaggctggtctcgaacccttttttttttttttttttttgagacggagtctcgctctgtcgcccacgctggagtgcagtggtgcaatcttggctcactgtaagctctgcctcccaggttcatgccattctcctgcctcatcctcctgagtagctgggactacaggtgcccaccaccacgcccggctaatattttgtatttttagtagagatggggtttcaccgtgttagtgaggatggtctcaatctcctgacctcgtgatctgcccgccttggcctcccaaagtgctgggattacaagcgtgagccactgcgcccggccggtcttgaactcttgacctcaggtgatccacccacctcatcttcccaaagtgctgggattacaggtatgagccaatgcgcctggctctctttttttttttgagatggagttttgctctgtcacccaggctggagtgcagtggtgtgatcttggctcagtgcaacctctgcctcctgggttcgagcaattctcctgcctcagcctcctgagtagctgccattacaggtatgcgccaccatgtctggctaatttttagtagagaccgggttttaccatgttggtcaggctggtctggaactccttacctcagatgatccacctgcctcagcctcccaaagtgctgggattgcaggggtgagccaccacgcctggcatataggtttttgctttgtggttaccatgaggcttacagaaaagatcttacagttacaaaaggttattttaaactaataacaacttagccttgatggcctaaaaaatcctttatacttttaccctactctcccattttgaatttttgatgtcacagtttggatctttttttttttttggagacagtgtcgttcttgtcacccaggctggagtgcaatgatctgatcttggcttactgcaaccttcgcctcccgggttcatgtgattctcctgcctcagcctcctgagtagctgattacaggcggctgccaccacaccccactaatttttgtatttttagtggagatggggtttcaccatgttggctaggctgctctcgaactcctgacctcaggtaatccacctgccttggcctctcaaagtgctgggattacaggcatgaaccaccacgcccagcctgcatctttttatattgcatattcctttacaaattattgtagttactttcaatagttttgtcttttaaccttcctactaaagatacaagtaatttacactccaccattacagtattagtgtattctgaagttgaccttgtgtttacttttcccagtgagttttatactttcagatgtttttgtgttactcatcagtatccttttctttcagcttgaagaacttcccatagcatttcttgtaaggcaggtcttgtggtgataaactccttcagcttttgcttgcctgagaaagtctttatcctttgtttctgaagaacagctttgtcctgggacagacagctttgtctaaaggacagattttttcctggtcgcatttttttttttttttaaagagagacaaggtctgttgcccagactggtcttgaactcttgggcttaagtgatctgcctgcctcagcctcccaaagtgctggggttacaggtgtgagcccagcccctgcgagcgctttaaatgtatcatctcactctcccctggcctctaagttttctgttgagaagtctgctgctaggtatattggaagtctcttatatgttatttgcttcttttctcttgctgccttgaggattctctctttgtctttgatctttgacagtttggttataacatgtcttggagtagtcttatttgggttgaatctggttggagacccttcaacctgtagccatatacttataactttctccatatttgtacagtttttttgctactttttctttagatatacttttttttttttttgagacagagtattgctctatcgccaggctgtagtgcggtggcgcgatcttggctcactgcgacctccgcctcctgggttcaagtgattctcctgcctcagcctcctgagtagctgtgactacacgcacgcaccaccacgctcagctgatttttgtatttttagtagagacggggtttcaccatgtttgccaggctggtcttgaattcctgacatcaggtgatccacctgcctcggcctcccaaagtgctgggatcacaggtgtgagccaccatgcccagcctaacatgaaacttgatagaagtggatatgaggcattcaaactagaataaacagtaacattcagtgttcaggctgggcgcgcagtagtggcttacgcctgtaatcccagcactttggaaggccaaggcaggaggatcacttgaggtcaggagtttgagaccagcctggccaacatggtgataccctatctctattaaaaatgcaaaaaaaaattagccaggcatgatggtgcttgcttatagctccagctacttgggaggctgaggtgggagaatcacttgaacccaggaggcagaggttgcattgagccaagattgcgccactgtactccagcttgggtggcagaatgagaccctgtctcaaaaaaacaaacaaaaaaaatcaatgtttgaaagtttgtttcaaacgtagttcactttttcaaaggctctttttcaaagagctgattaaaataagtttgacatatgtaagatgggacttcaggactgggtttgggagtgctttattcttgtttataaagtcttagctgatttgtgtgagagcagatggtattttcagtaagctggaactcagcagctgtttcaagccttagaaggagataaatccttgtggctgtgtataggtacttttaaatagaaatagaaaaaacagtttaatagaatatatgttatggattgcctggactctagaccaagttcattttatagatgagcagtagaaatacagatatgaaatggcttttgcaggattttttagctagatgttgagtccagagctggtatcttgatttaagactcttggctgggtatggtagctcatgcctgtaatcccagcactttgggaggccagggtaggtggatcacctgaggtcaggagttggagaccagcctgaccaacatggagaaaccccgtctctactgaaaatacaaaattagctgggcatggtggcacatgcctgtaatcccagctactcaggagactgaggtaggagaatcgcttgaacctgggagatggaggttgtggtgagccgagatcgcgccattgcacaccagcctgggcaacaagagctaaactccgtctcaaaaaaaaaaaaaagagattcttaaatactgcttctgtatcacactgtatcctacgtatgccttggttgcttttatttcctggaaacccagtgatgttattttacagataaatgctgttaaggatcaagacaaaatacttgatagagtctaaaggcattaatagaatattaaaactccatgttcttttaaggtgtgaaggattttattgaaatgagtaacaaaaatttagaaaaagcgatttcagtggctaaatgctggtcaatattcacataaatcttttttgtaagcacatatttggtattgcaggtaaatacatatatattatttgttcccttactgatttttttttttttttttagaacgagtcttgttctgttgcccgggctggagtgcagtggtgcaatctcagctcactgcaacctccgcttcctgggttcaagtgattctccagcttcagcctcccgagtagctggaactacaggcgtgtgccaccacgcccggctagcttgttgtatttttagtagaaacggggtttcaccgtgttagccaggagatggtctcgatctcctgaccctcatgatctgcctgcctcggcctcccaaagtgctgggattacaggcgtgagccaccatgcctggccagtgattcttataaatctgtgattttcttttcttttcttttttttttttgagatggagtctcactctgtcatccaggctggagtgtagtggtgcgatctcggctcactgcaacttgtgcagggttcaagcaattctcctgcctcagcctcctgagtagctgggattacaggtgtgcaccaccacacttagctgattattatttttttttttttgtattttagtagagaaaagggtttcaccatattgaccaggctggtcttgaactcctgacatcaagtaatctgcccgccttggcctcccaaagtgttgggattataggcgtgagccaccgtgcctggcctaaatctggattttcttttttttttctttcttttttttttgagatggagtcttgctctgttgcccaggctggagtgcagtggcgtgatctcggctcactgcaagctccgcctcctgggttcacgccattctcttgcctcagccttccgagtagctgggactataggcacccgccaccacgaccggctaatttttttgtattttttgtagagtcggggtttctccgtgttagccaggatggtctcaatctcctgacctcgtgatccgcctgccttggtctcccaaagtgctgggattacaggcgtgagccaccgcaccgggctctggattttctatctgaggtttatctaagggaggcgagggaaagggaggttattgggagtgttttaagtgtttgatagaaacgtatctctgtatcagaggtagaatttacaacctgatgagttatcctaaacatttcagtattgcagctgttattcctaaagtgaccctttagaatatttagtactgttcctttctttttttttttcattttattcttccttttacctacttccccaagtaggctgcctctagataaaactgtatattatcgggtaggaagaacttggttccaggagttttgggactgggaagattggacaacagctatgtaacccgggcttcttattctctctagggcttatgaagtggttactaaaatctaaagttctatggaaaagggccagtttcctctaggatttgaccacacctttgagggatgcttcataagaaagctgaacttctggtggatggagatgtaaatgaatattgagtttggtttcagggagctgttgtttcaagacaactttactgagatataattcacataccatacagttgtctatttaaagtgtacaattcactgatttctggcatgttcacagatatatgtaactgtggtcattttagaacattttatcacctcagaaagaaactctgtaccctttagctctcactgttctatacctccaaacctcagcccctgactactataatctgtctcaatagatttacccattctgtactttcatatgtgtagatttatatattatgtggtcttttgtgactggcttctttcacttagcgtaatgtttttaagggtcatccatgttgtagcatgtatcagtatttacatgtttttatggctgaagaatattccagtgcattggatacaccacatttttgtttattcattcatcatgttggtggtgttttccaccatctggctattgggaataaggctgctgtaaacatttatgtacacgttccacccccgccccgcttgagtagatacctaggagtggaactgctgggtcatgttaactatgtttagctgtttgaggaactgctaggctgttttccaaagggagacttcttttttttcgagacggagtctcgctctgttgcccaggctggagtgcagtggtgtgatctcagtccactgcaacctcagcctcttgggctcaagtgatcctcctgcctcagcctcccacgtagcttggatgccacgtagcttggatgacaagcctgcgctaccatgcctgtctaatttttgtgtttttagtagagactggattttgccaagttggccgggctggtcttgatctcttgacctcaagtgatctccctgccttgaactcccaaagtgctgggattacaggcatgagccactctgcccgggcccaaaaggagaccattttatattcctaccagcagtatatgaaggtcccagtttctccacatccttaccaacacttattatctgactttgattgtagccattctagtgggtgttaagtggtatctcattgtggttttgatttgcatttccctgataactagtgttattgagtatcttttcatgtgcttactagtttttatttatttatttaattttttgagacaggttcttgttctgttgtccaggctggaatgtagtggtgcagtcttggcttactgcagtctccacctcctatacccaagtgattctcctgcctcagcctcctgagtagctgggactgcaggcacgcgcctttatgcctgggtaatttttgtatttttagtagagatggtgtttcaccatgttgcccagggtggtcttgaattgcttggctcaagtgatccacctgcctcagcctcccagaattgtggcattacaggcgtaagccactgcacctggccctttactggctatttatatatcttctttggagaaatgtctattcagattctttattcattttttttttgtttttgagacggagtctcgctctcgcccaggctggagtgcaatggcgcggtcttggctcactgcaacctctgcctcctgggttcaagcgattctcctgcctcaacctcccaagtagctgggattacaggtgcccaccaccacgcctggctaatttttgtatttttagtagaaatgggatttcaccatgttggccaggctggtcttgaactgctgacctcgtgatctgcctgccttggcctcccaaagtgctgggatttacaggcatgagccactgtgcctggcccctttactcatttttatttatttatttatttttgagctggagtcttgcattgtcatccaggccggagtgcagtgtcatgatctcagctcactgcaacctccatctcccaggttcaagtgatcctcccacgttagcctccagagtagttaggattacaggtgtgtgccaccacacccggctgttttctttttttttttttttttgagacagagtttcgttctcgttgcccaggctggagtgcaatggcgcaatcttggctcactgcaacctctgcctcctgagttcaagcaattctcctgcctcagcctctcaagtagctgggattacaggcatgtgccaccacacctggcgaattttgtatttttattagagatggggtttcaccatgttggtcaggctaatctcgaactcctgacctcaggtgatctgcccacctcggcctcccaaagtgctggaattacaggcgtgagccactgtgtccagaccaacacagctaattttttttgtagttttagtagagacggagtttcaccatgttggccaggcttgtctcaaactcctgacctcaagtgatctgcctacctcggcctcccaaagtgttgggattacaggtgtgagctactgcacccgacccctttacccatttttaaattgggctgtttgtctttttattgttgagttatcggagttctttatgtattctggatacaagtcctttatcagatgtatggtttgcaagtattttctttcattctgtagattgtcttcactttcttgatgttgtcctttggaacccaaaagtttaaaattttgatgaagaccaattaattttttttctacttcatttaaatgcagattctggctttttgtatgtagctcatcatctagctggtactttgttttaaaaacaataatgttcaggccaggtgcagtaggaggccaaggtaggcagatcacttgaggtcaggagtttgagagcagcctgggcaacgtaccgagatcctgtctctacaaaaaaataaaaaaattagctgggcacaatgctgtgtgcctatagttccagctcctcaggaggctaaggcaggaggatcacttgtgcccagaagttcgaggttgcagtgagacatgattgtaccactgcccaccagcctgggcaacagagtaagaccctgtctctaaaatgaacacacaaacatcagagaaccatgtttcatgcaggatatggtcagaaactaaaatataaatgaataaaaacaacctgatgaagtactgtgaattctagttgatgctctggttgtgattactgtatgacagaagggcaggagtctgagctcttcttgccaggtgaggtttaatctcactaaaaaaagttcgatagccagataccatgcatactgtaaacagttttattctttggaagtagtataattatgccagaggtttttcaatttatggattggaatgttcttgaaaagtacagacagtgcattgcttggtgtactgctcttcatgccattgtcatctgctacctaaattattgattgttgtttactaaacagtactgatgtaaatggttatgtcctcagaggaaatacttatgttattgagaagtctttaattttctcaagtttttacctcataaacagtgatttggagagatatctgtttattttgcttaatatggctttctgactgtggaagccagctacagcttcctggactcacaggtgagcagttatgcccatttaatagtctccgttagaagacctcacatcttttaaagtgcatgccatcctaattttacttagaaattaaaactagagaggaaccagaatatattagcttacttaactttcttccactccctagtgtattctaagggaagtctcccttgatagttctgcaataaacattcttagctacctcactggagaatgtgaagtaactgctacattcattggcttatctcattgggatatctgtagtgtatccaggtgaaatcttctgcaataacttactgcattatatttggatgtattcacttacatggttgtcttccccacgagatagtaatgtcctggggaaaggattctgtgttcagtatcagcaacatctgctgtcagtttatacatattgagagaaagattaaaaacaaacatttgccataaattcaccaggtgtttatcaagtgcctgttgtgtcatcattttctatggtacagtttctttctatgtcagagatttaataatgagaaaataaaggactcaagtaaaacctagcttttcaggctgggcgcagtggctcacgcttctaatcccagcatgttgggaggcccaggcaggcagatcacttgagcccaggagttcgagaccagcctgggcaacatggcgaaaccctgtctctactaaaaatacaaaaattagctggatgtagtggcatgcgccagtggtgccagctacttgtggggctgaggtgggagaattgcttaagcctgggaggtggaggttgcagtgagttgagatcgtgtactccagcctgggtgacagagtgagaccctgtcccaaaaacaaaaaacaaaacaaaaactggctaggcatggtggctcactcctgtaatcccagcactttgggaggctgaggtgggcggatcacttgaagtcaggagtttgagaccagcttggccaacacggtgaaaccccgtctctactaaaaatacaaaaattagccaggagtagtggtacatgcctgtagtcccagctatttgggaggctgaggcgggagaatctcttgaacctgggaagtggaggttgcagtgagctgagattgcaccattgcccttcattgtggctctgggccacagagcgagactctgtctcaaaaataaaaaaccaaaacacaaaaacaaaaattagccaggtgtggtggcaggcacctgtaatcccagctacttcggaggctgagccaggagaagcacttgaacctgggaggcagaggttgcagtgagctgagatggtgccactgcactccagcctgggtgacagagcaagactctgtctcaaaacaaacaaacaaacccccccaacaacaacaacaaaaaaacaacttagcctttcctttttgtagattgtaatatttcactgttttatttttagtttgcttttctgaagtaaaactactaaaagaatattttagttcatatatattcattaaatctaaaatcatgaagccgcttattttccccttatctagctgagttaatatctaacaaatagattctaaatgaactctccatataggtggtgattttttggcagtggctgggggtagggtggttttggttacaacctaaagagtaacagtagtatgattaatttctcctgtatgtaatgtattctccacaccacagaattgagatactttgcaaatcctctaatccagaggtttttccacttgtgtttgaaagtgtagtacagatgcttcagatgtacgaagtttgacttgaatttgtttttttcttttttgagacggagtcttgctctgtcacccaggctggagtgcagtgatgtgatcttggctcactgcaacctccgcctcccaaattcaagcgattctcctgcctcagcctcccgagtagaggtgtgtgccaccactctcggctaattttttgtatttttagtagagacgggggtttcaccatgttatccaggatggtctcaatctcctgacctcatgatccacccgccttggcctcccaaagtgctgggattgcaggtgtgagtaaattttgtttttataaattacatttttttctgctatatttcatcaattctaaaacacattgaaatatccgaagtggatatatgtgttgtagtttaattggtagagtgtttaaattttttaaaattatggtatcatgtagttggttatgccatcttagatttgatcaaagacagtatttaaaaaaactgttaagatgcccacattgaggtgaatatataatagatttcaaatactggattctacaaacatactgacgtgttctcatttgttaactgaatactaagcaattgtgatcaatttaaacttaaatgtattctattgaaatatatttttaatctcatacaattttttgaaatattttagaggctaaagttgaaaattggtttatctggtaaaccttcatttcagcaaaagaatattaccttctgattttttttggtgaattatataaatatagtttttagtattaaatctatttgtataaattcacagtgtctgaatgatggatgtatttcaaatttaaagttcagaaaaagtgtagctgggcatggggctcacacctataatctcagtactttgggaggctgaggcaggaggaccccttgagcctgggagtttgagaccagcctgggcagcctagcaagaccttgtctctactaaaaatattttaaaaattagctgcgtgtggcggtgcatgcctgcagtcccagctactctggaggctgacgtggaaggatctcttgagcctaggaatttgaggctgtagtgagccatggcgacagagtccctgtctcaaaacaaacacgcagacacacatgcacacacaccccagcatatgctttgatgtcaataattgtgtattattgacattattgacattattaatgtcaacaaatagtgttcttgagagtggggttgtaactgatgtttttgaaacagccagtgggggttatgggcccagttaggattctggaacagttttcctgagtgtagaactgtggtggggcttatgattcatactcatttctttgctggatgagtgttaaaagcggataggatggcagacccactcagcaaggaattccactgaggatgccttgaaaggagcaggggcataccatccagagcacaagacagagtaaagttatcacatgaaggactcatttgcttgaaaagacttgacttttcttagtgtcctcagatattctaacaactttacaaggcaaaaagactcagtgattttttttattctttttccattttttttttcctgagacggtgtctttctctgttgcccaggctggagtgcagtggtgtgatgtcagctcactgcaacctctgcctcccaggttcaagcgattctcctgcctctgccacctgagtaactgggattatgggctttcaccaccacgctggctaatttttgtatttttagtagagatggggtttcaccgtgttggccaggctggtctcgaactcctggactcaagtaatcctcctgccttggcctcccaaagtgctgggactacaggcatgagccaccacacctggctcattccttgtttttttaaaataaaatttattgtgtgtatttaaggcatatatatcatgttatgagatatataggaaaatggttactatagtgagtcaaattaacatattcatcatcttacagttacctgttttcctccctgtggcaagagcaaaaatcctgactatagcaaactcttattaaaagtcctcatggctgggtgcgggctcatatctataatcctagcactttgggaggccgaggcaggctgatcacttgagcccaggagttcgagactagcctggggagcatggcaaaaccccgtctctacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgatctttcattgtgtgcatagaatgtatagatcaaatctcagggtatttgtggtatccagattcttgactcatgacagatagttaatatatatgagctggccaggcgcggtggctcacgcctgtaatgccagcactttgggaggccaaggtgggcggatcacaaggtcaggagtttgagaccaagcctggccaacatggcgaaaccccgtctctactaaaaatacaaatattagccatgcatcgtggcaggcacctgtaatcccagctacttggaaggctgaggcaggagaatcacttgaaccctggaagcaaaggttgcagtgagccgagatcgtgccattgcactctgtcctgggcgacaagagcaagactctgtctcagaaaaatacgtatataggttatgaagttttaggaagtgacattttgggcatcacagggattggttgtttcttttagaatcagtctatgaaaggataaggctttagaaataatgtgtttcagcagggattctgactagggatagaggtgggggaaggaagcaaagtgataggatttctcctttcttttgcctcttctccccagggcagtgggttgccttcctgtactaggctcttgtgtgttggtcattgagatatattggggtagacaaaaagttgtatgtataccactgatacagtttagtagaagtatgcaaagtataaaaagaaagcactttgctcagtcatctggttaggttcttagtagagcaaaactctcgctttatgatgttacctcctccttcttacgcttctccttctctaattgtggtttctgtgtcttgatgccctgctgaactttaagctccacaagagcaggactttgactatcatggctagatcatgggcctagccacaattctttggctcacagtagacatttggtgctgttaaaatggaaataaataaataaaaccaaagaattacaacagtaaaatgaaccacaactttgtctcagttaactgagtgcttaacacttcttccctgatcatcctgtttcttggtcttttataacagctgatacttttctcctcctcttacctcccaatccattcccacgttgcagcaaagtgaagtttatgcttaaaacccctccctgaatcctcattgctgcagataaaggctgaattgctaagggtgcccttccaggccatttctgactctttgctctcatactcagttgcagtccccaaacattgcccagcattctctctctcttttgtaatgtcctccccacgccttttttggctccacccgtccaatcctcccttttctttttaaataaaatatttcaaacaccaggaaaatacgtgaatacacatatacccaccctggctattcacattctaataaattcttgcttcagattgttttttggaaacagaacatttctagtacatttaaagtcctattttcacttcttagtcctaggccactttctctttgcccagaggtcatcaatatcctgatttttattatttgtatttatttatttattttgagacagagtcggactccgtcacccaaaatggagtgtagtggcgtgatcttggcttactacaacctctgcttcctgtgcaagtgatcctcccgccttagtctcctgagtagctgggactacaggtgcgcaccaccatgcccagctaattttttttttttttgagacagagtttcgctctgtctcccaggctggagtgcagtggcacaatcttggctcactacaacctctgcctcccaggttcaggtgattctcctgcctcagcctcccaggtagctgggactacaggcgcacgccaccatgcttggctaattcttttgtgtttttagtagagatggggtttcaccatgttggccaggctggtctcgaactcctgacctcaaatgatccgcctgcctcagcctctcaaagtgctgggattacaggcgtgagctaccatgtccagccacccagcgagttttttgtatttttagtagagacagggtttcactgtgttgaccaggctggtgttgaactcaagtgatttgcccatctcagtctcccaaagtgttgggattacaggcatgagccaccacacctggcccaataatcctgattttttttttttttttttgagacagagtcttgctctgtcacccaggctgaagtgcagtggcgtgatcccagctcaccgcaacctctgcctcttgggttcatgcgattctcctgccttaggagaatttttagtagagatgggtttgtatttttagtagagacgggtttgaccatgctggccaggctggtctcgaactcctgccctcaggtgatccacctgccttggcctcgtaaagtgttgggattactggcgtgagccaccgtgcctcgcccgacccctgatttttaaatatcttttccactaacacctttatactttttgctacatatgtatatatgtataaaaactatgtttatttatagcttctataccagtttattctaatctcagcagtgaatgaacttccaatatctacacgtttgcccagatcaagaattatcagacttagtatttgtcagtttggtggctagaataagccgttatgattccctgattactgatgaggttgaacatatttttatgtttgttggtcattactgttttctgtaaaccttattcctaatatgttctcattgttctctagggttttcttttccttgttgatttctaggaggaattatttctgtattttgaataacgttcttgtcttctatatgttattcacatcctttttcagtctgtggcttatcttttcatttaatctgcctataattgatttttatgtatactatgagatcagattgggttctaattttattttttcatattggtaaagtgttccaacaccattaacttttcctactttttttttccttctcttttgagacagggtttcactctgtggcccaggctggagtgcagtggtgtgatcacagatcactgcagtcttgacctccctgggctcaggtgatccccaccttctgaatagctgggaccacaggcatgtgccagctaccacacctggctaatttttgtattttttgtagagatggggtcttgccatgttgcccaggctggtttccaactcctgggctcagttgattggcctacctttgcctcccaaaatgctgggtttacaagtgtgagccgccaccatgcccagccttttctacttttttttttttttttcttttgaaataacttcagatttgcagaaaagttaacataagtagtacgaaggattcccatataccttcatgcagatccatcaaatgttgatgtttaacatttttgcttgctcttgtgtgtactctctcttcccccctcccttcacattcgattttgttttttgggggaaccattcaagggtaagttaacagatactgtctcttcacccctacattcttcaactaggacattttcttacaatagaattatcaaaatcaggaaattaatgttgatagaggactattatctaccagccctattcagatttcaccactactgttctttaaagcaaaataatgataataatatttttcctgataccaagattgcatttggttgtcatgcctctattctctttactgacttttagtgttgcctctactaagaagcacattttcatatatgatatgtctgctttggggcttttctttttcattagtctgtccatttctgtactgattccatattttcttaatgatttctttagctgatgaggaagtcttaaaatctaggaaagtgtcccctctgttttttctttttttgttttgtttttgtttttgagacagtctcgctctgtctcccgggcaggggcttgatctcggctcacttcagcctccacctcctgggttcaagcgattctgcagcagccttccaagtagctggttgggattacaggtgtgcaccagcatgcctggcttatttttgtatttttagtagagatggggtttcatcatgttggccaggctgggttttttttttttttttttttttttgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccgggcatggtgttgcacgcctgtaatcccagctatttgagaggctgaggcaggagaatagcttgaacctgggaggtggaggttggctcggctacagagcgagactctgtctcacacacacaaaataacacagcaggtgtatgaggaacattaaatgtctttcctaacttactgtatgcaaataaaagtagatacttaagaaattgtctaaaaatatttagtaaacccatttctacacagacaaattaaaagttctgagaaatcaggctaaaatcacctcaaatttataaggtttgattaataaatatttacctttgcatatacacgaaagcaaaaaaaggtaggaatactttcaatttcagataacaataaattgaaatcaagtacaaattttgactccccttcctaaactgaataaactcttaaaaagcagacacactttacttgtgtaaacactcttcttttttttttttttaaatggaatttctctcttgttgcccaggctggtgtgcaatggtgtgatcttggctcaccgcaacctccacctcccgggttcaagcgattctcctgcctcagcctcccgagtagctgggattccaggcatgtgccaccatgcccggctaatttcgtatttctaatagagatggggttcctccatgttggtcaggctggtcacgaactcccaatctcaggtgatctgcctgcctcggcctcccaaagtgctgggattacaggcccagccgtatccactcttttaaatttaggcatccatgtcactggaattatgtttttcacaggatcacttttaaattcattaagaagtttctttatgtatataagcctattcattttacttgaaaggttttctgtcttcccaaagtcaaatccttactaactaaaattaggaattttgaaaaaccatccatgaaaatctcacaaacacattaaaaaatgtattatctaaggtgcataaaattaaactccatattaccaatagcatttaagaaactcatataaaatgataatgttttctttaaagagacatactgaaagccaagtcagttgttcacaggaggtggttttgcaccattatttgaactttgatgtgtgaatttgctttagaagtccatggtctgtttactctctgacagattctgttttcacatgcccctcacatgaaggttcactcctcattcttttttttttttttttgagacaggttgggtgggactgcttcaggattctaaaagacagtaccttctggtgcactttctaagatggaacataattctactctttgaaaatcattagagagtatatattaatgaactttggcttctatgaactttctgggcatgcctgtttgattggtgcagagtccttggctgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtataggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaagggtcagtgttataaattatattttttctattaatacttattgttaaagttagcatttaattttatactattgatattaaaataagcaattatgataacttctaaaatagttcctttttattttgtttacatttattgatgcttcccacgtgcaggatataatgctcgattacgtagaggattggggggaggaaggttgatatggtcattgccatcaaagttttgcagtttagtaagggagaaaaaatcagtacaaatgacagattctaaatatgacagagcaagttcactacgggactttagaatatgtttcttctagctggaataattgaggaaggctgaacagtggaggaagttgcctttggaatgatccctaaaggactgactggtaggatttcagaaggtggtgatggggatggagaacattccagatagagaggagaaaaggtgaggaaatggagggggtatgtggggagagcagtcattttgacgtaacatgttacctcttgtgtgaacctgagggtttctaaattggtttgcattgagtgcatgttgctatttgccctctgacacttcacatgccatagaaatgctgtaggtctcagcttcttcatctataaaaagtctatgattcttacatttttttctagtatggttggcaactggcccattgtactttgtctttcttgggtttatgaagttttatttttactcaaagtcttttagtctttttttctagcttgggatttttttttttttttacattgcattccttacttaatggtcccatccactgcactccctgcagtgaatctttgaaatttgtctctctaatgtttttggcttgttggaaagagcacacatttgaagggttttttaagtctttggttttgtatactggttgctaccttatgatgagagcattttaactgttttgctcttgggtagagtttagagttcctcctgatgatgatgatgatgatgatgatgatgattattgagacaacatcttgttcagccacccaggctggagtgcagtggtgtgatctcagcatactgcaatctcagcctcctgggctcaagcgatccttccacctcagcctcctgaggtggtgtgcaccaccactgctggctaatatttgtagtttttgtagagatggggtttcaccatgtcggccaggctggtctcgaactcctggcctcaagtgatccacctgccttggcctcccaaaatgctgggattacaggtgtgagccactgcacccagcccctcctgattattacaaaagaaaaatgtatcaggtaattagcaacattaattatagagaatgaattagtgtgtgttttatgttgttttctggtgttcctttgcaaaattcatgcacactcctaaactgataggctccctgtttactcccttgctctattttttcctgaagacattttaggaaggaaatataatgttgatatgttgatggatagagttccatatgacttggtatatataatggaagccttgattttcactgcctgtgaacatcattactgtggtctgtttggtttaaaaaaagcgcttataattgatgaacattctgacttactgatttgaagatttaacagtcagaacttggtagaatataaatttgaaattatttagatttcgtttttctctagccactgcctgcagcagactttaagaatgttttggaacttgtgatgagttcatcagtggtcttgtgggctgacccacagcacagttcctagctgtcgtggaccggttcctgcttggtctttcacccggttggggtcccctgcaggatgccccaactagttgccattcctggtgtcaccgaacctcaggaaactctatccactgggatgggggtgaaggctgcttctctgcaactctctcccctctcagggcacacagacaaaatgctactgtggtcctccattccctgtgggtggtggttttggagctgcaggagagaaaaggtcataatagcctttcctcacttgtctcaagcttcacgctgaggcacttataataaaaagcagagaaaagcatacaaatttatttaagttttacatgacatgggaacattcagaaaggaagacccaaagaaacagggaaaccgtgtatttttatgctaaatttgatgaagagtggacagtgatgcaacagcgtgattggatctgatggtaacacactaggtaataaactgggggaacttaccagggcctgtttgttcacattattcctgtgtctttggatttcattcctttcttggcataagacaagacccctttggagtggttctcatgacctacctacttcgtggggaggtcagctagattttagggtctgcttcaggggagaagggggcgaaggtaaggtaagagtaaccttgcttctgctgttttcttaagtgccaaggtgccgtattttgggatagtatgtcctgaacctcatcagagaccccctcacttcctttgagtgccaggcagaggtaggagggtgtgccctgcaaaggcacaggcttcttctggaactggcctctgctcaccacctgatgatcttctctgcatcaccttctcagttctcttgaaggcaggtcacagcaggcatattcagttgccttttcataaaacaggcaggagttggtatcttaccacagttgttttctccttagaaggtgcaatgttgagaacaattttgtccccagggtagagtatctacatctagccaggagaggaggaagacttttttgtttgtttgtttttgagacagagtttggctcttgttgcccaggctaaagtgcaatggtgtaatctcagatcaccgcaacctccgcctcccaggttcaagcggttttcctgcctcagcctccctagtagctgggattacaggcatgtgccaccactcccagctaattttgtatttttatttttttttttgagacggagtcttgctcagtcgctcaggctggagtgcagtggcgccatctcggctcactgcaagctctgcctcccgcgttcataccattctcctgccttagcctcccgagtagtgggactacaggggcctgtcaccacgccctgctgattttttgtatttttagtagagatggggtttcaccatgttagccgggatggtctcgatctcctgaccttgtgatccacccgcctcggcctcccaaagtgctgggattacaggcgtgagccaccgcgtctggcctaattttgtatttttagtggggacagggtttctccatgttgctcaggctggtctcagactcccgacctcagatgatccgcccacctcggccttcgcaaagtgctaggattacaggcgtgagccgccgtgcccggttgagaggaggaagacttttaacatgttacatggttcgttgttttttatttttattttattttattttgagatagtctcactctgtcaaccaggctggagtgtagtggcccgatcacacctcacagcctggaccccctgggctcaaacaatcctcccaccttagccttctgagtagctgggactataggggtacaccaccatacctggctaatttgtgtgtgtgtgtgtgtagagatgggggtctcactgtgttgcccagacgggtctcaaactcctgggctcaaatggcccacctgccgtggcctcccaaagtgctaggattataggcgtgaaccactgtgcctggccagttgttttttattttttgtactttattgactaaggtccctctttttttttttttttgagatggagctttgctcttgttgcccaggctggagttcagtgacactatctcgggctcaccgcaacctctgcctcccaggttcaagtgattctcctgcctcaggctcctgagtagctgggattacaggcatgcgacaccatgcccggctaattttgtatttttagtagagatggggtttctccatgttggtcaagctggtctcgaactcccaacctcaggtgatccactcccttcggcctcccaaagtgttaggattacaggtgtgagccaccatgtccagccagatccctcattttttatgttgttctagtatttatttggatttatatgattagcagttttgtttttctatgtttttgtgttcagttttctgaagcaatatttgttgtcactagagtttagtactttttcaagttttctcatatttaatgaaggtactgtccccatctttaaaatagaaacagtgtgagaattaagtgaaataatgattagataataggagaatacctgagtacttgacttagtaaatattagtttgtttttctcctcttttttttgctcttgctttttattagataacagaaaaacttgactgttaattaaaattttttttttttttgagacagtcttgctttgccacccaggctggagtgcagtggcgtgatctcagctcactgcagttgccacctcccgagttcaggtgattctcctgcctcagcctcccgactagctgggattacaggcgtgtgctaccaatttttgtatttttaatagagacggggtttcaccatgttggccaggctggtctcgaactcctgacctcaggcagtctgcccgcctttggcctcccaaagggctgggattacaggcatgagccaccacacccagcctgttaatttaaaatttagaggggataaaatcaaaggtgtcagaagttagggtgatatttactgtaagaattggattagattaataggctagctttgggattaaatttttttttgtttacataaaatctttcagaaaagagctttgggttttttttttttttttttttaaacaaaaggaattgaggtagaatttacatgtagtgaaatgcacagatgtgccatgagtttgacaaatgtagcttgttacccctactgagatacagaacattcctgtcattccagaaagctccctttgcgctttcccacacctgagagatttgcgtgttgtagagctttggtaagtagggtcatgtagtgtgtacacttacggttctttactcagcatgaagtctgagcaattcagttgtgttatctcatgtagtaggagtgtgtttctttttattgttgaatagtattttactgtatggatataccacaatgtgtttatcacttctttttatggacatttggatttaatctactttcttgcttttacaaataaagctgctatgggcattcttgtagaagtctttttgtgaacatgtgtttgtttccatttcgcttgggtaaatgcctaggaatagaattgctgtatcataggggagtctgatatgcatccagattggagaatcacagccaagataatcatgagatctatctgattttagtcatttttatatattgaaagtgctggggatattattaatatttgcttgctattaatctcagatgagttttatatagctctttttttcttaaagtattgaaatatttaataacatacatataacattgttgcataggttttacattagagtagtttaatactgcaaatctgacctccatttggatagctcttgtttatggggatgggatcagtttgagtaggtgagatctgtagatggttggttagcttcctccctctctggtcttatacagcagccagcagatattaaatttttcactttcatttatttatgtatatatttttatgttattttaattataatttagaaaatttaaagtttcaataattataattctctttaaaacaatttttttttctttttaatctcttgagtcaaggtgaggattcatttattttttactttgctgttttaatggtacactaataagttaacagagtgaacaaaagccatagcagaaagaagagttaatttataggcatgaaaataagccctggataatctagaagctttaagtttgatacctatttgaaaatgatgtgtaaacataaagtttgccattgtatctctgaattcagataatgggatttaatgaacctcaaaattaatgaagtggcaacgtaagtataactaacaggggacataaaataattatgttttattgctgcaaaatagtataatatggggttttctcttttgctagaagttattgattgccatatttagtaggataatcatataatttgttatccaacaagacccttttgagaatgaaaggaggcactgttaatagtcaattctgggacaataggaataagcagaactgttctgtaaaacagaaaccttcatatatgtttaacacaagtctcaagtagcccctccctctacaatgtaaactttttagcaaaatctaaatttaagtggtttgctttttcgtttttccttcttcgttctaatttgttacaggcatcatttttatcacaaaagcaacttgggatcatattgataatactttgtagaattaattttgtaaaatctcatggaattaattttgtaaaatctcaatttttaagtatgcttattgcattttttctcaccatataggtgaaataaatttgaatgtagaaaaataaattcttaatcataaacactgtcttacgtacattcatattgtactttcccttttttttttttagcacttagacattaatattttaggtattgttattttgattatctttttgttttttgccttccagacaaattatgaaaacagaatatatagcctgaaagtagaatgtggacctaaatacccagaagctcctccgtcagttagatttgtaacaaaaattaatatgaacggaataaataattccagtgggatggtaagttaatatagtcattttggttttatataacataatgtatagagttatatattatacgtacacacaccataatatatgtaagatattaatatgtagttaggagaaagtttttaaaagaggacctttgttaagccaaaagtctaaagaaggttgcattatgttgtttttcttttattaatataaattaggccatccttaaaaaccttaatgtacttgcctagaatagatgcatgtggtggttaaaactttttttttcttttcttttttttttgaaacagagtctcactctgtcacccaggctggagtacaattgtgcgatcttggctcactgcaacctctgcctcccggcttcaagtgattctcctgcctcaacctcccgagtagctgggattacaggcacctgccatcatgcccagttaatttttgtatttttgtagagacggggtttcacaatggccaggctggtctcgaactcctgaccttagttgatccgcccggctcggcctcccaaagtgctgggattacaggtatgagccactgtgcctggccaaaagttttcttagggttttaattgccttaatagtcatatttcagttgatctttatttggtaaaaagatgaccattattgggcggggcatggtggctcacgcttgtagagattgtgccactgcactccagcctgggtgaaagagcgaaactccgtctcaaaaaaaaaaaaaaaaagagatgatcattatttctctttgaatgttacttttctgagggttaaggtacatttggtgggattaaaaggatgactgttcatgaaaaggatgaatattcatgaagggtttttttctttaaagagcaaatatgtctgtgttgaaacagtcatggctgagcatcattgtctatttatttttgggtttcactctgtcccccaggctgtagtgcagtggtactcccccacttcctgtggcctcaagtgattctcccacttcagcctcccaagtatgtgagactacaaggcacatgccaccaagcccatctaatttttgtattttttggtagagatggggtttcgtcatgttggccaggctggactcaactcctgacctcaagtgatctgcccaccttggcctcccaaagtgctgggattacaggcgtgagccactgtgtccagcccattgtctctttaaacaaaatgacatgccctgcttgacccacacaagttagttagtagaaacagctgaatttccagtatgagtagattgttaagttcatgataagtctttgaagcctaggctctcttggtgccatgttgagagcacgccacatacaaaatacattttaggaagcaaaataacatatcatcatcataaaatgagtatcatccatcttaggaaatagggcctcagtatccttgatttctcatcccatccctgcgttccctctctctaccagtgtattttgtactacaaatgtatcacatatgtacacaaattcatcctcctttcttctctccttctctctttccttctcatctgtttaccatctgttaaaaatcacgagtttatactaacaactcccactaattttattctaaaactatagggtttgttctatgattcttcctttccagttgagaaacctggctcccatgcttcccagtgcatttacttatttgctcaatttccccttcatataactgtacttctggcaacaagttgaatcttggattcacagccagctccctgcccctcaaccccaacctaatacgcaggtctgaggcggggccccagattggctggtgcatccagcagggaggcaccaggccaaataaagcatgaccctgagaaaggaagaagctgggaaaggtcattggaaaccttagccctgcacctgctgggccattaacacccccccacccctgtgccaactcagagctgggacctgagagtctctccagccctcacagtcctcagttggtcagtctttgtgatttactgggagcatttagtccatttacatttaatattcttaattactgacatgttcaggtttaaacagatcatcttatttggtggtttctatttttctacatgtttcttgcctacttttggaatggttgttctcaacttctttcattctgtttgtgttctttcagtgattattctagaaattatgcacacttatctatttttaagaaatttgataggagcaggattataaagcatatgagtacacagaaaagatattatttagggaatgtcctgtgtgacacacagcattgcctttatgaagaagacctttgttagattttgctactagacatatctggttttctccactactgttttgtttttacattatagcttctgtaaattaagtaactaatggtgtgttctacattgtcatggaagctaggaaatttagattaaatttcagacctacctctaataagcttatctgatctcttgggcttttggtccagtagttgatattttgcctccctctctacctcccttcccccaacccatttatcattaagccttgtcagttttatgttccaaatgtgactggatttaggtcttatttttctatttacattgccaccaagtgaatattggccatcatttatttcctggactcttgcaacaacgtctctgattctactttttaaaatcccttccagtctttccaaagttagcagccagagggatcctcctaagagacaaattgcgtcgtgtcatttctgcacttcagattcctttaggggcatcagcctcagcatgcatgcttcttgccatggctcactgggagtgctcaaggtgcacactggcctgcatgcctttcgtttggtctcaagacctttgcacttctgttcttcctccttcctccccagtctggctaactcctatgggtccttcatttctcactgtaaattccactttcttttttattgagacagagtctcactctgtcactcaggctggagtgcagtggcatgatctcgctcactgcaacctccatctcctgggtttaagtgattctgctgccttagcctcccaagtagctgggactacaagtgtgtgccacaacacctggctaatttaatacagatgggggtttgccatgttggccaggctggtctcagactcctgacccgcgttggcctcccaaagtgctgggattacaggcatgagccaccgcacccagcctaaattccactttttagtatctttattgatgttccaacttgaattatgtcccttctattgctctgttagagtcactcttattcttttgttgcacttaactataaatttatttttttgtttttaaaagaaatgtttctaacataatagaagttttagagaatgatagaaccagcatctatgtgtccttcacctagctttgtcaaatgttaacatttgtcttatttgtaacagatcttttaatttttttttttttttttttgagatggagtctcactctgtctcccaggctggagtgcagtcacgcgatcttggctcactgcaacctctgtctcccaggttcaagcaattctcttgcctcagcctcccaagtagctgggaccacaggcatgtgccaccacgtccagctaatttttttgtatttttaatagagacagggtttcaccatgttggttaggctggtctcaaactcctgacctcaaatgatccgcccgcctcggcctcccaaagtgctgagattacaggcgtgagccaccctgcccagctagatttttttcttattagtacaaagactacattataaatagagttaattctgtgtgtggctttctcttgtttccccttcctgttttttttttttttgagatgaggttttgctcttgttgtccaggctggagtgcaatggcatgatctcagctcactgcaacctcttcctcctgggttcaagcgattctcctgccttagcctcccgagtagctgggattacaggtgcctgccaccatgcctggctaatttttgtatttttagtagagatggggtttcaccacgttggccaggctggtgttcaactcctgacctcaggtgatctgcctgcctcggcctcccagagtgctgggtgggattacaggcttgagccaccacgtctggccaagtttaaaatttttaaattaaaatgttctccgtcagattgctataaaactttctaagttcttactctcaattgcaatgtgtatcttgtcaaggagcaatagaattcagttcgtggcctgcccctttccatggacacaccttgagtagtgctgctctcgggaatacatctagaagtgtgccgtggcgtggggctttcttcagcttgaatattgccaagctgctttcctcccggctgggtcaatgtcagccccaccagtggtgtataacaggaccctctgaatgtatattcccaccaacccttcttactgtcaatctggaatggggactgggaaatagaaaaataaatactgattttaatcattattggagtgtagatgtgtgtatagagggttgtgggtagggtgaatatattggacatctgtttttctcttcatttacatctaagagtttggattattacttttataactagtaaatggtacagaatttcacattggtgattgtgccaggatagtttttatattttgaggctgtttaagtgtctcatgaattgtagttcataggcattgatggtgggtgttgctttagtaattttagtttatacgtatttaatacgacgaggcaaagttattccctgtgggtggttagcactctgaagtgtaaattttattgtcttatgcagtgagatctcacattttggaggtcattgtatgttgtagactgataagatgcagattttattctgacatgatatttattttctcatgctctttactgcgtcctctctcttcatcttttttttcttttcctccaatgtttctttttttttttctgcaccctgttggtatttcacaggatttgcaatcacttatgtttatttaactaccatttacagctggaagtgtttgtttctgatttagaaatagcttggtattctctctacttatttttataaactgttcagttatggaatctatttaaaataggctaaggaggttgccactctttaaagtgaaagtgttagaggaagcattttaaatgtaccttaccattgtaacatttttcttactcttttagttagtttcttttccttttttttttttttttgagacggagtttcgctcttattgcccagggtagagtgcaatggtgcgatcttggctcactgcaacctccgcctcctgggttcaagtgactctcctgcctcagcctccctagtagctgggattacaggcgcccgccaacatgaccagctaattttttgtatttttagtagagacggggtttcactatgttggccaggctggtcttgaactcctgatttcaggcgatccacccacctcagcctaccaaagtgctgggattacaagtgtgagccattgcgcctgctgttagtttctaaaataaatatcactctaaaattatttttcttttctactttcaaacacttttatggtgatataattcacataccatacaattcacccatttaaagggtaaaattcaagggtttttagtattcacaacattgtggaatcactgccatgacccaggtttggaacatttttgttcttcccaaagcaaatctgtgcccatcagttgtcatttcccatcccatctcccttagacctaaacaaccattaatccactttctgtctttttttttttttttgaggcagagtctcactctgtcgcccaggctggagtgcaatggcttggctcactgcaagctctgcctcctgggttcatgccattctcctgcctcagcctcccaagtagctgggactacaggcgcccgccaccacacggggctaattttttgtatttttagtagagacggggtttcactgtgttagccaggatggtctgtatctcctgaccttgtgatctgccctcctcagcctcccaaagtgctgggattacaggcgtgagccacggtgcccagcccactttctgtctttatagatttgcccattctggatgtttcatataaatagaatcatagagtatgtgttctttggcgacttaacgtaatgttttcaagatttacccatgtttgtattgtgtattggtactttattcctttttattgttggacaatattccattgtatggagatcccattttatttatccatttatcacctagtagatatttctatttttctacttttggctatcatgaatactgttgctatgaatatttgtatacaagtttttgagtgggcaaatattttcatttcttttggatatatatttaggagtggaattgttgggtcatacggtatctatgttttagtttttgaggaactgtcaagacagttttctaaagtgaataggccatcttacattgctaccactagtgtatgcaggttcccagcttctccacatccttgctaaccccaaataaaaagcaagaaattaaaacataacaacataaacaatcaccttcaaaaaaaggaaaaggagacagggtttcgtcatcttggccaggctggtctcgaactcctgggctcaagagatccacccgcctatctctcccaaagtattgggattacaggtgtgagccactgcacctggcctgcctttctggactaccgtagctttgtagtaagtttttttgtttgtttttgagacagagtcttgctgtgccgcccaggctggattgcggtggtgcgatcttggctcactggaacctccacctcctggactcaagcagttctcgtgcctcagcctcccaagtagctgggatcacaggcatgcgccaccacgcctggctaattttttgtatttttagtagagatggggttttaccatgttggccaggctggtcttgaactcccagcctcaagttgatctgcctgccttggcctcccaaagtgctggggttacaggagtgagccaccacgcctggcctgtaataagttttgaaatcataactttgttcttctttttttaatattgttttggctattctgggtttcttgcatttgcttatgaattttaagataagcctgttcatttctgcaagcaagaaaaaagcagttgaaattttaataggagttgtattgaatctctaaattaacttgatgaatattgtcatcttcacagtaataagtcttctgacccatgtatatttatttagctctttaatttctatcaactatattttacagtttttaaaaattatttttatttatttatttttttgagatggagtctagctctgttgcccaggctggagtgcagtggcgtgatctcagttcactgcaacctctgcctcctgggctcaagcaattcctgtgtctcggcctcccaagtatctgggatcacaggcatgtaccaccacgcccggctaatttttgtatttttagtagagacgggggttttgccatgttggccaggctggtctcgaacttccgaacttaggtgatctgcccacctcgccctcccaaagtgctgggattacaggcatgagccactgcacccgacctttaaattatttctatttaattttttttttctcttttttctggggagggagggaaagggggaggtaggagaggagggtggtaggaaggagggaggggagatattttacagttttcagtgcacaagttttacacttttgttaaatttatacttaggtattttattaatttttatttcagattgttgcaagtgtaaagaaaaactaattattgtatatggaacctgtatcttgttgccttgatgaacttgtttattagctctaataatttctttagtggattcctttgaattgtctatataccagatcatttcttgtatttcttctgcaaatagaggtagttttacttcttttctttctaatcagggtgccttttatttcgcttctttgttaattgtcctggctagaacctctccagtacaatgttgaatggaagtgatgagaacggggccaggtggtggtggcggctcatgcctgtaatcccagtggtttgtgaggccgaggtgtgcagatcccttgagcccaggagtttgagaccagcctggccaagatgacgaaaccctgtctctataaaaaatacaaaaattggccgggcgtggtggctcatgcctgtaatcccagcactttgggaggctgaggcgggtggatcatgaggtcaggagttcgagaccagcctggccaacatagtgaaaccctgtgtctactaaaaatacaaaaaattagccgggtatggtggtgagcacctgtaatcctagctacttgggaggctgaggcaggagaatcgcttgaactggggaggcatgggttgcagtgagtgaaagtagccgggcctgtggtggtgtgcgcctgtagtcccagcaacttgggaggctgaggtgggaggatcacctgagcccagggaggtcgaagctgcagtaagccacaattgtgccactgcactgcactctagcctgggcaacgagtgagaccctgtctcaaaaaaaaaaaaaaaaagaaaatataaaaagtgatgagaatggacatccttatcttattcttcatcttaggaggaaagtatttggtctttattaaatatgatgttagctctaagttttttgtagattcctgttaggttggagggtagtttccttctattcctaatttattgagtatttatatcatgaaaggtttttggattttgtcagatgcttttttgcatccattgagatgatcatggtttttgttctctgttctgttaatatgatatattactctgatttttaaaatattgaatctatcttgtgtttctgggataggtcctacttgtatataatcttttttgtttggagatggagtcttgctctgtcgcccagggtggagtgcagtgtcacgatctcagctcactgcaacctccgcctcccagatgcaaacaattatcctgcctcaacctcctgagtgggtgggactgcaggtgcacaccaccatgctaaatattatattattatatatttataaatacaaatattattgtattttagtagagacggggtttcactgtgttgcccaggctgttctcgaactcctgaactcaggcaatccgcccgcctcggcctcccaaagtgctaggattacaggcgtgagccaccattcccagcctgtatatagtcttatatgttgcttgaggtcagctgtagatgacagcttatggccttctcagctctttcataagcctgtgcgcagccctacacatgtgtgtggtcttctagattcccaggcctgtttggagacacttcgtttcccagcttgtctgcttaagtattttggttaccttcctgctttttttttttggagacagagtctcagtctgtcgcccaggctggagtgcaatggcgtggtctcggctcactgcagcctccacctcccaggttcaagtgattctcctgcctcagcctcccaagtagctgggagtacaggcacgtgccaccacacctggctaatttttgtatttttagtagaggcggggtttcactatctatgttggccatgctggtctcaaactcctgaccttgtgatccgcccgccttggcctcccaaaacgttgggattacaggcgtgagccaccgcatccggcccaccttcctgtttgactcaactttttttgacaaatgcccaaggaaggaggtgagtgaagatatgtgagctctgaggtcagataaaggaaagnnnnnnnnnnnnnnnnnnnnnnnnntgtgagtggagttttccagggaactgcaggacaggtcaaatgctgacagttaactgggaatgggcttgcaaggagctccatccccattctgttgctctttcacagaagattaatttgggtcgggtgccgtggttcatgcctgtaatcccagcactttgggaggctgaggcaggtagatcacttgagctcaggagttcaagaccagtctgggcaacatggtgaaaccctgtctctacgaaaaatagaaaaattagcctggcgtggtggcaggtgcctgtaatcccagctacttgggaggcctcatgaggcaggagaatttcttgaacctgggaggcggaagttgcagtgagccaggatcgcaccactgtactccagcctgggtgacagagtgagactctgtctcaaaaaaaaaaaaaaaaaaaaaaagggaaagaataattaggaatagtgcgtagaatacattggaaagaaaaatctgaaagaagagatcaggttagtagcttttgtctaaatctcagtgtgagataattccccagattttgggcggtggcattggaaatggagaggaaccttttgaccttactccattaagaaagaattggtaaatttattgacaaagtagttatttaatataacatttatttctgatgaccaaagttcactgtatgttttatgtctttatattttcccaaaatattaaactaattatgataaaatatactaattatggtattagtaattccatagtgtatgttttgtgaaaatagaggcaagctatgaattttcaaaatcattcttattaaaatatgcttaacaaattggtgccatagtactttaaacttgctagttaactgtactctttcctcccctttcaggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatat

SEQ ID NO: 13984 - DNA, 14817 bp, Human
caaatggtaacttgtagaagatttgagttagttatattacctgataccttgcaaaacaaaatgccaagtcatgagtaaaatatagttaaattttatatccttagctcttcaagtttataatgttaacgtacaatcctagatgaaacttctatattggacactatttccccaccaataacttttgtttatttaaatattttcctctctcttactctctctttctctctttctctatatgtgtacagtcatttcctacaaattgcccaatatatcaacttttcagtaatggcactgtgagaaatgctgccaatatgctaggagataatttgtagttaatcattgctcactcttttttttttctggcattatttatctcagtgtatacctaacagttttctttttcaggtgaactccagaaatctcaaagtcttgaacacacagtttagaattatctgtttattgacagagaattttgaaatgtataggcaaacatgctggaataaatcaactaagatgcagatagtaaatttgccgatgaggtttttgaaaaatgtatttgcagaaaaatttagataaagtttctgaaaaacttactatggcctaaaattacatgacttaatataaattgtcttgaaattccaatttctattaacttcttatgggaaagtataatgcaatacaaatcgtaattttaaaggctgcacatctaaagctattaaatatttcactttgcaaagtttacctagcatttatttgaaattatgtgctattgtgcgcgtttaaaattaatcataaatagcactttttttaaaaaaggtatccctctatgcataaataataacaacatgatgaatttctagatcgttcttggtataaatgttattgtcttctctgtatgattactatatcaaataacatgaaatttatttgccaatcttctaaccactcataccagaaaaagaatattgtaatgattgagtggattggtttactcatacaaataattatacattttataagaactacaaaacatctccattaaccactgcagtctttctgatcaaacagtgacagataggagctgagagtttaagggcatttgtttactatgtttgcttggattttccgaactgccttagttcctgattccacactgctattgtgtggatcaaataatcccttgtcacaaaaataccctggggaatgactcccctggcgtccaggttatgagtgtggtcagtcattccacatgccttagggatgagctatctgtgccatgacgagcgatttccttttcgagttttgtaatccccaaatactaaatactattatcaataaaagttaattaaggaaatgtatatcgaaatattgttcaagatagcactgaaattaggtttatctttcctcattgtcttaaaaaattattactgaattaaaacaggagaaattttacaatatactcttaaaattgtaaatatctactactgacctctttgatatgaaccataaccagacatttaaaaatatacttttgtcatgtagacacactagatatgccacttttattctcctttgcatggttcaatgtataagaaaacaacttagtagggggagaaaaaaattaaaagccattctgtaaatctttccctctttcttttcttgcaatctctcattgtatcttggagagcaagaccacaggttttaagaaatatgactcattttatgttagtggccttccaatacttcagaatattcttgatttttcatgaacagaggtacagctcagggagtgtggctaaatcagtcccagtctccagctccgcgtgaacctgggatccagacatctcctggatatctggcgctctctgagatccagccctcggtttcctgcaagccaaaaggatccgctaggttgggaaatgccgcctggtgcgattccagaaagggccatctctttaaggataacggacttggagggcctcttcaccctctcaccctgctccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagcacggaggaaggcgaccatggccaaggagtggggctacgccagtcacaacggtgagtgcaggcagccgcgacccggccaggaagggatgccagtccaggagagccctgccattgcacagaaatgggcaactttagagactgcagtggaaaatgtaggagtagaataagacctaacatttactgaggcttttcaactgccaaatgctgctgcttctttttttccttcatctcatttggttctccctagtatggagtttttatttcccttggagaaaactgaagtgcagagaagttggatcacttgcctaagatcccattgcctctgagaagtcagacagcccgaggtcaggtgtgactggcccttattctgttttactggacaagcacctaacctgagcttggtgccggtgtgagaatctctgctctgcctaagcttctccctaatccaaggcaaaggaacatgggtgtgctctgaaacccacaacacaatgctcaaatgtaggtggtcaatattattttattccaactctatgatggaaggtgtcattggttaaaaaaaaatgtgataaagtttatctgaaaaataagcctttgagcaggcagagtgaacacactgagttaaatagtctccatgtgtgctattcacaaaactaccaacaggcctgaaatgaatgctaagtctcttattgcccagtctgaaacctaagacctttttgaaatcactgtctagcctctctgtattttgctggtttagtcaattagaaagaggccttgggttgtgccaccaaataaatacatctcctcgactttatttcctaggtcctgaccactggcatgaacttttcccaaatgccaagggggaaaaccagtcgcccattgagctgcatactaaagacatcaggcatgacccttctctgcagccatggtctgtgtcttatgatggtggctctgccaagaccatcctgaataatgggaagacctgccgagttgtatttgatgatacttatgataggtcaagtaagtatgacaatgaggtagaatcacatggatgttttcaaggtccatattgacaaaatgtggtttatgacacagtaccagaattaatggggagagggagcactttatcttttaaaatgcagatgacatttgactttgctttagtcatgaataattatatttatgtattgaagaggaatgtcacaccctccaaacttggtctctgtgaaaacggccccatgtccaagctaaaagttggcaatgcattcccgaaatggaacacgataggacagagatgacaataaactcaaatgagtattcttcagactccgatggcctatacctgagggttcttgtgcttcttgtccatggtctggagagccaggcttccactctcaattgcatagattccattctacaaagccagatatacaatagaaaccctaaataggcactttcttcccttggtgcctgggaggtgaccaatctaggggagagaacagggccactgaaggtgtcaagatgacttgccttcaagccttcagtggggttcatctgattaatcatttgggtgagtatttttgaaatatctgacaatttcttcttgagtagtagtttgtgtgtgagacagcgactgaaaaatacatgtttagaaaaaacaaatctctttatttcacctacactagtaagcaaatcagtataataaaagaagactagtcagaaatactttatttcacgataaatgaggtaagaaagaatcttcctttaatattttggtgcttgatatacagcaaaataattccttatagccccatctctaataaagttatatttattgatatacataaatgaacattcttaatgattttgtaatgaagaatgatattcataattcctacctaccaggaggttccaagttacagaaatttaaattttcttaaacagtggtttcgtattgctattgtttccttttttccccttctccttatatatcaagtaccattttgaaagcaacataacaaaattaaacatatctattaggttgaaccatatgaaaatgccatttttgtgtgcaaaaatagttgaatattgtcaatttcatatagtttcttctaataaattggactcacatgtccctataataactgttctgagtggttggacaggaaaaatgcaatgaattgaaccactccatttctacctgaacaaactcatataggcctagcctcattgtttgaggtctatatttatggctttccctgggccacttagtgtgggcaacctcttctaaaatagctatgctctgaattctattttgatctagcttatattgccaaatcttgatcttagggtttctgcatagtttccaatatactttggaagacatttgaacctctaaatcactctgcaatgggttgagatgtttatcaacaagcccaaattaatgctgctgagaattatctagtttaatcatccacattgattggttttctgggaaatttctgaattttccatttcatctcatttgaatagacacagtctaaattagacgtagatgaaagtttttgctcgttgtcttgaagaaaagtgtagttggaagcaacacgtggagaaggaattcacatctgctcagtgatcatcatgcaggcactatgatgagcactttaaggtgcttaatctcagttaatcttcacagcagctctgaaagtttggtattattatcaccttcttagagatgtgaaagtgggttcagagaagtttagcaacttgcctgagaccacagaactagcaaggggtgaagccagcattggaaacctacctccacctggttctcaactgtccagttcttcccactgcaccacactactgacttgttctttgggtgtatgcatcctcattgtctatctgttgttttaattttgctttcctaaatgttaaaatgatgtttcaataataatgaaacaagcaaacaaaataagaaagacagaaaagaacaatcatttatcttgacatatccccagacttcattttgtgaggagtccagtgtcctgggagtggcaccatccacccagcaaactgaccacattttgtccattaagccttggctctaagagcacttggttaaagtagagctctgtaaaagaagcatgaattcactgttgaccaagcttatctgaatcacagtgctgagagggggtcctctccctggaccctaccgacttcgccagtttcatcttcactggggctcttcggatgatcatggctctgagcacaccgtggatggagtcaagtatgcagcggaggtaagaggaactgccataatccattctcggtctcatacagtgaaaactgcaaaattaaaaataagaaccacagcaacaaagcatcatccactgcttttgtttcaagtctatagttatgaaaagagctgtactagttttagctgaactgaagctgctgaacattctaggctagacaggtaaaagggtataggtgagttggcatcaaacatgaagatttccaaggttatgttaagaaactggggcgagtgcagtggctcacacctgtaatctcaacactttgggaggctgaggcaggtggattgcttgagcccaggagttcgagaccagcctgggcaatatggtgaaaccctgtctctacaaaaaatacaaaaattagcctggcatggtggcatgcacctgtggtcccagctactcaggaggctgaggtgggaggatcacttgagcctgggaggtcgaggctgcagtgagctgtgattgcgccacttcactccagcctgagcaacagagtaagaccctgtctcgaaaaaagaaaaaccctaaaagttagaaattggatagctacttaataagaaagcccagggtcctcaatggaactggaaaaaggatagctaatacttattaaatgcttacatgtattaactcattagatcctcttagctaccttatgagacaggttacagatgaggaaacagaaggcatagaaaagacacataataaagtcacacggctggtgagtgctagtgctctacctgatacagactggcttcagaattcatcatcttatccagtgccctatactgcctattttataagaatatagtgctctaaaaatagcatttagaaattctgaataatgcttatgttccaatctcttaatgaaccgtgtgcatatatatgtgtgtgtgtatatctatatatacacatgcatacatatttacacacacatagagatatgtgtacacacataccatttaatctgagcacatactactctctgtctcagttaactcattaaagaaaaacatgaattttaactcagatcaacgcatcaaattacaagggtttaagacaggcctctgacatgttctctttataaagccaaaccaataagtggtggcaattgccttggaggtgaggaccaattcatttttcctgctttattcttttccaaagataggctctggttaacataggggctgtgacagaagctcagaaacacactatgaacatgttcttaagcagaatcattaggcatcttagttcttggttaaattaaattctgtgaaacccaaagtacttcactgtgatctttctgtttctttacagccaatctagagagccatggcaagataaattaagtattgagaatgccttctagacatcttccccaaccaaatggggaaagttgagtatatttcttacagatgcaggcaaggctttcagtttgacctttgcacatgggattatttcatacttttggtcttgaataaaacattttttaactgctgcaaatgattgtatcctcttgccattctctgtaactcagcatagaaagtttgattaacctaactggtgctcatgttctaaattaaggtcaggttgccaccaggtttcagagctctggttgataaaaggagataaataaataattttatatgctttttatttgagccactagaaatgttaccaaaatgttacatgctactctttcaaattttctcagcttttatgagagtgctcagcaaccttagcctgtacaatgattgggtttattgtggataatgttgtacttatttccatattccaggaatttaccttctaatctgtcttctatggtttcagcttcatttggttcactggaacccgaagtataacacttttaaagaagccctgaagcagcgcgatgggatcgctgtgattggcatttttctgaaggtaaagtaaaaattgactatatattttcttccaaaatgtatttccctgccaatggttagcatagtttgagtttcatttcctcatttttaccttcctcctttcatatgcattttattattcattcaactaatcaagatatttctgcaaagatcagctcaaaatgtcttacttttctctaaaagtgtatcttttaccacactccaggacccctagcacttctaaattttccccagatgtgggaggtgtgtgtgtgtgtgtaggtgttggggacagagccttagagtgagcttattacggtggtggtaagggcaaaggtggcatatatttattttcctttctcactgctcaacttcaattgcactggaaaccagaaaagtcagtgttgggaaccatatgattccaagtccctggctggacatcccctcggcttgaggtggtcaccactcacgtgatcccaggctaagatagcacatggaatgtgtgtgttgttgagccaaccttgctttaaagaggacttagtgtcattaacacatgaagttagtggtaacataatctagatttcaagccagaggtgaaaatctggcttctttctctttgaatgacctaatttgttttaggttcttaattcattgggtcatttttggtacctgagcacagaacagcaggaggtggagtaggtctgagaagaaagacaatgagtttagtttgggatacatagggtccattttggttctaaatctggtttttagaaaagtggaatgactttgcagagaaggtcaaagacacagaactagatgaacgtgtaattttgtggtcctgtacttcagaagcctggagtccaaatttagatcagaaaatatatactctaaaatcttgaggaaaaataaacttatgtttttgcttagtacgagatattctggcagatttataaacactagttgcagatggatggatcaaaatcagctttgaagacaatcctaaactatggagaagtaaaagaactatacttggatttctgttttcttacagataggacatgagaatggcgagttccagattttccttgatgcattggacaagattaagacaaaggtaaacaaaaatcattttccctcctaaaacataaagcagattatgcagattttctttacatattttcaagtatttttttcacctaaaatctgttactaagtttgatggatatgctaagcatacatataaaaataaatgctattatatttgtatggcatacagtttttagagcaatttcacatatatcagtttttttaatggtcatagtcatcctgtcagataatcactttctcaatggagtaagtgagagtcagagaagttgagtggtcaccgcatcctcgcccaacacacacacacacacacacacacacacatacacacacacactgcatatatgcatgcataccatcacggagctactaaatgtcagccagtgctggtcttttgagtcttggtgatgagctttctgggaagcacttaaaaatttaaaatcttcacaatagactcatgtaagtaacagaaacattttaattattttttttctgaccgttctaatcaaatattattgagtttcattaacagagaaagtaagcattccaagtagatcattcaataaaaatacaagcctgatattttttggtatcatcaagaacaaaacattaacttatattaaataattcaattacacttgagatatcagtttctcctttttcttgagtgatagaattatcacagatagttctactcacagctaaaacactaaggaacacagtatgacagtgattgtgtcagatcaagtaataatgtgcaaaccagcttccctgctttgatctttatttctgaaaggcttatactttgtttagaagttctattttctctattgcatttgaaattcattcttacaaataaagtggtgagggcattggggtgggtgggcatgtgcatgcatgcactcactgcacctgcaacctgctcttacccagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccaggtgagcagccttgtgaacacgtgggcttatgttgctgtctgcctatgtaagatacagatgctaaatcaaaaatacatagctactaactggatactcactgaacagctctatggccagtaatttcatggtctgccctggttaattacaaccagcctgttcagctttctaaaacttggcccccaaagggtaccaggataaatgcaactcatttaaaagtagttttgataccgaacatgactgagtttatgctctataaacactttaaagggtttagattaatatgagtctttgttaatttggacgttgccaaatactgagcactggtaaggagatgggatgataaatacagacctggagaagagaaaggtgctaatggaaaggatttaacaattttgtatgctatatattatttctgcagttttacagatacataattcaaggctcaaaagttcagtaatttgtccatgatcacacagccaagtgcaggattctaatcccacctccaaactgtttccagtactttttggcatctcttctcaaggttcccttcttactgtttgatctaaagagtgtcctggtaacattcattaaagacactatcaaggaaaagctgtgtaggagaaaataagtgggcaagaacatggagaaaaacagattgaagcaagtaaacaacacagggactcacaacctagagcatgcatgtactctaatagtaaaatcagtttcccagtgtgtgtctcttgcataaggcaacagctttcatatttatgtcagttgtaaactcaagtttataaagacatttttattaaaagatcagatataacaaccttgttcagtgatataactattttgaaagaatgaaattttttcaaggagaaatctaaaaatattttaatatagaatcatagtgttattaatgagaatttcttattttcttatcctttaagaaagaaaagtcaatttaaaattgaaaatgtagcatgagtttgatttctttttgctcttaaaataattgactccataaacttatataataaaggtctactacattttatttacactgatatatggatgtggtcatcctctccaacaaagtatgtagttcatactgacccctcaaataaaaagtaaatgtttcagattcaacaggaaaaggttgtgaccagagggcacagtgatcctgtatagaatgaagaaaagggctttacaaataaagaaaaaatgtgtgtcactctagagctgctagctaaatagctctggactggacactggggacaggttgtgtggtttgcttgtcatgtttaaaacaccagtattggccaggcacgatggcttaacgcctgtaatcccagtactttgggggtccaaggcgggtggatgacctgaggtcaggagttcgagaccagcctggccaacatggtgaaaccccatctctactaaaaatacagaaaattagccgggcaaggtggtgaacacctgtaatcccagctattcgggaggctgaggcaggagaatcgcttgagttctgtgaggtggaggttgcagtgagccaagatcacaccactgcactccagcctggctacagagcgagactctgtctcaaaaacaaacaaacaaacaaacaaacaaaaaaaccaacaacaaaaaaaaccccagcagtatttatacctctttgtcacgtagtgtgtccagttgatccgaatgtcttgttaacagtctgcccctgccctttgcagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaaggagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacgttgagtgttgtgttttttaaatggaaaggcatcataaatgacaaaaatggagtttaactaagagcaacaaactttgtaagtttgtttttatagctgaaggatggcactaagggctgaaattctgagtttggatgctacattcctcaaggagggccagaaaaaaaattaaaaagcaattagtgaaggccttctgaggaaactgcagaccagaagaggaatgtatggccatatatctgatagtgggaaatactttccagaggcctcaaaattggtttaggattctggggttcagactagtgcaatgggttttaggggcgtgaaatcaagtcagactgtagcttttacatccatatttttaaaaattgtgcctttaggatgatgctggcctaacactgcaaaaatccatatatttagacctttaagccatttaatataatatctttagacataaagtctaattttgcagttagtggctttgatacgtctttcatcactcactggccaatatgttaacttactttagaaagtgacaggaataagctcattaccctaaggaatgaaataatattgggtcaggagagtcctgagatgccagaagtcaaatcacgtgacagagtcctatgaggccaaagttatttaatagattaccacccaggtgaagtcaagccaggttggtcagtgtgaactggaagtgttaattaaatccctcgaaattaggaggtgtggagctttgatcattagtgaaaatacacaagctgattctctcaaggtacttacttagtaatgcttatgcactgtaaaagatgtatccagtattgactctatgtgggggaggaacatatgacttaatgtcagctacaaatggtccttattccagtatacaagctgaacaaggttagaactgttttgagggaaaatgccccatcaaaagaggctatcttcgtagaccatatgctctatgagggcacaaatatgcgtcttgcatgctgacattcaccttgttgtctgatactgtgtccagcacataataattaattaatatttgttgaataagtgatgtcatgaatgtagatgaatccaggtaaaatacttaccttcttgaacaacacgtcacatggttaataggaatattgtttttgtttatcttagtttaaatctccttggaaaatgatctcactagcttcaggtgggagctttctagtagaacatacttctccccctccctccagtctgagtcattgtcaatgctcacaattatcgcccatcttaaaatttcctcacagcttctcaaagtgctgaactcagagttctgtgatatgtgatattatagatgtccattagaatattaaagacatactgtgtccttattcagcagggggatcattttcctgatcataaacaggccctcaaacaattgcatttcagatacacacagccttacaaaggggcatggccaagaactgctgtgataaaaagatttcagcatctgccaacttttgttcttcagggtataatcattgtaggtattttaaaatttcaaaatagggcagaaactaatttgaatttgtgtttcataatattccaatgatcatatcattaaaaacctatggatagagcagaattaacaagaatttatctaacatagggtattgttgaaagtatgcaaatatatatttacatacatatacatacatatttacatatatttacatatatttacatatatatataaaacttttttttttgagatggagtctcactctattgcccaggttggagtgcagtggtgtgatcttggctcactgccacttccgcctcctgggttcaagcgattcttgttcctcagcctcccaagtagctgggattacaggcatgcaccacaatgacatgctaatttttgtatttttagtacagatggggtttcaccatgttgtccaagctggcctcaaactcctgacctcaggtgatctgcttacctcggcctcccaaagtgctaggattaca

SEQ ID NO: 13985 - DNA, 5173 bp, Human; identical to SEQ ID NO: 11822

SEQ ID NO: 13986 - DNA, 25458 bp, Human
  misc_feature (1)...(25458): n = A,T,C or G
cacaacccagcttaagagttcaacaggattatgtatagaggaagttattcatccagagcagatgtaatagacggctgattatgtaccattccgttcttagcttttataaatttgagaagttgaatcttcttgagatattataaaatttgaacttattttagtttacaaaatatccccacagatttcactatttcagaatttggtgactattgatcctaattctttatactatattaaacaaatgtccccctaattatggattacattttgtgccatctaaaatgacaacttagaaactttgtgtgaattacttggtaactcacacaaaatgtaaataacttcatggtaaaaccagaggaaacaatgactgtcataggatatgactctgagatcaatgtagcattaccatcactaaatactagagagatgcaagacttctgtttttagaggcttctggattttttttttccacatgttttgaataaaagaaatttcaacagctttttacttatgagactgtggagacaattattattgcagccattatgcaaaataaattgctttgcttttcatattcattccatttgttcaatcatccatcagagatgttttgaaggcctgctgtgtatcaagcactgggctaggtgctaggatgtgacaacaaggccctgagcattccagccttctctgagtttataatatacaaatgatcagtcttaagtgagagaagttctaaaaagaaccttccttagagggaacaagggaaccagcttaaccatggctggggaagattgcctgaggaggggatgaaaggctgatatttgaaagattaggtaggaatttgccatggtgtccatccatggatccttccttgtgccttctgtctttatcttaacaattcccttgccaaacttccttgaacttcccttgtacacgataattctgttgcttttctctatacctataaacttttccaggggattgaattatttttgaccacttttgacctacgaatgtgacaatttcaacaactcagtgtatagctgtgacactttcaggctaaaaggttctggtctcttaaaattatggtatcacattgtactctttttaacatttattgtaagcaatccatcattaactgaaaacatcccagttattttccatcaaacaattctctttcagattattttttctaaaccattttcttccaagttgagtcatattttttctgcttattcatcatttcatctgatagtggggtcagtgattctgcctctatgctttcggctgtacctccaattccttttcttagcttgtttattctttcctccatgacattgttgagaaataaatcagttctatggactatcaaaattaatcaaatgcttttccagaaggtatgagctctcttgaaggattgcttctatttcactgtttttgagggtaaggcaaggttatacaaaaatggcaagagctggtaggctgctggtatttgtttttaagactgctgttatcaaatctgtgaaaacaatttaatttcacacatgcccacagacaggcacagagaattgtgaacttaaaaagagacagaaagactagaacctttactatatagaacctttactataatgaaattaaagtggttttgagctttacataatcacatatctaccccctttctcatcatcccacaactactatggaaaactttactctgtcaaccttagtttatctatgattaaaattagaaacacatccttgggcctttctttgcatgccatttttccacggtttcaaaaagataagcttcgcctataaaaggagtttttgttgctatctggttgcgtgtggaacctgacggaactgccacggtgagtcgggaacatgttttccaggcctaattgatcagaatgtatccattttcccccagaggtctaaatgaactaaaacttgccgatcttttaaaaacttagccagactcaatcatgtttttaatttcgtgtagatgctgccactttggactctttcactgctgctgggagcagtagcaggtaagaaaacaaataaatgttgagctgggagagattcacttttcaacacggtcaggagggctagggcagctgaattcaggccgcagtaataacatgaagatttacttcaaggagtaaagcacaggagacgcataagagcacaggtacatggagtagggttgtcagaaaacatctaagatgcccagttaaatttgaatttcagataaacagcaaatatttcccacaaacaacaaatatgtgacatatctatactaaaacattatcatttatctgaaattcaaatttacttgtattttgatttgctaaatctagcaaccctgacatcaagtcaagttaagagtttgaaccttggctccaccaccacctacaactgtattaccctgagcaaaattcttaactcttctgtgcttcagaatctttgtctgcaaaatggggagagtcggattccccatctcctaggattattgtgagaattaggtcagattagtaaaccatccaacccagcacctgacacatggtaagatgttgagaaacgcagcccccacaacagctgctactcttactcctaccattaatctagatttatcctccttagagaagagaacccttctttgggttatttttttatggagtgacattcaagcctagagttgtgttaaaccatggatttttggtttggttgtttgtgaacagcttcttcatcacaggaatgaagatgtcctgcagtacagcaaggatggggatatacggttttggcctttccataaaattttagctctcctttcaaagcccacagctaaacagtggctacaagaagttaaggcttagggacacagggctgtccctttcttgagcacctatagcccaaggaagatatctgagtttagaggctaaaaggagtcccacgttgggattgggcagagacacaaggggagtgaagtgatccatgtggtagaattgaggaacaagaacaacagcctgtctggaatagttgtgttgtcttttgaagctgttttgtgagtgtgtggctaggagggtgttgagagtagcagaggaggaaagtctaccacacagtgtaattgaactcatatattggcagacagatcattaaaaagagcatgtttgtaaaactaatatccttctgggggattgcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagtaagaactatcactgtgtttagaactaagttctttgggaggccgaggcgggcggttcacgaggtcaggagatcgagaccatgctggctaacatggtgaaaccccatctctactaaaaatacaaacaattagccaggcgtggtggcaggcgcctgtagtcccagctactcgggaaactgaagcaggaggatggcgtgaacccgggaggcagagcttgcagtaagccgagatcgcgccactgcactccagcctgggcgacacagtgagactccatctcaaaaaaaaaaaaaaaaaaaaaaagaagaagaaccaagttccacctgttttctgtaataaggatactgaatattcaagttcttaagagaaaaaaatcagccgtgaaatttgcatctttgtagatattcagggcactgagcttaggtattacttaatgtaaattgtttataaaagattcattaacttcatattattcttgtccttcctctataacatttaataaatattgtaaatgtagggctatatttatacatataaagtatataaacattcccaatattatatatttatgtaatctcctattatatatatgtatctctacatagataaagacatataaaaatacacacacgcacacacacacacacaaagccttccattgtatgaagaaaagatcattaccaccaagattataacagacatattatcccaagttgaacaatggcaaacatgttgtgatgactgggaaatggcaacatgatgatgatagtgaatactgtggttgctatggaggaatcattattcacaaggatcctgaatcctagcagtcttctacttactgcccctctccatgtacaaatggttctattggctactataggaaactgacatgaaacacttttctgtctaaacaggaagttgccgcagattcatcaagcatcagtggctccaatttcaaaacaaatagaaaaactcgctttattattcatggattcatagacaagggagaagaaaactggctggccaatgtgtgcaaggtgagatgtggtcatctctcaaggaaagatcgtttccaaagtggtaattaacaaacggtaaggcactggccccgaccaatgaggacagtgcttggaggtcttggaggatattcagacccctgctgggcctggagttcctaggggaggtcaaggaggtggtggtgggaagagggggtttaggatggtcagagcagtgaggctggcaagcacttggtggatctaggcagtggttatttaataactgatatggaggtgtttcaacattatagcaacagatgctgtcatgctgatgcacaccagctggttataggcccctgttttttcattagtttttaattttatgtgaagtgctaagaggtctcattttgcctgaatgaattcttttcctttgattttcacttgctactctcggatctcctctggtagcaataactttgaaaactgtgtaggttttcatttttggcttctgttgtttcaacagcggtgatcctattttctttaatttgcctttggctatatgccctgtcataaagaagaatgaaaagacagaaaatcaaatagaataaattttcctagtaactgctagtgcttgaggaacattactgttgattcatttattcaagtatttattcatgtattcatcaaatttctttgacctgctgtcgcacaaagggagtagtcctttcttcagaggtgtcaagaagaaagacacaggctgggtgtggtggctcatacctgtaatccgagcactttgggaggctgaggcgggcggatcacgaggtcaggagttcgagaccatactggctaacacggtgaaaccccgtctctactaaaactataaaaaaaattagccaggtatggtggcacgcacctgtaatcccagctactcaggaggctgaggcaggagaatcgcttgaacccgggaggcagaggttgcagtgagccaagatcgtgccactgcactccagcctggacaacagagcaagattccgtctcaaaaaaaaaacaaaaaaagacacaaaggtcctcctaagcccatacagtttcaggtctgcctctggctcaaagcaagggcagaatgagtcaactccagaacctatccattgatcctgaagacagatgagcactgtagaatctgtacactccgcaagtttaaacacaagcagtaaaaccacaacttgtcctccaaaataatttaaagctgatgattactggagggagggtaataatagatatttatagaacagcaaagaaaaaaatgtgattctcagttcaaaaggaatatagttacctttgatatggctatgcaatttatttctaagatcccaaaggcaattgtggtttgtttttgttttgttttgttctgcattgatttggctttgacagaactattgctttgagacgcagaaacaagtggtttaaactagaaggataaaggttctacagtccagtcctgactctctccttagctaactacgattagcaaatcttttccctgctttggatttttccttttgaaaaatggaaaagttgcagatgatttctaagattgttccattattctcaaattctttttttttttttttttttttttgagatggagtcttgctctgtccccccggctagagtgcagtggcgcgatcttggctcactgcaagctccgcctcccgggttcacgccattctcctgcctcagcctcccgagtagctgggactacaggctcccaccaccaggcccggctaattttttgtacttttagtagagatgaggtttcaccatgttagccaggatggtctcgatctcatgaccttgtgatccacctgcctcggcctcccaaagtgctgggattacaggcgtgaccaccgcacctggcctattctcaaattctttttgaaaaaaaaaaaagaagctatacataaacacactcagacaacagaattccttccagaactaacctccatgaagccctaattaaatgccatcaaacaaggctttccatagatatctggtaggcaatgttttcatgtgaaatattaataactctttagtgatgtacaataaaacacgttcatccaaaaaatttgattagtctttctattgtggaaaaacttatttaccttcaatgtatttatataaggggtcctaacattgtctttcattcattcattaaatatttactgagcatctactgtgtaccagaatctgttctggacactgaggctataccagtggacaaggtaaacaatgtccttgggtgcattctattaagggacaacgtagtcttatggcatttaggatgacctaatgaacaacacattgtaccacattttatacagtttatacacttttttcttgaactaaatgtctctgtatctgctacagtagaaatcccaagaatccagttcccactatggtcaaattccagtttggagatgattttaaactttagcagagattatatatctataacagactaaaagttttgtcaattgcattagggttaaaatgacattgtgtgggtcaaggagggaatttatcctagtcctccagtatgttaactagtaattaataaagatcctgaattatttatctgtttattgtgccccttccaccagaatctgttcaaggtggaaagtgtgaactgtatctgtgtggactggaaaggtggctcccgaactggatacacacaagcctcgcagaacatcaggatcgtgggagcagaagtggcatattttgttgaatttcttcaggtaattactcccggattgcataaaagcctgtacacatggttttccagattatctttccaaaaaaaaaaaaaaagcctgtagatttaatcatagataaagacacttctctactcagatatgatgtttctcttggctacaaagaaaaattaaaaaaaatctagctttgggtttcatcaataacccattatgttaataaactagtttttttaagttaacttattcaagcaattggtaggttgtttttaataaattccacgagtatttgttttaattttactagttattaccaatgtcaaccttaagattaatctagttttatttgattttagttttgctttcttaagagaagcacggtgataacaagctaacctcatttggtaacaaaaaccacagaaaatgttatacttgaatgtgtttaaataattgtttttatttttactttctaatccaaatacttgcttcatcatctctggataacaactcttcatgttcattaagagttctctctccatagtaaaacaacaaaatacagccctacttccaccagattaaaagttaaacccatttccatttttcattataactattttaaaaaacatggaagtcaagtgctttggaaaggcagtgtatcttcttgacactgaggtttttgaaggttctccctctgcgcgcctcattgaattctgcaatacagtcatgcaccacacaaggcacgtgtaggtcaatgatggacttcagatatgatggaggtcccataagatgacaatggagctaaaaaattcctattgccttgtgacctatagctatcatgataccacagcacaacatattactcatggatttgtggtcatgctggtataaacaaacctactgcactcccagttatataaaagtctaccacatataattatgtacagtatgtaatacatgataatgataataaatgatgacattactggtttacatatttactacactttttatcattattttaaagtatactccttcaacttattaaagaaaaataaaacagcctcaggcagatccttcaggaagtattccagaagaagacatgttatcataggagatgacagcttcatgcatgttattgcccctgaaaaccttccagggaacaagatgtggaagtggaagacagtgatattgatgatcctgaccctgtgtaggcctaggctaatgcaggtgtttgtgtcttagtttttaacaaaaaattttgacaagttaaaaaaattatcataaaaatggttatagaatcaagatataaagaagtaaaataatttgatacagggatacagagtgttttaagctaaaggttattacaaaaagttaaaagtttaaaaaaaataaaaattgtggcctggccacggtggctcacgcctgtaatcccagcactttgggaggccgaggcgggcggatcatgaggtcaggagatggagaccatcctggctaacacagtgaaaccctgtctctactaaaaatacagaaaattagctgggcgtggtggtgggcgcctgtagtcccagctactcgggaggctgaggcaggagaatggcgtgaacccgggaggtggagcttgcagtgagctgagatcgtgccactgcactccagcctgggcaacagagtgagactccatctcaaaaataaaataaaataaaataaaaattgcataaagaaagaaaaatattttaaatgaactgagtgtagagtaatgtacagtatataaagtcttcagcggtgtgcagtaatgtcctaggcctttacattgcttaccacttactccatgacttgcccagagcaacttccagtcctgcaagctccattcatggtaaatgccctctacagatctaccannnnnnnnnnnnnnnnnnnnttttttcagacagagtcttgctctgtcgcccaggctagagcgcaatggcgcgatctcggctcactgcaacttccgtctcccgggttcaagtgattctcccaccttagcctcccaagtagtcaggattataggcacccaccaccacgcccaggtaatttttttacttttgtagagacggggtttcaccatattggccaggctggtcttgaactcctgacctcaggtggttagcccaccttggccccccaaagtgctgggattacaggtgtgcgccaccaaggccagcctaaaatcatttataccgtatttttgctgtatgtttttaggtttagatatatttggatacacaactagttacgttgtgttccagttgcctagagtacacagaacagtaacatgctgtacagatttgtagcctaggagcaacaggctgtaccacacagcccaggtaggtagtaggctatgccatctaggtttatgtaaatacactttatgatgttcccacaacaatgaaatcgcttgatgatgcatttcttgtaacgtatccctgttgttgagcaactcatgactgcacttgaaaacattctgaaaaggttttctttccgacagtcggcgttcggttactcaccttccaacgtgcatgtcattggccacagcctgggtgcccacgctgctggggaggctggaaggagaaccaatgggaccattggacgcatcacaggttggtgaaaacagtgaaagataccaggggggttgaggcaagatgatctcttgaggccagcagtttgaggccaatctgggcaacatagcgagactcctatctccttaaaaaaaaaaaaaagaaaaaaaggacgctacaaacttagactaaatgcagcctgtatgtgatttaaaaggaaatacaagatggaaatttggtgcaaccctacgttttaccttttcacattttctgaattgggccccatgatcagaaatcgctgttctgaggctttgtaaagtcttcattgataccaatctttggtctacagcactctgtttaacatatttatattgcacgtgactagaatatgaattaaggacatcgagagattttattcatgtctatttccccattgaccgacattcacaaaggacaagtttcatgaatagaataaatttcataaatagtagaataaatataattaaacctaaggagctgaaatttgtataactaattatattctgtttcattagcaattgctaatgtgcttaagcctcaaacataaccccagagttgtcagggaaaaggtggtcagggtgctctgggctgccagttctgtgtgctgctaatgagataacgaatagtattttacaaacctgaggctggctgcattcagccagtgagctcacatattggatacccaggttctaaaacctctgtaaggttataagaaagatgctaccatcctggatctgagaggtgattattttaaggaaggaccactttcctcttccatctgtgttcaacctttttgtctctgacttggtgattttctttttaacccttgggataagtcggctgtatttggacttgggataatctggactgcctatccgttcatttgctgaaggggagatctgcacaagattttcttttccacagtctgtaaatgtttctttcccacagcctgctcggccaggtgctgtgcagtgaatgcctgtggtctcagtgacgtttgtgaaagccaaggtccttgcccttgtgggagttcacagtctaatggggactattttaaccctgcgtggtttttagtccagtgtgtcccagagtctacctcttttgttgtaactgctgctagtgactaagactctcccagtgactatggagccatgaggaaaggcatattgtttggtttggggaaaattcactttaaagcaaatagctagaagtagattcctcttcagcaaatggtcaggtaaggaagaacccgttcatccctttccatgcataactcatattttactcttaatacttgtactcaggacttgtcataattcatgaaacatactctttactttagggttggacccagcagaaccttgctttcagggcacacctgaattagtccgattggaccccagcgatgccaaatttgtggatgtaattcacacggatggtgcccccatagtccccaatttgggtgagttcctcaacccgtcccccaaagggtgttatagtgtctgagtctatatacattagcataaaccctcatgtatttttatgatttcagggtttggaatgagccaagtcgtgggccacctagatttctttccaaatggaggagtggaaatgcctggatgtaaaaagaacattctctctcagattgtggacatagacggaatctgggaaggtagaactattatgtgtagaaagagatcttcttgggagaaagcttgtgttttgttttgctaaacttgctaaattctttggaattgtacaggtctcacattttacataacaaaagacttttaattgtatccatgagatgtaggttttcactgggataagtgggcatgaggagactgggaaagaaagcgtattttcagtcaacttcagagtacctaattcagggaatgagcttttatttatttaaaccaatctttttcttctacagtattttaaacctttcatttaattacagtattacctattataatcttaaacagtactcaacttgtgattacatcacaaatcataaatatactttacaaatgactttgttctgtgacctgcatgagctcacactaattagagaaatctattcaaccactatattctgaatatgacgttaacttggaaaaataaaatctgtccttgatgtgtaattgtgtctgattcaaagggactcgagactttgcggcctgtaatcacttaagaagctacaaatattacactgatagcatcgtcaaccctgatggctttgctggattcccctgtgcctcttacaacgtcttcactgcagtaagtagactccaccttccgcataaagaattttgtgactgtcacttctcatgactggtgtgctttcctatacatgacatcattcaatgaatgtttatacttttgaacttatacatgcctttaattatatgtatttaaatagtgataaattagagcactttagagaaatgagcttgtacatggaaatgtcctgtttactttcatctgtgttacttttgtatgcattgggtaaatgtccaaacttgttttagaaataaccctaaacagacaaaaaataattagtctatggaaatctgagcaatatctgtaggatgctgatgaacatggaaaaattttcttaaatgctgacctttctaactattaatatataattatagacatgtggacatttctgtgcaatttcataatggccaaaatttttttttgaattttcatcttatttggtattctcttgatatcttggttgaattatttatttaattttactttaagttccaggatactagtgcagaacgtgcaggtttgttacataggtaaatgtgtgctgtagtggcttcctcttggttgaattctttatatgtgatctcaaatatgacatatctattgtctgggtttttttttttataaaattgactttgctttgtaccataaatttttgaaataaaaatttaaaacctatggatttaataagaaaatttccagtaacaaatgtgccagctgaagtcacaattacccaggatatataccttagtgattaagagagaggatgcaaatcttggtttcaccattaaatagctgaatatctttgggcaaaacagttctccaagaagtttcttcatgtataaatgtaaatactgatggcaaacttaacatatttggtgagaggacttaatgagaatacatacgttaattgcttagcccagagcaaaaaaatataatagcattcaattaatgttagctattatgggagagggagtacatatattattcacactacagcttccatatgcagtgagacagaagatcccttctttatttattttaactttatttttattttcttccccaatacccaacaataagtaatgggggaaaaaaataaagaagcaaacacaaaagcctcaggtttcattcagttaaaacttagtctaattcaacaatataaacagttctttcaagtgatactcatcacttgtataagaaaaaatgtctcagtcttgcagatttcttcacctttgcactcccttctaagcttctctccaagtgagtgctggggccaggtgatctggtggtggtggtcgatgtgtgttcagcagaggaaatgaattgggagtccatgggtgtaaagtttttgggctcctttcgactctgggtaatagccttgcctgttttattgatgggcacactgctgtatttagagatgacgtcttgggcttgtctattcttctggctctagcaatgccctcagagagctttggccatttcttcccggctggcttaggcaacacctggattttgttgaatgccaaccctgggactgtgataagcccataatatggtccattgagccaggagtccaccacttgccttcactgtagagtagccctgcccctcacagtgggaattgggacacttgtcctgccaacttggttcctccctctccatctctttttcccagaagtccttggtccagaaataaggggtattttcctatacgaatatgtcttctccaggtatcagcctcacagtaagccttaggctagctggggcatttttctcttcacatagagaaaattcccggggatctgaatccttcaggggcttgatatgctaaacatgagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttgagacggagtctcgctctgtcacccaggctggagtgcagtggcgctgtcttggctcactgcaagctccacctcttgggttcacaccatcctgcctcagcctcccaagtagctgggactacaggcgcccgccaccatgcccggctaattttttgtatttttagtagagacggggtttcaccatgttagccaggatggtcttgatctcctgacctcgtgatcctccagccttggcctcccaaagtgctgggattacaggtgtgagccaccatgcacagccaacttatgcaatctttctaaaataaattctagctgtaagtagatgaatgtcttgggagcaaattaggcaaaagagaaaaaatagaagatagatacacacacacacacacacacacatattctctcattgtatgatttgttttttttttgagatggagtcttgctctcttgcccaaggcttaagtgcaatagtgcagcctcggctcactgcaacctctgcctcctggattcaagcgattctcctgcctcagcctccagagtagctaggattacaggcgcctgccaccatgctcaactaatttttgcatttttagtagagacggggtttcaccatgttggtcaggctggtctcgaactcctgacctctggtgatccacctgcctcagcctcccaaagtgctgggattacaagcgtgagccaccacacccggctcgttgtagatttttatagtattgtgttgtttgacagtgaagttggtgacttactgttgtgaataatgaaatgcattgttaatctttgctgctgagacactattaaagtccccatttatcatcagaacagaactggctttagaatatttgaatggcgacaacatgtaggaaatatggtacacaactaaaagatagggcatcctcattcatcatttgtttgttttcactagaacaagtgtttcccttgtccaagtggaggctgcccacagatgggtcactatgctgatagatatcctgggaaaacaaatgatgtgggccagaaattttatctagacactggtgatgccagtaattttgcacgtaagtttctgttttctgtatcttatattcttattgctatatattttattattatgtccactgaaaatgtgcatacttgcttttctatacaaaagctttaaacaccccctctgcaaggtggaaaaatgctcaatgctatgttcaaggtaattatagctaattagggtggcagaacggagtttgggtcctggactcttaatgctgcaaaaataagtttcttcatatttgattctggtgctgaattcagaaggctttctctgctccagcctctttatattcagtcaaaagtttcactgaacaaaattctgagatttttgtaaaagcagaaaagtaatctaggagagagagatggcagaggttgtgagaatggaaagacattgacagatttaagagacgtttaggattgtaggctccatgggtgatgggaattagaggctggaggagtggtaggaatgggaacaggttctgggtttcttttccaaataacagaggaataaaattatttggatgagagttaatggggttaccgacatttttaaatactaatgacaaattttatctcctccccaatttgctctgcctatctctaaatggcaaactattggctagcaccaagaaaacgttcttttggttttcataaattaatatattcccaaaggcaatgaaaagttgaattatagaattttgaaaataaatgtagatatttagacaaaaagatagcagtaccctaaaatttggtgatctatgaaaataaattaaactgaaaaaatgtcacagttcacaattttacaactaccttttaacataaagttcttataactttcaaggataaattgtcaggttggaaattgaaaactaaatgtattccttagtcccttggcttgaaaaaaaatctgtcttaactttgaaaaaattctgcaaagcccctattacctaatgcctgtcccctaaacacatataaaggaatatctatcactatttcattagaaaattacacacacacacacacacacacacacacacacaattataaataaattattcaaaacgtggcagtagtgggatgcaaattaacttgtttttagtgtcttttatctccaaactgacattttgcaatttttctcccttgcaggttggaggtataaggtatctgtcacactgtctggaaaaaaggttacaggacacatactagtttctttgttcggaaataaaggaaactctaagcagtatgaaattttcaagtgagtaaaataatattgctctatgcttttttttttttttttttttgagtcggagtctcgctgtgtcgccggggctggagtcttgctctgtcacccaggctggagtgtagtggtgcaatcttggctcactacaacctctgcctctagggttcaagcaattctcctgccttagcctcccgagtagctgggattacaggcgcccaccaccacgcctggctaatttttgcatttttaattgagatggggtttcaccatgttggccaggctggtctcaaactcctgacctcaggtgacctacccacctaggcctcccaaagtgctgggattacaggcatgagccatggtggccagccaatgcttcttaatgttggaatactgcacatgtataatgtatgtcatcgacataagagtttgtctattcattactaaatggaagtagagtactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatgtatatatgtacacacttacatacacacaaatatatatgtatatatttacatgtatgctcatgtatgtttttgttaacttcttaaatccttaggggcactctcaaaccagatagtactcattccaatgaatttgactcagatgtggatgttggggacttgcagatggttaaatttatttggtataacaatgtgatcaacccaactttacctagagtgggagcatccaagattatagtggagacaaaatgttggaaaacagtaagtaatgaaaatcccaggagatgtgaaatatcgagtctgtgtttatagttctattcccactaaaagtctaatttaagtgaaacctcctacaggggatcgcctacatcctagttgcagttgcttcctaatgccttctgtttctttagggaaaagggtagaactttaggaaacagctttgatcaattcatgatagatgtgtgttagctgatacaaattaaatgttagaatgagaaaccggcttcatgattctaaggtgagaggaatgtttcctttggcagctgtgcttcgtgctatgtgagtgcttcttgtgtgcatcttccaaacttcccaggctcacctaattgctgtttaagttgctggaaacacagtgaatgtttcaaggaatagaaataggcttttccaaatcactggtcttcttagtgaagacgaaggtccaggagataattcttggtttcaaccaggactggagtgtgtgggagccaaaggatggtgaactaccaggaaaggtgatctggtgataatcataacaataccaatactagaccaagtatttctgagtattaggccaaattctgaggcaagcactgtgcttctgtcattctatccttccatcctcataaaaaccaaatgagaagactttgcttctggcaaagatggagtaacagagcccagatttactggcctgactgaaataaccaaaattcaaacaaagtacatgaaaacacagttttccagacactgaacattgaggaataagggatagtgattgctgagagacaaaaacggacaagatggagcctggcagttgccccagcttactgctccgagagatttccaggatgtgtcacagggaggagaaacccaggcagagttcagtggactccttaagttaaagaatcagagctaagaatgagaagatccagggaagtagatttcacaggacagcataccagagaggagagagttgctgagggagaatcccagagattatgaaaagtctccctgaatattcatcaaggtactgattgacccatgtatgagaacaaaccagctggaggtcattgaaatatccatttgatggattagagaaaatagttcccctacttttgcaggactgggaatggtgcttgtttccaccaagcagtctggaaaagtttataattcaaaggacacagggtagagtattttagaaggtcttgctttatagtggaaaataatttacctatattgaccaagatctgtaaagaaactgtttccaaataactgcattgcagaacaaaaaggtcaagaatatttataaagatccagaattatcaagtacctaaaactctaaaatccacagtatctgactttgactcaaagattcccaggtatataaagaagcagaaaaatacagcctataatgaggagaataatcaatcgacaccaaaacaaaactgacatagatgttacattagcagaggagaaaattaaaacagttcttaaacctgtatccatttgcttaaaaggtcagtaaaggcatggcatatacaggttaagtgtttctcatccaaaatgcttgagatccgaagtgattcagattttgaatttctttagactttaggaatagttccattatatgtaccagttgagcatcaaaaattaaaaaaaaatccaaaatctgaaatgttccaataagcatttcctttgagcatcatgttggcaatcaaaagtttcaaatttcagagcattttggattttttatttatttttaatatattttatttttccataagttattggggtacaggtggtatttggttacatgagtaagttctttagtgatgatttgtgagatcctggtgcacccatcacctgagcagtatacactgcaccatatatgttgtcttttatccctcgcccctcccactcttctccccaagtccccaaagtcctttgtatcattcttatgcctttgcgtcatcatagcttagctcccacataacagtgagaacatacgatgtttggttttccatttctgagtcaagtaactcaggaatggatttttttatttttggatttaggatgctcaacctatatagaaaaagacccacactgagtttctagagatgaaaaatacaatgtcacaaacaaaaaatgcacagaatgtaattaacagtagattagacattatagaagacaaggttaatgaccttgaatacataatagaaactttctgaaatgaaatacacagagaaaaaaatcttaaaaataactttaaaagaacatcagtgatctgtgggacaataataataaggcttatttatttgaaataagacccttttttaggtctttgaagaccctaacaaagaagggacagaaaaatatatgtgaagaaataataccttgaaaattttcaaacatggtgaaaactataaaccaacagatcaaagaaaatcacaagaaacatgaagaaaacagcacagcaccaatacacataaaaatcaaaatgctcaaaccaggtagaatgtacattattcaggtgattacactaaaaacctagattttaccactatacaatatatccatctaacaaaacttcacttgttcccttaaacttacacaaataaaaaaatgttgaaacccaattataaagacaaaatattgaaagcagtcagagaaaaaccacacattagaagagtaaagaaaaaaataacagcaaatttctaatcaggaacaatgcaagccagaaggcagtgaaacaacatcttagagtatggaaaggaaaaactgttaacctggaatttatacccataaatatctttcaaagacaaagatgaaataaagacttttaaaactgaaataattcctcaccagcaggttaacactaaaagaaatgtcaaaggaaggccttcaggcagaggaaaatgataccaggtagaaaagaattcactaaaagaaattaagaacacaggaaataggaaatacatgataaatacataatatttttaattcttattactaaattctctttgaaaaaattgactatttaaaaaataatgacagtattttggggagtaaataatatatgtataagtaaaatataacaatgacataaaaggcaggaggggagacctgaaaatatactattggaaggttcttataccatttatgaattggtatactttcccttgaaggtgtgataagttaaaaatatgcgctataaattctaaaataatgaaacaaataatgaaacaaccactaaagtaatgaaacaaaggataatagcaagtaaaccaaacaaggagataaaatggaataaaatataatccaaaatagagtataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccctgcccagctaatttttgtatttttagttgagactggttttcgtcatgttggccaggctggtctcgaacccctgaccacaggtgatccacctgccttggcctcccaaagtgctgggattacatgtgtgggccaccgtgcctggcctgtagcagcttttattgtaacagccaagaagtagaaataatccaaatgtctaccaatagaggaatggataaacaaactatggtctatggtctgtccatacaatggaatattactcagcagtaacaaggaatgaactaatggtacactcaacaatatggatgaatctcgagataattatactgaatgaaaagctagacaagagtgcacacaccttagattccatttatataaaattccagacaattcaaactactctatagtgacagcagagccgtggttgcctgggaggagtgaatattggagggaatgggaagaagcaattacaaagaggaagaaagaaaattgggggatgatagatatgttaataactttgatgttggtgatggcttcagaggtgtgtgtgtgttgtgtgtgtgtgaaaacgtatcaatttaaatatgtacagtttattccaggtaaattaaagctcaataaagctgttaaaacaaaaatatatatcctatgaggtagatggttttattatccttattttatggataattaattaaggtactgtttctgaatttctatgcaggaagtttgactctacaaaattcttaactactacaaaaaaattcagttcacctttaatcatgtataaatattggtgcctttcttttcttgtgtccctgattgataacagttttaacctttaatttcctatttgtgaggctgccagtcattgaggaagtgagcgtgaagggaaaaaaacattttctgagcactttttttctgttcctggtagtttacatatggtaaggtattttattaaagaaaaatattccaaagcatcctaagtattgttcagcctgttctttctttctttccttttttccctccctcccttcctttcttccttccttccttcttcccttcctccctccctctgtcctttccttccttcctttcttctttccttccctccctcccttctttcttttcattccttccatccttcctccctcctttctttctctttctttctttcttttcttctctttctttcttttctttctttctctttctttcttttctttctttccttctttctttttttctctttctctctttctttcttctttctttattccttccttccttccttcctttcctttatttgatccacacagggaaagaaggcatattgttcagtcacaatgagaaaagtttgtcatttcagttcaaatattgaattaaaataatggttagccaacgtaacaccagaaattagattttatacactgggctgatttcttatgatggtgactctgctgttcctgagttgcattggttgacatgggctaagtgttcagtgactgctcatgacaaatgagtctttctttttctttggggcgtctactgacagcttctctctcagctattgcacaaccagaaaataacactggaaaggagaattcagtcctttatgtagaagaggtcttccctcagccattgtctggtctccagcacagggtgcgcccttccctcagactaggaggttgggggcatagattgtcctcactgtcacactccagatatgtgccaggaagaggaggtgactttgtgttgttttttctccacaggttcaacttctgtagtccagaaaccgtcagggaggaagttctgctcaccctcacaccgtgttaggagactactgttatttgaccaatgaattgacttctaataaaatctagtggtgatgcattacatgcctgtttcttttgtccaaaacctcgattgtttcaagtgaatctgttggatgaagtgactaaaatccaaaatttggagttggtcaaaagaaccaccaatggctgttaaattttgctgcatatttgaccttaagaatgttgtttacatggtactgtcatcatgttcattatcaatattacttatgccattctggtcacttaaggcagtcttccatgtccaaaatgaccccctcttggtgggctcacatggaaagactcacaattgccactttttccataatctttaagttctgtgtctgctcctaatcagatatctcaggggaaatgacacacaaggagataaggactagacagatccaatgctccctaacaggtctacctggtctatgtggggctcccccaaacccctcacttctgcagcctctttgatttttctaaagcgcaaataaatcatcttcccagtggtccccaggacagaatccatattctttagtaagccttgtgaggtccctcttggtctggttgtctccttggactctagcttcatctttcactatgttccttctggaactctacattctgaccctgtcccccaagagggttgtcttgatctctgatgctgctggatgttgtcaggaactcttcttcttcctgggatgttcttttctctgtcttcctgtctgttaagctcctactggttcttaaatctttttgtagacatcacttcctccaggactcacctccattatccatacccactaagacttgatgaggggcttaccactattatactcccaccacacccagacattttgccgtctcaacactggacttcccatattgtaattgcttgctggctcacttctctgtgtagcccatttctaaactccttaaggagttttcccattgtatgtgcctggcacatgcctggcatatagtagaagagaaaatatgtattttttgtatgactttcccactaatgggaccaacgaatgagtccactagggtcaggtacttaaaattaggccatgtctaaacaatacatcctaagaaagaaagggatatttgtgttaggtcttaaaagttgagtagggatttgctaagaggacatggtggaaagggcactccagagacaaggaacagcatagccaaaggcacagggctatgaaaaattgaaaatgccatttattctgtatttcaccaaaatatatgaagttaatcaacacacaaagacttgttaaagggccacccgtttatattaattaggatgtttcacttgcatgaatcaaaatctccaattcaaagttgctttaacaacaaggaagtgtttggctcacatgattggaaagttcagaggtcgaggaagcttcaggttttgatgacccagtcactcaataacctcttcaaaagccactttctttttctatcttctgatatctatggtgctagttctataccaagtctggctcccttctcagttgaagaatggccatctcccacaattgaggctataaacatttatttcacattcaacaaggagagaaagtgcatcttctttcctatttttttctcacaaaacttgtgagattcactcttattggcccctgaccatgggagtagaatgtgctgattgtcttaagtcaatcagtgaacactcctgggcaaagaacaaggccagcatcctcaatgtacatgaactatatagagaaggaattgatatctaaatgaaaaagggagttaagaatgactcatgggtcatcattacaactggaaggatggagttgccattgcctgaaatggacatgctttgagaggcacgattttgaagaggcaggtcagaaggtcagttttagtcatgtcaaatttgagaggctcatcaggcatgcaactgggcatggcatgctggcatttggatatataagcacagaagtgaggacagaaatctaggttagacacataaactttggcatctttagtctatagatgtcatttttaagca

SEQ ID NO: 13987 - DNA, 6052 bp, Human
actcatccatatataaaatgatatgtgtaaatccagccgggcgtggtggctgaagcctgtaatcccagcactttgggaggccgaagcgggcggatcacgaggtcaggatatcgagaccatcctggctaacacggtgaaacttcgtctctactaaaaatacaaaaaaattagccaggcgtggtggcgggcgcctgtagtcccagctactcaggaggctgaggcaggagaatggcgtgaacccgggaggcggagcttgccgtgagccgagatcacaccactgcactccagcctgggcgacagagcaagactctgtctcaaaaaaatagatagatagatagatagatagatagatagatagatagatagatagatagatatagatagatagatatagatatgtaaatccaaggaaaatcaatttaagctgaataaaaatattggaacatctttgttaataaagaagaagttgaaaactggagttgctctggcatgcgctgtggcatccttctgccttgtgcctcttaggcactcatctgcggggctcaggggctcagtgaggcctacactgacatctacccctccacttcctgcactaattcatcttacctggctcacctgtttccttttctcattcttaccctggctaacatactagataatttacctataattattatttgtttcctgccccccactctgcaccactgtgagctctatgaaggcaaggatagtattttgtttttttctggttctgagaaggtgctcaaccaattgtggaaggaaataatgaatgtctcaaaggagagaaagaaagctgaaaaggtcctgtattctctcgcttcctcctagtcgtcccagattaagataccccccacctttgcacaatctacatctcagcactatatacaaaatctccatgaggtataaatgttcaccggtttattcatccgcagaatggttttacacgtacatttataaatccatatgcctgttgatgttttgcatgtgagatcctttatttacccgagagctttcatcaggaggaatttagctcaatatttgtgagatcataataggataaaagctgatgaagatgagctccatcctatagaggctatttcctctatgagtggagactgtttttcccttccctgaaggaaagaacagcagttgtttaaataatgaataaagctaagcacttaaatttatcttcaggaaggtactggaagaagaggaggagcagagtataaaaactacaagtatacctttgcggggggaacagccagttcaaaatcttcccaatcagcagttatactttaattttaatttcaagttttcttaggattatgaaattaaaacattctgttcttggttattttcataagccttaccatcttgaaagactccatcctctgcccatccctcaaaagatcaacagacggaaatttttctttagaaagcaaactatgttcttttctttgaaataactgtgatagagaaattattcactttaagtagtcatgcttctaagttgcttgaaggtgattacatatgaaccttcatataaacatgtatctctctcatttaaaagaaaagaggaaggaaaggaattagcccattaattatttaaaatacttggtgcaactgttcctatgaattaatccaggcacttggaagacaattacactccatgttaataacattgccaaccttttccactatgctgcactccaaatactattgtgttttcattgacaacattccctattacatatgcatatgaaaaacaggcattttcatcagaattactgtaatagcattaagagattattattttttcccatttccttggaagaaaatttacttaaattagattatttattactcgactgctctcgtatcttgcctgtatgtttaggtaactggagcccatgaaagtataaacttcagaataaaaagcttgattttatacattaatgatttcaaataaaagataagtgccacatttgtgcatcacttctttagagaaagttaagtctgtgttctgcttaggagagataacactttttgtccctgtaggtggcccccctggtgtagccattagttgctaattacttgcaaacaaataaacaattaactccttaagctgctggctgggcaagtgttcattgacatgctaaaactttctaagacaggattttaattagtgacgttctaaatccagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcaggtatgccacagcttaattgtttcaattctttgttatttcatttacagtgtttaatttgccctttatttcatactacatagagctagagtttaggactttaatttattattattatttattattatttttttttttctgagacagagtgttggtcttgttgccaagactggagtgcaatggcataatcttggctcactgcagcctccgcctcctgggttcaaacgattctcctgcctcagcctgccaagtagctgggattacaggcatgcaccaccatggcctgctaatttttgtattttttagtagaggggggtttcaccctgttggtcaggctagtctcgaactcctgacctcaggtgatccgcctgcctcagcctcccaaagtgttaggattacaggcatgacccaccacgcccagccagagtctaggacttttaatgcctccaactgagtcctatgggaaattaaaagaatatcagctttggattgagcaaagtggataaattcactcacaggaaatcccaagaacctgcatttacttcagaagatctctccctgtttgacacatcagatatttgaaatctcttttcactgaaaaataaacgacattcagagaccaaagaggcaggattaccaagacaggatcttcattttttattggtttttggttaacggggtgcaattctcttgtgaaccccagaattccactaggaaatgaaagatgagttcctgaaactacctctatagaactttgtggaacataagattgaccatctaagacagggcttatttttttgtttttagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccaggtgggaagttttttcacccaataatgataatataaaggctttaattgacaccaagttgagcaaaagcccactcactttggtatctcagtttagaagccttattaatgaaacagtagactaccatattttaacaatttccaggtaatcatttttaaaaaggcatccagattaattgccaagatttaaatgtagtcattttactctagaaattaaagctcatttttggagacatactgaatatcaacatttttttttcttagattgaagtgttagaaaatgtctttagagtaaactgctatcctggtatcgatattagagaagacttagctcaaaaattgaatctagaggaagacagaatccaggtaattttcaaatttagttgttattcatgatgttgaaatgttaagaataataaaataatgtttctgagacctattttatttttccttaactttagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaatagactcatgactaagtgattccacaagctggattctaattataaagtatttcaagtaaaataatctgaagaacaaaagtgtgagttgttttcattagtttcttccatgcacattttgaaacataattatgcttcactatattataaattatgatttattcatgaatcttcaacttctcttgatttatagcataaagcagtgagaatttctcaccatttatcagaacaaattcttacagtatgttagtttcaagttttttttccaagcaaagtcattatgccaaagtagaaatatacaagcatcagctatcatatttataccattggtattgaattgcacaaaagaagtaagcagcaaataaatgcaaaattttaaatagttttctagtttaattttgtactttactttcattcattagtgatagtgatcatgtagcttatatctatttccagtttaaatgatttctaatcaactgcaatattaagttgactgagaaggtaggataactgacccaccttttgtaagtgctctgacatagtcactggaaataatcaaggtgctttctaagtaacaaaaactatgtgttttcatttcccattttcccattttacctgccaattaaagatggggggctgggcgcggtggctcacgcctgtaatcccaacactttgggaggccgaggcgggcgtatcacgaggtcaggagatcgagaacacggtgaaaccccgtctctactaaaaaaatacaaaaaattagctgggcgcggtggcgggcgcctgtagtcgcagctactccggaggctgaggaaggagaatgacgtgaacccgggaggcggagcttgccgtgagccgagatcgcgccactgcactccagcctgggcgacagagcgagactccgtctcaaaaaaaaaaaaaaaaaaaaaaagatgagaataggataagatatataacaagaagggagccctctcggctggaaatctgggcatttgttttccagttaatggaagacttcagtgggtggttttttttttttttttttttttttgaaatgtcagcttaaaactctgactttgtccactggaagccaaatttcagctttgtccatttgaattgaattctcccttgcttctcttttctttctgtcctctgtcctttctgatgtcccagggatgatcaagggggaaggttctcattgaattattgaatctataatcactattttttatatataaaaaactaaagggagtttgcatattatttctaaggaaacgcagcatgactcaaattttaaagctttttaaaattatttactgaaagcacatttgaggttgaaagctatgtgtcccaacaattggtcaacaataagcgtgcttattctattccactgttgctgaaatggagagggaggaggaaaaaaagggcaacagggtagttaggaagaacataggcattacatgttttccaaaaaagactgagccactttttccaatataaagagctgcttccattcatataaaaattggaagcactatttatgaaatgtattagttcaaatttatccacaaagagttttctttgttctccattaggttattatgaaattatgttaaattgaaagactggaagttaccaggagtaggctctggaggagtgggttggaggggaatgtgtcacatgatgggtaagcttttattttaattccaaatttattgtcattctg

SEQ ID NO: 13988 - DNA, 6093 bp, Human
taattttttgactcgagttttcattttcacctattgaattctttccctgaagtaatgtgtgggaaatgcccaattctatcctctcattcgaggccctgctttatatgcaaagtaaaccctttccaggacggatcgactggggaacaggcatccggcttccaggggtagcccccattgccgggctagcagccgccttccaggagtgcctcttgggctcttcggaggtcgaccttaggccagtcctttcccaattttttccctttgtgggaggagagttcaggaaaaaaattgaaaagcaaggaagagactaagtcattactagattcctactggaacactgccaattgccacctccccactaagtcctgaaccgggtgagcctgcattggccagggttttacagatcttgtaaacagtctccagaaatccatccaaatcacgtaaatagtctttcttcaacctccacagaattgaggattttaaagctaattcaaggggttttacaagcccaacaaacacagttgtaaaaatgccattgggctgctatcacattttacaaaacgagattgatccatgtgttgtaaaagtcaactatctcgaaggcacacctctcaggcaagagtgagcagctcaggacaggcttttaatgtcctgtctggggaccgccaggcctgggacagcagtgaaagcaattcaggatttctggagctggtgagactattcccggttccggagcgactgaggggcggcagccctccctgtggtcccaggaagggcagtaaagagggcggccccaggacagtgccggttgtcgggcgccccggaaaccgagcccatcaattatcccgcggccttgggccctgcagagctgccctctgtgcccagcttggccagggcctctgcgtcttctgtgcctctggaatgtggacagagagattccacatctggatttttatctgcctcagctctgagcggttctcgcagtggatactgagtccccaggcgctaggcaggggagcaggtccctcggctgtcttaggagcccagtctcacggccactgctctgtcggtcctttcttgttgaaaccagtggtttctggcctttcaattccctgggttcaaaggtgggatggggacgcccagctggaaggagtgctttgacaccaggcaggcgcgggccattgagccccttgggactcaaacaggatgtgtatgtgggaggagggaatgggtgggaagaacctacgtttggctgagtcctggtcagctcgaggtgatccttcagctctgggctgcaaggcccaggcccctggtgctagcggagaaggagagaatgagggagttcaccgattcctaaggcgcacgagtgaagagcatagagtgaaggcctggtttctcatggcccttgctccagctcaagaactcgcacccacgaataggggagcgctaggggaggggcaactctgggccgtgcctggagtgcaggccggcagggagcaaagccacctttgtcactgcccctcctggagcaggaccttcaggtttcctgtttggaggaggaggggcggggaacccgcaaaattcaataaagcaaaaaggggaggaggaaggagggaacctggcggggcctttgaggcggcccaagcattagtgtccctactctggcctgatctgctcgccactgaaagggccgtgcccgccgctggcgttcgggaagagagccgggccggctagctgtgcgcgcccattaatctgccgggcgggcggcgggcgggcgggctgggggctgtttgtaactttgctgcctcggtcgccgcggtccccggggagcgggctccggcgttcgctcccattggccgccgccgcgtcagctggtgcgatttgctgctgtcgcttttggcgttcggccatccagaaacaaaccagttcgatgactactaatagttatagccagatgtactaatacacaacaaatcacagtcctgcagaggggcgcgcaaatgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtaagacatatcccaagacagtggagggagaggggaaaggaggcaggaaaagaaagaaagaaggaggaaacagagtagaaagaggaatagagagaaagaaaggatgaaagaaccagcaaagtttctttggcttcttaaaagagaagaaaaaatcagttcccaatggggctatcaggccatggcagaggaagggcaaggccccagtgtccatgtaagctgacaccttaggggaggatgggggcactggcacgtatatgagacctgtgacagggacagcctgaagagagagagaggctggtggggagggacagcctgtccatgcaccctgagtaccctgctcagcttcccaagccagagggccttttgcactgcgtcactgataaataccctttgcttcccaaccccctctcctttctgcccttcagaaacccgtacagagaggtggccatttggcctcttccagtgtctccccaaagccttggagggccacagccccagactcaggatttttttctctctcctccctcatctcccccggcttctactcaactgcccactcttagccaacttctgccctcttctgagcccatgcctgagcttcatacacctgtcttggagggaccccccaccacccttggggaactttggcaccagatcagacagcccaacacaatcctacattgccagaaatcctagactacctatagctccatctcttagcctctggtttccaaggactccacagggaatcccaaagactcctaggaattccctaggacagagcctaatgcggattgttaaaattataatgttttccattaacatccactttatccttgggggagttctgcatttctcagaagggtcatataatttgggagaatgtgtaaagattcaagagggctgaccatttttaactcttcaaaaaatgtgttgagttccgacatggctggtcacagtagcatcctcagagagaccactatgaattcagagtgtgtacactacttacatggttccacaccacccaccccagacacacacacacacacacacacaaacacacacacacaccctgcatccccacaaaaacacgacctgggcatcccaaattaagaatgctcattctgttattttgcttgtaatggttttcctatgaggcagatttttcaaaaacgataatgtccaccccaagtcgttataggtggaaaacatctcgcttggtatgaaataatctcccattcagtatgctttgggccccagacatagtgggagaggctggagtggaggcggggtggtttctagtctgggtgcctcttgtgggaggcactgggctgactgggtcaaccctccaggccctggcttaccggcgcccggccgtttctgctcgtaggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccagtcccgctccacaaggatgcccaaaccggctccggagttctggggtgcgccctgaatgcgtctggggctcctgtgctagtgtctctgagctccccgacctcgggacgcggggctgctggggaggaaagagccctgggccgagccccgtttcgtgtctgggcgtctctgcctaggtccctcgccagtaagtcccgaagggcatcatcaaatcatctctggccagtggaaagagggggtctaagagctggagcccggccttgtcgcggcctcccaagccgcctcccagaacaggaaggaagctcgaggaacaaagggggccccaacagagcccagtctctcggtcccgcgtgtgcaaccgtcagtggaagagaagcagcctcagccgaggcgagttaacctgggcgcgggtggaacattacagcccggggtaggctcccggctccggattcccgctcccagcctccgatagcgcccgcgtcgccgccacagcagcgttcaggacccaacgaggggcccagggccatgggagccgccagagtcctggcttccagacgtgccaggggcgcctgcaacgccgggcctccagcggggagactccacttgcctctcagctatatttgtgatttacttgagtctttcggagccgtggaaaataactacagagatactaggcactgccaaggaatgcttccattatcgccctcattttactcctggaggtctaagcaagaccccagtaacccgccccacggatccccagaccccaggcagcctctgtggctgcagggagcctgggcccactcgctgggttcaaggagaaccctccgacttggggcccggctggctcgaggaaccggaccctgtgatgaagattttccaggctggatacgtaagcaaatcaaatcgcaaactaatgacacgaaaaccatattcacacgaaagaaaaatcgactacggttataaaagtgtatggaatttgacctcgccttggagaaacactacacaaaagctatctttaatagacgcctgtcatttaagagcggcagggacactgtccctcatgcgctcgcaaaaacagagccgtaattgtagctgctgctgctgcgggcaggatttatttctccaattggctaaatggctttcccccttccccgaaggtgatatctgtattttcaaaattcagagctgctggcaggacggtcagtaccgaccccaacctcgacacaaaaataagaggggctgcaaaacgggggaaataaagttgttgtaaataaaatgcaagtcaccacctccccccaatcctctgcatcctcgccgggcgcgcgatcggcagctgacggcctaacaattggtacatcctaatggaactgcgagggaaatgcaataattttgccataatgggctgtaacctcaattcgaccccggcccttgcagcccccggtcggaagctgggcgatgagccctgcctccagcgggtggcgctcgagtccggctgaacggcggcaactggcggcgggcacgcgcccggggcgcgcgcgccacccccctcgcctccacccaactcccctattagtgcacgagtttacctctagaggtcatcaggcaggatttacgactggacaacaaaagcacgtgattcgaagtcgtaccccatatttgggtgcctacgtaggagggaaccaagtacatgtcccagtcatttccataattcatcataaattgtgcaagggtgctataga

SEQ ID NO: 13989 - DNA, 5774 bp, Human
ccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccagtcccgctccacaaggatgcccaaaccggctccggagttctggggtgcgccctgaatgcgtctggggctcctgtgctagtgtctctgagctccccgacctcgggacgcggggctgctggggaggaaagagccctgggccgagccccgtttcgtgtctgggcgtctctgcctaggtccctcgccagtaagtcccgaagggcatcatcaaatcatctctggccagtggaaagagggggtctaagagctggagcccggccttgtcgcggcctcccaagccgcctcccagaacaggaaggaagctcgaggaacaaagggggccccaacagagcccagtctctcggtcccgcgtgtgcaaccgtcagtggaagagaagcagcctcagccgaggcgagttaacctgggcgcgggtggaacattacagcccggggtaggctcccggctccggattcccgctcccagcctccgatagcgcccgcgtcgccgccacagcagcgttcaggacccaacgaggggcccagggccatgggagccgccagagtcctggcttccagacgtgccaggggcgcctgcaacgccgggcctccagcggggagactccacttgcctctcagctatatttgtgatttacttgagtctttcggagccgtggaaaataactacagagatactaggcactgccaaggaatgcttccattatcgccctcattttactcctggaggtctaagcaagaccccagtaacccgccccacggatccccagaccccaggcagcctctgtggctgcagggagcctgggcccactcgctgggttcaaggagaaccctccgacttggggcccggctggctcgaggaaccggaccctgtgatgaagattttccaggctggatacgtaagcaaatcaaatcgcaaactaatgacacgaaaaccatattcacacgaaagaaaaatcgactacggttataaaagtgtatggaatttgacctcgccttggagaaacactacacaaaagctatctttaatagacgcctgtcatttaagagcggcagggacactgtccctcatgcgctcgcaaaaacagagccgtaattgtagctgctgctgctgcgggcaggatttatttctccaattggctaaatggctttcccccttccccgaaggtgatatctgtattttcaaaattcagagctgctggcaggacggtcagtaccgaccccaacctcgacacaaaaataagaggggctgcaaaacgggggaaataaagttgttgtaaataaaatgcaagtcaccacctccccccaatcctctgcatcctcgccgggcgcgcgatcggcagctgacggcctaacaattggtacatcctaatggaactgcgagggaaatgcaataattttgccataatgggctgtaacctcaattcgaccccggcccttgcagcccccggtcggaagctgggcgatgagccctgcctccagcgggtggcgctcgagtccggctgaacggcggcaactggcggcgggcacgcgcccggggcgcgcgcgccacccccctcgcctccacccaactcccctattagtgcacgagtttacctctagaggtcatcaggcaggatttacgactggacaacaaaagcacgtgattcgaagtcgtaccccatatttgggtgcctacgtaggagggaaccaagtacatgtcccagtcatttccataattcatcataaattgtgcaagggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatggtaaagccagcctttttctaaatccacgcgaccgcggggacgcggctctcggtcccccctctcttctctgccgccctctcccagtctctcttggtctcatttctcccagccctgcggagctctccttgccgttctccctcccctgccttcctccttcctcctcttctttgcgagcaccctgcgctcacaaatagtgggggaaatgggcgttctctgggacagtttagacgttggaagggggaggaagcaaaaaacccctctggaaccccacgccttgggacgcgctcccgggtcaggccagccgagcaaggcgcagagaggtagaggatggctgtagcagccgtgaatcgggcttgtcacggcggataatttatgaggagggctacgctggggaaacagcgttactaattacagcccccaaaaaggggcttgggggaaagaatcgaggcgagagcctgcaggattctgaattttgggggcaggagggagagagaaggaaagggaagaaaaagaaaacaggctccccaaccctgcaggctggaaacgggaggcggctctcggggctggaactttgagggagggtgacccgaaggccacttgggcgctcaggaaagggccttgcttcctgggtttctgtgcggtgggcagcctgggagggctgtgcctcccgatcggggcgcccggggcagggcggagggggcaggagaggggccagggaaagccggagtccgccgggacacggccccagcctcagatgggcagattgttcccagggtccaaatcgtattgttttctttctagaaaggaagagagaaggaaattcgggaggggtgtgcgggctggtaggcagaacttgttgagcttttcgcctgggttccctgctcatgacccaagcttgtccccctggcggactttggaagacaggagttggtggctaaaccgctgacttttctattgcagacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgtgtaattaatgctgttgtagaggtgacttgatgagacacaacttgttcgacgtgtagtgactagtgactctgtgatgaaaactgtgactccaagcggtgtgtccctgcgtgcctttataggaccctttgcacgaactctggaagtggctcttataagcgcagcttcagtgatgtatgtttttgtgaacaaagttacaaatattgtccaagtctggctgttttaagcaaactgtgatcagctttttttttttttttttttttgtatttgtttttaaggaaaaaatactgactggaacaaaaaataaactttctattgtaagttctcttggtctggtttgtgccaaatagtgagcggctctgtctgcttttctgtctgtctgtgcagtcttggaagctgttgggtctgaggctacctgagcagatgacctgtgcagggagacctcataccaacactgtcccatcgcttccctacctctgacccattgcaaagttcagggcagaaggtggaaaaagctgtaggctgttccaaagccccagaacaccctgtccatctctgaggaaaccaagttaacttgctgggtacaaaaaagagagaaagagcaagaaaaaagaaaaaacccagggctttgttagccgccctcaggccacacagatcctgcctctttcctaaggctgtcctaggcctccacttgctgaagacgctgctatgtctgtctgtggaccccaaaccctctgcccttaacccatcccagcaccccttccccactcttcacccgggacccagttggcttcttttgctacaattaatttgctacaaattgaaggtacttaccccatcctagctcgattgggaaactcctcagagcagctaaagcgcaactagagatttgcacatttaccgactgcttacactgatgccgtctttccttttaaaagttataaaacagtaaactttataagccccagttccggctatatgacatttgggtgccaaatgaatagggttttgtctatgaattagatcgtaaaatcatccatagcacagacagatcggctcactggctataaaacgtcacgtggggccattaaagtaagttttatggttttggggagttgacatccaacattatataccacataacatataatctcactaacgctggactccatttgactcttttgcaggctacgtgtgccgcctggccattcaaactgtcaattttaggtccagaagtgtccaaaccacaagttctcaaaactctctgaaaaatggctccctccgagttaaggtaagctcgcctcctgagcgctttcaagtttatttgtactttggaaactttctctctctctctctctctctctctctctctggttcaataactcaggctgcctctgaattcgaaaaggcagagcaaactttccctctgcccaaaagagcagcgccaggagccaactctgcggaggcagcagagtgagcagcgcctgtggccgcgccgcatccccaggcctaactttaattgcagcacaaccgcggatgttaatga

SEQ ID NO: 13990 - DNA, 20566 bp, Human
ctgctgcacaggatctcccaaaggcctcaggagtctgtgatcagccaaactcaccctgcacccacaaggtgggcaaggagaggctgagggcctggaagacccaccccagggagctcagtgtatggactaggagggcacagtgtggaccacagaaccctcaggatgagcagggacaaagcccactgaccaagcaggggaagtcacatctcagtagacaaaactatttccttctggagcccaaggccagcacagcatcgtgacaaagcaagaccaaaataataatgggccaccccttttcactgcctcagcagtaacattgaccaccccctcacccaagaccgctctctccagactggaccccaggggagagaagggagacaaaaaggaagggaactccataatgaggctaaattttaaatctggagtgaagtgactgagagatcactgaattgggctgagcttgcctagaagtgactaggtaacttgttttcttttatcagtcagattatgggtttagggtttgaaattaagctacatctggaagccatcatcctcatcaaactaacacaggaacagaaaaccaaacaccacatgttctcactcataaatgggagctgaacaatgagaacacacggacacagggaggggaacattacacatccgggcctgttggggggggtggggggagggagagcattagaactaatagctaatgcatgtggggcttaatacctaggtggtgggttgacgggtgcaggaaaccatcatggcacacgtttacctgtgtcacaaacctgcacgttctgcacatgtaatcctggaacctaaaacaaaataaaaaaagaaaatctaagtttgcaaaccacaaaaaaagagagaaattaagctacataaagaaattatggggtttttttgcttgccattgaaatctgtgattgtgtgttaacacccacaagtgagccagtggttagctaaaataagacccagggctctggctgccttgtgtttctccagggctctatttctctatttttccttccccttctggtgtttggcctataggactctgtagggagagcctgggtcagccctgcacaggtaggatgggcagcatttctgtgggggtttgcagtgaggggtcggggggccatacacgtgtgtgttggggagtgggcttcacttttgtcacaggactgccacgatcatttggggaacacctgggagtcccaaccaggtcatgttttggcatggactaacagatagggaaggaggtgctacttcagctcagcaggtcagcaccgtccttgctatggagccgagcccgggtcctaacaagactctgaggtcagccatgttcaggggagcccagaagcagcgagtctttcatgactctggggagtgaaacaggaagggccacagtcctgccagttcctggagctctgggactggtaaaaggggcttggcaggaggtgtataaggggcatttttgtccaggctaagtaacctagggagtcggaggggattccagagcaactggggatatgagaccaaggactacgacagccactcctgccacctgtgccccatcagatgatgtcaacttcaaatcaagcattgggccaggtattttagagctaataccgggctatatcctctacctgtagatttggtattaccatccctcttttccagatgaaaagaaataggaaggtgacttgccaaaggtcttgcagctagaaagcgacagaacagcatcttcacgcttgacattctgtccctcatcctgaagctgcaacgatggaggattcccaagtaacagagtctccccaaggtcaaaggaaaccaaatggagccagccaggaaggccaaaatgaaaggaaagcaagggatctgtgagagtcacatgaccctggctggccacggtgcctgtgggagagtggccctttaagagcccaggtgtgggtcaaacactgagcagagtttcagttttggcagcagcgtccagtgccctgccagtagctcctagagaggcaggggttaccaactggccagcaggctgtgtccctgaagtcagatcaacgggagagaaggaagtggctaaaagtaagtgttactgctctgggatccccagacgggatgctatctggaaagggctcgggacgatggctcaggtaaccccctccattcccaactcccagtctcctagatagtggggtgacaaggacaaggaggcagactgtgtgactgtgtgtggctggggagtaagcgtgcatatcgcagtgggacgagtagggatgcacgtgtgtggaagccccccatccttttctgagaaatatcagcaggtgggaagggacctctgtggtcagcatatgtaattctactctttcagcttggtctgtgcctggatttcctaactcctcatagttgattaactgtgtggccttagacaagccacctaacctctctgatcctcagtttcttaatctgtaaaacaaagatagaaataacacctatcattcagggtcaatgtgggttcaaatgagaaaacacaggtgaaatagctttgtaacctctagaatgaaataggaattgtttcatatttttcagtttagtttaattaatcaaggatttattgaacaccaacagacctggaattagatagtgcgcataaagtatggcacctagcaagtcctcttccattctttgaggtttcccacttgtggctttctggcaaaggcatgttcagctccttttttctgggcttccaagaacctctgaaatcctttgcaattccacctcgctttgctctagcagattcctgccatgggagacataaatgtgtgtcatcgcatcatcctgcccttcctagaggtagaaaaaaagaggtcctcacgggatcactgagtgaggtggagctgagccccacaggcagcatgatcaactcctgctgttcctcctggctctgcagccagcagatctcagacatgggcttcccctccctttgcccatcctgacagcagcccaagccagcagtgggaccgtccggcacaagggcagcagcgggtcaagctccatccctgacccccagttccctttgtgcaattgccacagtgcctggggccattgaagctgctcctattttgtgccatcactttcccccttcactaggggaattatagatcctttaacatctggagaggagatgccaatttcaggggtttaggtagaaggcagctgtctggtgcctggacataggtcttcccagagccagatctggaattctctctccatccttgtcccgcccctggatgtgctaaagtagcagaaagaacactgagccaggagtcaggaaagcaactctctctgcttatctcctagtgccgctagacctctgtggctttaggtgataaaaaatggggtcacacaggcttccatttagtaaacccacttgccctgggctttcacaccttcgtctcattctcccttgataccaacgaggaggtaggcagggttggttttgtgatgtcattccctagttgaggaaaccaagacaccgtgagtctatgtgagtggtgtgaagtcaccagcaagtttgaacgatgaggttttggtacagccattttgatatggtcatgaggacattttgatgtcacctaaaaagcaaactatccaacttaaaaaaaaatacctatgcattgtgctcagcagagaccttcatctatgtcttgccctctctctggaggggctggggctggagtcccaatgtcactggcatcgacacagtatggtggagtggaaagaggctttggcgtcaacatgcctggttatacccatggttatgtaacatatcctacacatggtaggtgctaaataaatagcagctaatattttccaggaagaaatttctctgttggcacctacctctgggtccaggtgtctcttcattttttaattttttatttttttgagatggaatcttgccctgtcacccaggctggaatgcagtggcgtgatcttggcttactgcaacctccacctcctgggttccagcgattctcctacctcagcctcctgagtagctgggattacagacccatgccaccacacccagctaacttttgcacttttagtacagatggggttttaccatgttggccaggctggtcttgaactcctgacctcatgatccacccacctcagcctcccaaggtgctgggattacaggcgtgagccactacgcccggccccaggtgtctccttataagaactgccttttccgtgaaaggcagagaggaaagaactgaacaaattctcagttcgctaagattgaatatcctgcttcttcctctctccactgcttcctctcaataggaagaccctctgaggtaaagcagagtggctaagggcctatgctcttgatctagaatcccatctaagtcacttaccaactgtgcaaccttgggcaaatgtctcacctctctgtgcctcaattatctcactcatgaaatggggttgcccattttgtcccatctcctatggtggctgtaaaaatggaacacattaacacatgtaaagcacctggaaaggactcagcgtacgttcttctagcctagcccatagtgcttgtctcctctcttatccacatgagtccaacctaagtagctcactctccatctctctatcttcaaaggatgtccagcaagcagacttctactctcataccaagtccaggggacctttcttcctctgaaaaagagggaaacctgagattagatggacaaaggtttggactccacaccatgagagatgaagtgcagtcactttaactgaacaggagctagttaaatacattttataaaaagaaaaactatccttcagcacagcttacactcctgccccaatccacaattgtggggacatatgttacacatatgttgggatactaacttagtaaactgaaaatgatctagcacatcctagcctcagcagtgaaaaaacaactgctagtttaaggaccagaaaacgtgccctcatgcatgatataatatcatatatataaaacccaataaagcaggtccctttgctcatttaaagagtgataatggggtagtgacctcaaattaggattctgctgtgggtcttggggtcgagaatccctataacccttagatttccaacctgtgtcatgaggataacaacatctatctcttgggttgttgtgctgatggatgaagtcttacaagaaaagaacctagcaaagcatttggcacgtagcaggtgcccaacattatgttctttttcttccttccttaagcaaatcctttaaatccagccccagccaccctgggctggggaggtctcccgagatttgaatccccaggtttggaagaaagtctctggttttgagaggaaggggtctgtaatgattctgaaagctcgaggtcctttcaaatgctactagagaaattgtgcttcaagttttagctttgggcaaagaagagctcctgttcctgaaagcaggggtatcctctcctgccaatcatcccatctaggactggactgtgtgcatcccgctgatgttgccatctgcccgacctgcctgtgcatgcctgatgctctcatccctggcttgagaccatgcagagggtaatgggtgcacacacatgtcccctctctacacaaacatgcacagccacccaaacatgtcacaaaatgagaagtctgggacagaggtcagggtggtcttcaccttggagaagctggcatctgactctctgcaacccaggccaagtccagaggagggctgcatcccccagctcagcttgtgggaagaccactcctgtctcacgcaaatatgaggcagcttgcttatctagaggtgaggacaggaacaagaagcaaggacagctgctgctggtgtgggttcttaaaagcaggcagcattttgtcctcccacctgtgactgcacccaccctgtgccagcacaagtagaaaatggtagatctcccaggactttgcagccagcccatcccaactgtttctgagacttcctggcctcctgaaagctgctcccacctgggagcatctcccatggcagcttgcagtgcccacgcaggtgatgacatcccagctagtgtcccctgattgcttccatgttggagctgactggtatttggccaaggccccactccaggcattaatcattgacctggtaagaaaggtctggggcaattaaccggactcaagagagcctcaacgttgccatctgacacccatatttgttcccactccctccctttattcttccaaagaactgcagaaacaaaatacctttatattcacaaggaaataaaaggttccttgctgggaaattcccctgcaacaaagaaataaccaagataaacaactctattgcctttggctcaagctggtgaagggagtctgggagcaggagcaggggccagggtggtgagggaggtctgggagataacgcccagcttcctcctgcttacagcgtccttatctttatgggcactcattactgcccaaacttacgatcatttaacactctctttgtcaagacaactccaaagtttaaagtctgtcaaagtctgggaaagtggagacttctgtctcctcctctaggctgtagttggggtcttgatgacagctgctgtcaggcagacccctgggaccctcaactctcctcagccctgggctgtgtccacggtggagacaaagtccacacaggctgctccgtctgagtggtctcatcttcgattcttcatctttgtctgccaggccttaccaggcaggattacaaagaccctaacacctaagcttttaaccccaattccataaccaagttgctgggaaaacgtaagcctatcattcagcatctcaagacctcaatgttttatccataaaatggttgtgattatacccgtctgtcttatttcaagggaacatataaagctcaaatgaaataatgtaaatggtagtgctttcataagcaacagggtctctacaaataacacaaataagcataaggtaaaagcatgctcttgtatttggggtgcgatacagtagtggagaggttaagcacatggactttgcagtcagacaaaggtgggcccaaatcttccccgacccccattctgtgtacccccacacatttaaccccatgtgcccttgaggaaagtacttaaccttgaagccttcatttcctcccatgtgaatgtggataaggatactaacctcacagggctgatatcaagtctgtatgagatagtacacataaattattcaacacagtgcctgagacagaataagggagcaatcaatggggttaggaccatcatcattacatttacagccttaataatcatgacacctcctctgtgggtctcagtttcctcatctgaacacactgtgaaatatgtcagcccgcttcacctcccaggaatgtagggagggcagctgaaacagagagatgggggccacgtattggtaggaaccaatcacccagcaagccattcctgagatcttacggtgtgcctgggactgtgtctcatgggcagggaaacagagcaaatgacacaatatctctatcccaaaggagcttgcagcttagttgagaagacaaaagctacttctagctattaaggatatacaagtgttgaaggatgataagactttgaattgttatggaaaaagtggaggcactgattcattcaacaggatttatgtcagttgctggagatacaaagccaaatagatgtcacagaaactctaaggtcaactagtcttggaagacaaggggcgcttcatctccttgtgattattgtttttcagcattgcacaggagaagtcggcctgagtggtgcggcgctcgggacccaccagcaatgctgctcttcgtgctcacctgcctgctggcggtcttcccaggtgtgtctgccaggccccaactctccaagctccaccccttcagcctgcccgactccagggttcacctccctggggacactaaaatcagactcatccccagggatgtccctctcaaagttggcacttccttgaggaagagtcatacagagaagacactgaaaggccacatctgtgagcattggaagtcagggacaggaatggcacttcctaatctcaaggccaggggtctgtgaaagatcttctttgagaataacaaagaccttaacttcaaccaagcatctctatgacccgctgtgaaatctgagggaagtcacttatcctttctggctctcaatatttttatctgggggaaaaaaaagaaaagaaaatcatctacaaagtgcttttagaaatataaggaaataacacatggcaagtgcaaacatgtaacaccttacgaaagtggtgttattgtttgaaaaaacaatggatggctggatgctggctcacagctgtaatgccagcactttgggaggccaaggagggtggattgcttgaggtcagtagctcaagaccagcctggccaacatggagaaaccttgtctctactaaatagaaaccaaaattagctagcatgcacctgtagtcccaactacttgggaggctgaggcatgagaatcgcttgaacctgggaagcggaggttgcagtgagccgagatcgtgccactgcacaccagcctgggcgacagagagagactttgtctcaaaacaataaaaatatataaaataaaaaacaagggttatcataaatttgtcattcccttgtccttgaaatggttatcattaatgaataacaattccaatttaatcatgattaaaacagtcactttatttaatctcagcaattttccagctgtgatatatgataaattatcaacacagggcctacgtgtcaggtagaaaaccacatctactcatagtgggttatctggaacaggctttacctcccaagggcctcagaaagcctctctcttctgttcccacagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtaaggatccaagctccttgggcttctgggggaaagttagagggaattctctaaggtgcatggagggcttgaggaggaacttcctgacaaggatgtgtagccgggttgggggtcagaaggcacccctttccccaggcaaagacttctttaacaggagaaggagacagatagggcctacttgggggtgatgagtgaacccttctaggacttggtggcctataacattttaggctttctggagaccccagcttagaagggtatcagaaggacaagttttctggtgtttgctacaggtagaaagggaaatctgacatcaggctaaggagatagaaaaggtagggagagatttacagggatccttaaattcctatcattaatgcacctttccatcaaggtttgggccgccaaaaggcttcttgtaaaatgcatattttttttttaacctgggaacccttagtcttttggtattatcagggtaaattagattattagatcttgaccaaagaccaagatcctgaaaggatgggttgctaacaagcctattctagttggagaaagagaaaaaaagaaaagctctttctgacaagggtttaacaatgaggctgttttagatagtcaagggcaactcaaaagagaggtctacggagaaaagaaattcagggggactcccaaagacatgtcttgctcctttggaatatgcatactattgtctgtggactaaatgaggaggtcatttaggtggggatcaagattcaaaaccacagaatctttagaggtgaagagggcttagagttcaccctaaccggacacttagaagaacatgctgatgatgggtatgcagcctctgattaagcactttagcagaaactcactgctccctgagacagcccatttcacatttagactcttgtaatttttagaaacttctattgtatgcgttgaaatccatcaccctgcatttacattcattctgttcatttcagcacacattaatttggccacctactacccagaggcattgtgcttgtcacagcagaggggtcaaacatgagaaaaacatgttccagccttcaaggaacttccagtccatggagaacataattacccatacaccagattggatgtaataagtgatgcagatgtatcaagaaagcacagggcagggagagattagtgttagcttgggaaaggtttcatggagaagaccgctgtcaagctgggccttccgacagcattcctctgggaaggagggcattccaggttataagtccacccacaccctaactaggaatagcaaatagtcctatgttgcaagaaagtagaatcgtaacttgcctgccccctaccttgcacccctcatcctgcaggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgagggtaagaccctagagagggagggggagtaggtggggcagtctcgcaggtgagagccaagctcagctccctctgagtgtattcatcaatagtcatcaatcagccaacagcatccactcaatgaccagccccgaactggaggctgcgtgggctgctgcacaggacagcaagaaaaagcaacctctgcctgatggcagctcctaattactcttctgttatcaaagtcattttgatggctgtccctgcttaacaagcaagaggtgagtaaagctcttgattgaggcaggacttatagactgtgtttcagggctgtggcaggctctgcaggggtcctctgtcccctcccctggcccctgaacaagatgggtgcctcatccctcacattcagatggaaaaaggattggcttatcttggtctcaatgcgttcccaggagtgccccagcctctaaatgtttcactgtcacatttcgtagggttatttgtgaatttcagcaccatctggcccactcagccctactccagtgagccatcagcatggtgaaagaattaaatcccagctccttctcatcccagagcaccctgcatagagttgccctcgtgagaagcagcaaaccagtacttgcagttccaagtatctgtgcttgtgactttttttttttaaaggggcttatattctctgcatgccatgtccacatccagctctgggttttcaccagaatcccctgcatctttggtcacctgcttctctctggacctcagctttagctgcctggagaatggctatcgtctttgagatgccccttggggccccaacaattaagctcacctttgctacatactttatagtttacatcataccatcctaaatatattttcttgatttgggcataatccattgggccacttttgtggaatacacttgttagtgtactaaatagacaaaaacctacacagagggagactttgtaagaagccaaagaagagctgatatcctctccttcaactccttccattctctgctcagaataagatgggggaaaagaacaacatgtgcaggctgatggggagactccaagcccttggagtctggccctgatggctccagctgcaggctctgtgacattaggaaagctccttttcattttctgaagagggtaaggtgatgcgtgtaaacttcactccccatcctggctgagaccccgggaagaaggcttctcaggccacgcaaggctcttcctgcgtggccatcctcccatcccatctctgtctgtgcttccagagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggtaggagttgacagggagggagaaagctctaaaacctctccagccagcagcagcatccccaaccactcttcctcctttttcacccgcctccaccctgatgggccagacctcaggagggagcccacctatccagaggtcacattttcatgcctataacacgcaccttacactctgaattaccatacatggtacctcctactaccaagaacatgggcttctttcgcagtgtgcaggcatcagctgaagtcaaggattgcagatacctctttgtattgagtctagaagagaaggaagagtgaggaaagcaaactgaagtccatgtgtgaagatctatggtctatggtagactctggattgatcatggtgctcatcaataataattattacctaggcacacaattacatttcttctgtagtcagaataacatacttatttctaatgctatccaaagaggatatgtagactgaacatggtggtgcatgcctgtaatctcagcaccttgggaggccaagacaggaagattgcttgagcccaggagatggaggctgcagtgagctatgatcgcaccactaccctccagcctgggtgacagagagagaccttgtctcaaaaacaaaaacaaaaatatatatatatatgtatatgacatgtggacaaagattcccaccagagtcacttccctgcagcatctccaagtaccaacttctgtgtttatttctacctccctccctcctccaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcgggtgagtctccaaggacagggcctgcacccctcagacccagaggcaggacttcctgaaggcccctgcctgagagcttctcaatcagtgctggcccctatgtttggctgtaagaggctgaaagtggagagtgggaagggaggggacatttaggtcctatatagcctcgttgagcccttcaaaagggacatctcaaataaacataccaactaagtaaaaatagtgggtttgctatttaacctcggcattaagacaactcccagctgaatgtggtggctcacacctgtaatcccagcactttgggaggccgaggtaggcagatcacttgaggccaggagttcaacaccagcctggctgacatggagaaaactcgtctctactaaaaatacaaaaattagctgggcatggtggtgtaatcccagctatttgggtggctgaggcatgagaattgcttgaacccaagaggcaggggttgcagtgaactgagatcgtgccaccacactctagcctaggcaacagagctagattccatttcaaaaaaaaaaaaaagacaagtcccatagttgccacttcaacccagattgaagtctcttctatatctggaaatattcttctctgtatagaagaataatatgcatacatcactgtcatatgcaatatgttcatcccccttccccctgccaaagctcgccctcgaaagagggccagataccttcatttacaaggtctgatcaggaaaattaggaaacatctagtaaatttgcatttcaagtccccttttaaaatttcacatgaaatgttttagccctaataagggtatttgtagtccctcaagaaatcctattgggtctggaccctgcggatgggactcactgaggggcccatcgccaggctacctccagggggcagcactatcatacccagctgggcagtcaggaagcctggggcagcgtctcagagccttgaaaatctcccgggcataagtgatgggtcagcctttatgcacagctggtctatgacacgaagccttgaaggtccccactatacttttggtagtaatggggcagagatcatctgtgacagctgaagaaggccatcacagctgtttctaatgtcatcctgggtcctaccccaacagccttgagatcgaaccctgaccctgtgattcctcatgaagtctcccccagactccttcacctcgaggagtaagagcatagagaaaaatcacaacccaggcccactcttccctgctgcagggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcaggtaaggaaggattcaaggctccccactcggagaacaccccagagccgagcacctgaggctgggccaccaggtccaaggaggaaagcccatctgtctcttgagcactggggcagcccttactacctctgcttatatgtgggagggtcctatggtaccctctgcccttctcccatggctggggaggtgtttacaattcagttcaatcttccaggcctaggatgcaacaaggcccagtgcgtgcctttgccagtctgggaaggcttcttagaagaacagagctagggagctgcatcagcagggtggggtggataaacctgggaggaaaaaggactaagccaaccttgccagcacatcgtcgggcccccagatctcccttccagggatgaactaacttaagccttcttccagctctgaggaacaaggtggaagctccagagcgctggtctccaccctggtgcccctgggcctggtgctggcagtgggagccgtggctgtgggggtggccagagcccggcacaggaagaacgtcggtgagtccctgggatactccctgcctcccacctccaacccgagccctcagtcctgaatcatccacccatagaggaagctgctgtgtctcttctttttcatgagctaaaacaaaggatcccgagaaagcaggatggggaaagataaacccacacatactcgaaactgaaattcagagctgctgtccaaatactaacactggaaaatcatctccaattacccaggatctaggttcagagacagggctgccaggaagaggagattgggtttcaggagaccctgggcttggactaattggataactaatgagctgtgtgacattgagccatccttatgccatgcctcagtttcctcatggctcaagtcaaggatgataatcaggacctcacggggctgatgtgaggaccaaaggagatgctgtgcattgaaaggtcccagagtgacaaagatcagggattaccaagtcctgattacccaggaaaagggactggggaggagactcggatcatttccatccccctgggtcatagtcagagctgcaccacctcagctgtcctgcagggctacagtggatccgcccagagagaagcagcccagcctggccttctaggtcccagcccctgtccttacaccaactcctcttcctcccggacagaccgagtttcaatcagaagctacaggacagacattagcatgtcagacttcgagaactccagggaatttggagccaatgacaacatgggagcctcttcgatcactcaggagacatccctcggaggaaaagaaggtatgaccctcactcaagggaatgctcagcccctggggagagtaagaattggtctcacatctgggttgggaaaaggaggctagtaagggctaacctaccctctttcttcacacagagtttgttgccaccactgagagcaccacagagaccaaagaacccaagaaggcaaaaagggtgaggaggaagaaggaagccccactacatgacaaagaaatgcagcatgaggggatgcagttagacttcagaaagaactacctcaacatgggggccgatcccagaatagggaggatgatataaatagtcctcaggagtcctcaggactttttgaggaagaactatatcttactggttgtgggatgctgatgtggataaggcccaggaaggaggtgagctatatgattaggctgtaaaactgcaggagagaggcaggccaggagatgaggaaagcaggtgcataaaagatgggaagctacaatgccaaatgctggtgattaaatggatgctcttcctgggttgggggacccaaggacctcaggccacacatcctcccttgagggtttgctcaggaccagctttttgcctgggcctaggagacatttgcttgcggtgggcagtttgaggctagaagcccctgctcacttctcttgaagccccaccagaggcaactcctgccttgggtgccatataccatcccctcaatctgccctaggactcaggggaccaagaaaaataacatctcatgcctttaatcccgaggtgagagtttttgttgttgttgttgttgtttttatcatatctactttttcttgaaacatctctggcatttagcaaagttagaacgagttattcctgggacagccttcccctttaactttgtggtgccaaaaagctacctgtctgggctggtggagaaagaaaaacatacaccaccgtggttgaccccagcctaggccaccttgcccgtggactgtgtgggcagcttccggggacaggcccgggcaacagaggcggttccactccgtgtgtcagaaggaggtagtgagacagaagaagatatttttagaggctgcaactttccatttctcaaaatgcgtccttcttggtgagcatgggggctgggatgagaacagtgggccccaaaggcttgtgttgcttggaccaagatcacgaattcaggacattaagcacctcccctcccctgactccacccactgagccagtgcccccaacactgatgcctctcctcttgccccttagtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaacgaggctcagactgtatttgcacccaataccttctgtctcccagacagcctcttcagagcttttcttttctttttcttttccttttttttttttaagacagggcactctgttgcccaggctggagtgcagtggtgcaatcatggctcactgcagcctcaacctcctggtttcaagtgatccttccacctcagcctccagagtagcttggactacaggcgtccaccaccacactggctaactttttgtatttttttgtagagacagaatttcgccatgttgcctatgcaggtgttgaattcctgggctcaactgatcctcccacctctgcctcccagagtgctgggatcacagatgtgagccactgcatctggctgccttttgctttggtcccaattttaggcaccctgggacccccttgtctgttaagatcattcctaggttctggtgctgaaccatgtcatatcctctaagggctgcccaagctgtctgttggcagctagccccccatctcacccctagactcttccacagggcttctgtgtgtggagagttctctctgcaagagagttctccccagtctgccatcctgcctgatgtgaacctttgcttccacccaggccttaaacataatgctgtggatgctatgag

SEQ ID NO: 13991 - DNA, 4550 bp, Human
taacttctcattttcagaaaaataccaggcttgtgttaagtgacatgatgggaaattcaatgtagatgagatcatcaaatccagactaggggaaattttatgggacaaataaccttgtgctttcaatagaagttttcaaaaagaaagaaagatttagaaaaagagttgttgaacttgggaacacatatcaaccaaatggaatgttttaatcttatttggactaagactccagtgaatttaactttaacaatttatataagacaactgaagaaataggaacactataaggtatttgataaatgaaggatttattatgcatttttagcttgatagtgatattatgattatgtttttaaaagtcactatcttttagagataagtattgaaacatcaatatataaaataatgattaatgtcttcaaattatgcaggggctatggaaaattgaataggggtacagataaaacaacattggtcaggtattgataaattttgcagctaaatgttagatacattgagttccatatcatccctcaggctctttcctggagaggtaatgttgtgatgtaattttatttattcactttccaccgacagactgtgattttattaaagcaagtttatttatttattttattttttgagatagagtctggctctgtcacccaggttggagtgcagtggtgcaatcttagctcactgcaacctctgcctcctgggttcaagtgattctcctgcctcggccttgagagtagctaagattacaagcacgcaccatcatgcctggctaatttttgtatttttagtagagacagggtttcaccatgttagccaggctggtcttgaactcctgacctaaagtgatccgcccgcctcggcctcccaaagtgatattttatttatttttgtaagcaagtacctcttttaagaatttcgaacacaagctttcatgtcacggagactaaaagaacaaactctcaacaactctacctactagtgttgacaatagtgtttataatcacactttggacttccaagcaaatgggtttaacaatagtcttttgaagcatatctttttcataagtagagtcctctgtattcgcagcacctagtacattgtctacataaatcaaaaggtattaattaataaataacatcaaaaaataatgttgtagtgaattgaaataaaatgaattcgtatcacaccagctccttggtttgatgattgctaatgggagaaacaaagcatatattttgcctttacaatagaaatctatgtcaggataactgaataaccctgatgaatgtgtgtaaactctatagaaggatgtgtgcttattaaatgtgggaggactgatagcattaaaggacacacttctgtaaagcctaatgaaattccagattgagaaagaattatgaaccagtgttgagacaatcattggtggggaactggatttttggatagcgtacaacacaacacagtcacaagggggaaaatgtgcatggggatcacacttgcattgcattactcaagtccccaagtccagtggttggtgggacgaatggtgggacaaccagaaaacatgtgtcttctgatgtaaataaacatgaagaccacatcacttttgtgaattatcatattacatgtcaagatatttgactcgaatacatcaagctttagacctaactctagtttactggatatatatgagctatagaaacaagttaagtgatacaatgagaaagtgacaaatgacagaaggaaaaacactctggaggatcattggcctgatctcctaaacttaactagtgctatttcaaagagacataaggaatacaacaagcagacacaatgcatagtcctgggttgcatataatatggggtggggggagaacaaaaaaaaaaaaaccccaaagcacagctaaaaagacttctggggacaattaggagattttgaatattgtctaaccattagatgagattaaaaaattattgaaaagattcttccacaggaggcctacacgccgccgcttgtgctgctgccatgtctctagtgatccctgaaaagttccagcatattttgcgagtactcaacaccaacatcgatgggcggtggaaaatagcctttgccatcactgccattaagggtgtgggccgaagatatgctcatgtggtattgaggaaagcagacattgacctcaccaagagggcgggagagctcattgaggatgaggtggaacgtgtggtcaccattatgcagaatccacgccagtacaagatccccgactggtttttgaacagacagaaggatgtaaaggatggaaaatataaccaggtcctggccaacggtctggacaacgagctccgtgaagacctggagcgactgaagaatattcgggcccatagagggctgagtcacttctggggccttcgtgtccgaggccagcacaccaagaccactggccgctgtggccgcaccgtaggtgtgtccaagaagaaataagtctgtaggccttgtttgttaataaatagtttatataccaaaaaaaaattattgaaaagatgaataatattaacagcaaagttacaaagcagtatgttcaatataaactcatttcactgcaacattataaaagatctcacaaggtataaattagtgttaaagaggtatcctgtgagtagtgagatgtgtttttgtattcttatgtttgttctgtgtactttataattttctaaaatatgcatatctacttttatagtaatgaaaggtgattttaaaaatacaatatacataaagtactctattataataagtactccaatgtatatatatagagactaccaaaaattaaaaagtacatagactaatgaatatgctgtgttcttataatttgcttaaaatcaatctgtaaatagaatggattttcagtcccaattttaatgtgttcattttttcttaagtctacactttactatcatggtacaaaaagcaacagccataaaagaaaattgacaattaaatgaaactacataacttttgcagtttagaagtaattgagtggcaaatgttgaacaaggggcaaaattttaccacatgaacaacagcttaatagctttaatagataaaatgagtcattttaaatcaacgagaaaaaaatatctaccaccgaagaaagcaaatgatactaactgacacgtctaaaaattatagagtcataggcaagaaagctttgggctctgaggacaccaaggacagctcctagacaaagacgggcaaaattcagtccgttaattcaaactaaatatggcctgagaaggactctgttcttctatatttgagtccttgtggatgaaatgcaacctaacttaagaggtagacaagattgaaaacctaactttggagtatgtgtctgtaacaacagctgagtcttggccaatctcagcggctgtacttcaaccactcatagactgctgagtgttcaaaccgtgttcaattaaggcaaacacagacctgtaaccaatccagctgttctctgttctgtaactcacctccgattcttgtacctcactttactttttttttgagacagattcttgctctgttgcccaggctggagtgcagtgtcacgatctcggctcactgcaacctctgcctcccgggttcaagctattctcgtgcctcagcctctggaggagctgggattacaggcgccagccaacaagcacctggctaatttttgtatatttagtagagacaggtttcgccatgttggccagggtggtttcgaattcctgatctcaggtaatccacccgcctttgcctcccaaagtgctgggattacaggtgtgagccaccgcacgtggtcacatcgctttacttttttgtctataaatttgttctgaccacgaggcaccccgggagtctctctgaatctgttgtgattccgggggatgcccgattttgtgaattgttcattgctcaattaaactcctttacatttaatttggcggaagtttgtcttttaacaagtctgagcctctaaaatgaggttgcaagccgagtgtggtggcccatgcctggcctgtagtcccagccacttggaaggctgaaacagaaggactgcctgagcccaggagtttatggccagcctgggcaatatagtgagatgtagtcttgaaaaaaaaaataatttgaaaattaaaatagaatgaggttgcaagctcaaatgtctccagattgggtatgcacatgtgtgaatcgggatacacagtgggtacaaagcaacgggaggtggtgaaggctgggtgaactagagcatgtatgtattacctaacgatagccaaatcattgttattttttaaagctgtgctactctgatttggcccatgggccaccagtctgtggttttgtatagttattaaaaagtaaaatggtctaaaggagctctggaaaatacacttcagacaaagaatcacacgttcttggatgaagactgtaagagaaactaaagataccaatggtctcccagtgcagatttttttttaatgt

SEQ ID NO: 13992 - DNA, 7952 bp, Human
agaaagaggggagaacagctggtcagtggaacagtcagaatacacacaacatttaccaattaagtttgcatcatatatgggcccagttcatggtgccccaaaacaattacagtactaacatatcacagatcgccataacagctgtaatgataataatgaaaaaatttgaaatattgtgagaattacaaaatgtgacacagagacacaaagttagcacacactgttggaaaaatggtgccaatagttttcctcaatgcagggttgccacaaaccttcaatttgtaaaaaacatagtatctgtgaagtgcaataaagcaaagcacattaaatgagaaatatgtgtataattactttgggcagtgatttaatatctttctccctccattagaccataaactgcaagagagcagggactgtgtctatctcattcatgattataatcccagatcgtagcaacatttctgccagtaagtgcccaataaatatctagtgaatggatagatggggcttctccaaggaaggagggaatgaatagatgagtgtgggttaatgaatgaggtaagaatgaatgtgaaataatggttcatccattaaaaactaggggacacggttcagttcattggatttggcccagtttcagaccgaattctaaggttgaggagagttgatgatgccaagtactgtggtggtcctgaacaattaaagagggattctgggaagcagagtgtggacagttccaactccctgccaaggggaagctcataggcaaaggaagctcactccagaggggatatggaagttccataccctcttttgtctgaagagccgaagtccctgttctcaggtcgttaggaagttaaaaagtaatttggaggttatcagaactgattgaattgagtttgaacctcacctatagcaacaatgggccaggctgcttgactaatgccttggcgtcaatggtacagttttctccctcttgagctgctggcagggacctgggctgacatgtctcagaaggcccttagtcaatgattagcttatctcaaggccccaagccagggcagctgtcaaagagggtccccactgcgttctgcacctagatcctcattgtgaaatgaagtatgaagtgattgagtgaggtctctattgtctctgacattttacaattccaggattctgccttcttgtcagagaagtgtataggcaagcagttgggcaggtgagagggctccgggtgagaggctcagagactgagggctcagcctctgcttgaagagtcatcatctgggaggctctgtggcctcctcagatgagttcattcacactcataccccaaaatggagtcaacaccccctccaccatctcagccttctcagcatctaaagccccagcatcgatgcctctttttttgggttaggggtcagagctgttgtggaagggcatacagtcattcttcacttgcctttgactgtgtactctgtgcacatggaggtaggagcagacatgacttcaacaaggtcatgcccccttggcaagcatctttgagaccagagaggaagacagactagggaaagaatgaggagataagcacgggctgctgtgaggtccaggggagcaggcaaaggtaagagaaaaggctttaggatactaactaacatatatggagcactagcatgagccaggcactattctaagtgcttttcaggtgttatctctttttgcctcacgacagcacctacaaggcactgtaattatccctacttcacagatgagggagtggagccacagtgaggttaacttacttgaccaagggggccaagtaggaatggaggcatttgttgagtcttctaaagatgaggaaagagtggaagtgagattttgtaagtgcttgattcatttctaccaactgaactggcaaataaataaaagcatgagtaaatgggggtataaatagtctgtcagctatgggggtgggagtgggctcaaggcaggcttagagagaaggtgcaagagctgtctgaaaaggtcagagcaaagcatgaagctggtgagcagctgtgaccatagctggaagcttctctctgagctttctcctggttacctcctcctcccctacgtgaccagtcagccaagtgttaagtccaggggaacattttgctgcttccaagtactgtctcactagtgttatttgccataacttgcggccacagggcaaggtccaggtgctcagacctttacatcctggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggccccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggtgaagctctttatcctgcttatggtcacacactttgacttagagttggtggaccctgacacaccactaccccatgttgacccgcagcgctggggttttggcaccatgcagcccagccacgatgtgcgcttccgctaccgcctgcatcctacagagtgagcttggccaagccagctgcaaacctggccagaggagttctattgcatctctcacctgttctcacccctctgcagccccaagaccccactggccacccctccctctggtcctgtggcaccccctacctctgttctgcctgtcctcgctctctccccgcctagtcatctgacaggcttatcattctctttaaaataccatctctcagagtgggttctgccgaaccctcctctcacaggaagtccagaggaagggggagtatctgtgggcaacttggtttgggagatgatgcctgccttgagaagtcctgagtacagagactggttccccccagacacgagtaacatggcatcttgcaaacatcagcctccactctcccagcttgctttagttttttcagcaacacttatcccacatcctatggaattcaggttctagaacagtgtcatccaacataaatatgaagcaagctacatgagtagtggggttttttggttttgtttgtttgttttgagacagagtcttgctctgtcgccgaggctgcagtgcagcggtgcgatctctgctcactgcaacctctgcctcctgggtttaagcaattctcctgcctcagcctccccagtagctgggattacaggcacctaccaccttgcccagctaatttagtttcctggtaaacacatttttaaaaagtaaaatgaaacaattcatttttataatatactttacttaatccaatatatccaaaatattggcatttcaacgtgatcactattaaaaattttaacgtaatagtttttaccttccctttttcatcctgtcttcaaagtctggtatgtactgtacttttgcagttcttcccagttcagactagccacattccaagtgcttaattgccgtgtgtggcaggtggctgccctattggatacaacaggtctagagaaatgataccttttttttttttttgagacagagtctcactctgttgcccaggctgcagtgcagtggtgtgatcttggctcactacaacctctgcctcccgggttcaagtaattctcctgcctcaggcttctgagtagctgggattataggtgcgcaccaccacacccggctagtttctgtatttttagtagagacggcgtttcaccattttggccggcctcctcggcctcccaaagttctgggattacaggcatgagccactgtgcccagtcaggatgtctttaatgtaggaatcattcaagatccctcctcagtgcccatgtctcccccacctcagggtgctgtcaaccctcccttggtttccatgatcattgctgaactcagagctttcttctatccccagacccacatgggagtctcccagcacctctgactcagcttggccaatgcagaacttggcatctgaacccctgcctcttccctgaaccactcctcctcctgatttccctgctctctctgctcagaacactaccattcaccccatctcccagagacactctccctcctcctctttcaccttcatacaagcaggcccccgtcctatcagtacacccccctgtgatgcctctgaaatatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttggtctccaaacttctcaactttgccagctttctccaatgaaaccatcagtagagacattgctgttcctgcccatcccagtgccagctactccttcctggaagccttcctggatttcacgcatcccatcctctggccagaaatggcctccgaactgtgcagctcctgcggcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctgacttccagtctcggctaatttactttcagtcctcaaatcatttcctggcctcagccctccaatctatgaaatgaggacaatcccccttcccagcgtgcttatcagtgctacaagagggtgagggggtggctgccatagctgcagctggctgatggcagggctccagctggagctgggacaggaggaagaatgactgtgggagctggatagagtgtcttggaggaggtgggcccaggctgcatggaccccccgacccagcgaccagccagtggaacttctctctgctacttttatcttacatctctggcagcctcacatttctcctgaggctggctgcctgttctgctctgccaggagagtaggcaagggcctgagctggggtgacagtctgtctccaactagctatgtgaccctggtccagggcctgcatttctctgaggtcagctgcccgcaaatgctgatgtctgcctagggcttgatagagctctgcctggttaggagaagctgagatatcccatcctattctacaaggaccaggagcacaaggagaagagttgagtagggggcatagaaggaggagaaatgggctggaaggtggaagactatccatgggaaatgtaccaatgacatctctgcccagccaggccctgtgcccagtacaatggggctggggctgtggggaagcaggaacagagccttaacacacctccttggccctccctagaccttggtgctgtgtctccttttgtgcctcacacccaaaggaatatgggccaggagagtggcctatggattggctggggtgaggctgagggctggagttccctgagtcaggaccagaaggtctcaactgagagtgaccatgtgcagataggaacttaatggaccctgtggcctgtctgagagctccagaggagatgcttgggacctagagaagcctcagcgggtgaggtgtgaggtgaatgcaagtgtaccatcccacagtcagggatatccagcataacaacaggcctcccaggaagcaagagccccccaggattggagtgtgggcagggatcccaatgccccatgcccgcctgcttgcatgggaggggcccatgggccatatagctctctgccccctgcatgaggactgctgcagccaaccctggcagaggccttgaggcaggaggaagactgcgaccgccaaggatgcctctagtcaccacccacccaacctggtcattctgtccccaattcctcatttctatgccaaatattttcttcctctcatccttttcctcatcaggacctcagaggaaagcccactaaatgcgttctctctgaagatagtttataataaagcaagatcggggtggctttccaatggtggaatttcaggcacctgggaaagaaaagagatgcttttctcatagagaattaactggagtcaaaacatcacatttcgtggcgttcagcacaggcagcagccctgcccacaggcaaagcaacttctacacttctccctaggttggcccatgggaagagtccaccttgcctcagagcctgagggtcagaggaattctgattgctttcctgagacccctgggaaaggtttgagcagtgcagtcagggagccagactttgtcaggcctctgggaagacagagagcaacaggagggaccaaggcccaaacccggaagtaaggctggggtggagagggctttatcctggcctgggctgtgagagctgctgagctgctctcaaactatattgcacctaagacagtgacagagaaccaggtacctgcagctagctcttgccctctcctttggacataggcttcagggcactacttgttatattcctgccttttgcggcaagtacacactcacacatacacagagaaaggcatgaaagacaaataggactgggcgaagtggctcatgcctgtaatcccagcactttgggaggccgaggtgtgcagatcactttagctcagaagtttgagaccagcctggcc

SEQ ID NO: 13993 - DNA, 43555 bp, Human
gggctgtagaaatggcggccccatctcccaacaacttgggcattgtgaatatcacctccttaaaggggatctcctttggtcatcccgtctagagcagccaccataacttctgagcgtttattgctagctgatatatatcagaaaaatacaaattccacaaaagcagggactggtctgcttctctccctgcagggcccaggttctggcacatagttggtgcagaaagtgtgcagcctcaggtcctatccaagcccccagggcatcacactcgggacttgttctgcatatttttacttttgcctcccactggtactagttcttccgtggaacagcctgagtcccttcagatacttaatgttttttctcaagtgctgccatgaagccagatctccaccgtcttggggcattcctttttagggatgggaagtatatgtcgctccttttatgtgatttacattctatcttggataatttggccatcaccgtagttcattcagatctgtttggatcctgcccatctcagcttcagtccatttcattcttttaaatctgatcgacagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagaggtgagaaacccctccacgcaagcactggaaccttcacagtcaagagtggcaacagctccggttactggacttgggcctgttgaattctaatactctgtgactccacatctgggctgaatttttgctgagtatgatggaatttacatgcttcctccctagcccctacttgtctgtatagttggaatatttggttgcctcctctggagggatctagtacgtttagagtctagacgctggaactgtcaaagttcagaggaaagagctccagctgcaaagcaagagaaatgggctggaattctagcttcaccccttaatgaatgcttctgatttttttttttttttttttttttgagacgtagtctcactctatcgcccaggctggattgcagtggccacgatctcagctcactgcaacctccgcctcccagactcaagcgattctcgtgcctgagcctcctgagtagctgggattacaggcgtgcgctaccacgcccggctaatttttgtatttttagtagagacagtttttggccatgttggtcaggctggtcttgaactcatgacctcaagtgatctaccttcctcggcctccgaaagtgctgggattacaggcccgagccaccgcgcccagccgcttctgatcattaaaaaaaaattttttttttggcggggggaacgaagtgtccctctgttgctcaggctggagtgcagtgcagtgatctcggctcactgcaatctctgcctcccaggttcaagcgattttcctgcctcagcctcctgagtagctgggaatacgggtgccccccaccacacccagctaatttttgcatttttagtagcgatggggtttcgccatgttggccaaggctggtctcgaacttctggcctcaggtgatctgccttccttggcctcccaaagtgctgggattacaggcgtgagccaccgtgcctggccaaaaaatttatgttttaaaaagactagtcaagtgcagtagtgagaaggggggaaagagtagagcaaggagttatatctgttgcttctgaccattttgaacaagttacctaattctctgaggacaagctcggagaatgggagagacagttatctatttgcagggttgttgggaggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtggtaagtccctcttttatgtgtactctctaggataatttggttttttgaagaggagagagaaaaaagcagagtaaaaagcaaaaatacattccatagtaaaaagcaaaaatacaagaggatctccagggagaaggaagtctgtcaccctcctagaaggccacctctgttaccaatttcttgtatctttccccagagtctgcacagataggagcacacaagtatttgtatccttcaggtagatttgggctgttaaagcttaagggatgattgtgaaaggatttgaaaaacgctcattgtgttgtggggaaggtcagtttcatcttgggttgggcagctcagatgtgagggaagctctgtccaccaccaccctctccccccagtgttgagactggtgggtgggcaggggatcagagagaaaccattagggtccacagatgtgggttcagttatcagggtggctttgagatgctggctctgggctggggctgtgactagtgtgaggctgaaggtcaaagaagggtcaggttggtgtccatggggatattgggtgctttagctggctggggtagggagtgatattttggtcacaaaccaaggctcaattccttaaaagaactgaaagtccctagctccagtggctgggaagggggtggcttggcaagtggtggcaggagtaccgtggctgggatctgcagagggtagacagtgcgggcaggcccccagcgtactcagggtggtggagagctcttgggaagtagtgaaaccacatagagaggattgaaatgcttgagatttgtggaagtttgttgaaattaggagaaggatatgccagcgggtgccatagaaggggagggaaatgcaaagttgagctggatggtaattaatgtatttttgtttgtttatacatttaagagacggcgtcttgctgtgttgcccaggctggcctccaactcctgggctcaagtgatcctctggcatcagcctcctgagtagctgtgatgacaagtgtgagccactgtgcctggctatttattagttattgagctagcattgatgtgagctgggcctgttctttgtgctttttgggtgtggtttgatgtgcccccagacacacaatagctagttcatagaaagtggtatggagcctgcattcaggctcaggactgtttgtaaacattcaagtcctgtgagctcctgtgtgggatgcactgggctaggacctgggcacctggcaaacagccctgacatttgggagtctgcggtctgtctgatgggggaggtttgtctgatgggggaggtctgtctgatgggggagacagcagtaactaggagaatggtggaactagaacagcagtgagtatggtggctgtgagtaggggggctgatgactgagaggagctttgggaagccttattgcctgctgggagatggagcagagtttgaggcaggagtgttggaacaggtacaagtcacagaagaatgagaacctgcaggcctgggcttgtggccagtccctagagaggtggctggggagggctgggggataggtgcagagggactgagaataggtcctaaaacccagagtcactgaagggcctcacccccacccagcacgatccgggttgcctctcagggagcgatgtggggaaccatgagtggagggcctaactgggtgagactggaaggggagagaccttaactaaactagagatggcacagagcccgcagctgagtgggaaagcagggcccaggggagttgctggttggttgactggtgttggtgggtgaggagagatgtccagagtgttaaaggtgtctgggtggatggtgcagccattacatggcacagtttacaatattagataattgagtatcacaacaaagttttttaataaaataactggacagaacttaacatccaacagggccatacctaatggctcatgcctataatcccagcacttcgggaggcaaaggtgggaggattgcttgagctcaggagtctgagaccagcctgggcaacatggcaaaatgctgtttctacaaaaaatacaaaaaattagctgggcatggtggcatgcaccagtagtcctagctactcgggaggctgaggtgggagggttgcttgagcctgggaggtcaaggctgcagtgagctgttattgcattgctgcactccatcgtgggcaacagaacgagaccctgtctcaaaaaaaaaaaaaaaatcaaatagtagggagttcaataaattgtgacaggtcttatataatggattatgtaaagccattaaaaaccatgtttttgaaaaatatttagtgacctgggaaggcactcactatgtaaaagatgaaaaaaaaaaataacaaaaccaacaaaagtatatgaagtatgatcccaaatgaaaaaaaaaactgtccttaggaaacaaacaggaaagaaatattataaacattaatgccgaaattctcagtctagttaagagatagatgtggggttaacaaggagcatgtaagagagagtttgtggtgtgatggggtaaaagtgtcttcccttagttatttgaatgttaaatgaaattcagctgggttcctttttaaaacagctttattgtaatttgcataccacaaaattcacccatttaaatgtgcaattcaatgatttttagtaaatttacagagtaaacagcactacagagtaaacaccactacaatctaattttattttattttatttttattttttattttttgagacaaggtctggctctgttgtccaggctggaggacagtggcacaatcacaacttactgcagccttgacttcctggtctcaggtgatcctcccacatcagcctcccaagtagctgggactacaggcacataccaccattcctggctaatttttgtatttgttgtagagatgggatttctacatgttgcccaggctgtgcaatctaattttataacatttccattactccaaaaagaaaccttgtgcccatttgcaatctcttctggccccaggtgaccactaatctacttcctgtctctttagggatttgtgttttctggacgttccatataaaatggaacatatagcgtgggatcttttgtatctggcttctttcacttagcacattttttttttttcttttttgagatggagtttctctctgttgcccaggctggagtgcaatggcatgatcttggctcactgcaacctccgccgccagggttcaagccattttcctgcctcagcctcccaagtagctgggattacagtcatgtgccaccacgtgcagctaatttttgtatttttagtagagtcggggtttcaccacgttagccaggctggtctcgaactcctaacctcaggtgatccgcctgtctaggcctcccaaagtgctgggattacaggcgtgagccaccgctcctggttgcttagcataatattttgacatgcatctgccttgtagcacgtattagtatgtcattttttcctatagctgaatagtattcatggcgtggctgtagtgcactttgtttatccacttgccagttgttagacgtttgggcaagtttcttttgactgcagatttctcagggtctttgataagacaggatatttggattctccctgtggaggctttggcacccaagccagtttgcctctggaaccctgggttctaattaaacatccaaatgacaatgattgctgagatttacgagtgatttttattttcttcttttagggattgtgtaataaggtttgatcagagaaatccaactgataaatacatatatgcatattcataaacatatacatatattcatgcatacatacattcttgtgtgtgagaatgtatttctttttttttttttttttgaagacagggtctcactctgtcacccagactggagtgcagtggtgtgatctcggctcaccacaacctccacctctcagctcccaagctcaagcgattctcttgcatcagcctccccagtagctgggattacaggcatccgccaccacgcctggctaatttttgtatttttagtagagacggggtttcaccatgttggccaggctggtcttgatctcctgacctcaaatgatcccctgcctcggcctcccaaaatgctgggattacaggcgtgagccactgcgcctggccactgagaatgtatttcttagcacaagaatgcttaatttccatttttaggaaagattaaatattgttacttataatagggatagatggctcatcacagtttcagttataatcatggaaaattggactcaagggctcatagcagaggaaaatggagataaattgtagcgtaatcacagagtgttgggccaggccggccatgtgctcccacagcatggggaccatctccttttcacagtttcctgttgctttcctccacacactcatgagctctttggccgttgcaacgaggccctgagtacacagtgcctggcacagcataggccttcaataaacagttgaaacgtgctcaaagatgaggactgtatagaaaataatatttggcatgaaatatgctcatatgtcatggggtttatctcttagtattgggattatgggtgatagtttctcctttttgattttctgtattttcttcaatgggcatgcacttctcttataatatttttagacatcactttaaaaagaaatgtaaagactccctttgcttgcttcctgttcccccttccatttcaggggaactttgtgagattcttcctgcgttgcctgctgtaaaccggagggcagattggctgagctcattcagggcctgacattcaccagctcttcaggatttcatgctggggataggaacaagtttctgggagaagggcttatctgaacaacctgttaaaatgcttcaatgaacaggaaagaaaaaagactgtagagtgatgtctaggttgagctctttttatatatctaggaagaggaaaagttttctttaaagagcaataaaaaaattaaatccattagtgccctaatggggtcttttcatgcccttttgttcattcccttgggttcattttgtagtttggggctctaaaggagtgggctgggagggacccaggatgggagagtggccttgtgtctcctggatacccgttaggatcaaggcaggaggaaccttctccgccagctgacagagttctagttgctggggagactttagtggggtcgggtgagacggcccactgtgacctggtgtttatgtgaggtgtgactgaggctccatcaggagtcgtgagaaggggcctggatgtgaattctaattctgattcttccctagccaagtctggcacttgggtaagttacctgtgttgcccaggtttctctgggtgcttccagcctgagtgcaaaggaacaggcctctgtgcagcaggtcgggcccctctctgtgtgtgcccctggaggatgtctaatgtgttctcaggggacagtttgtcttatgtattggagctgcccgttccctgtggccatctgctggagccagagccactgggcctatgtcatcagcagtgcctggctgagcagagcttggtcagaatcactgggctacaggttcaagggctccagcctagagtctgatttagggtctggatgctacctggtgccacctcatgtttaaccagctcctctggtgcatctgaagcaggcatctgtggactagacagggagaagctctgctccagcctcgtggttcccatccttgcctgcacattgaaatcgcctggagagctttaaaagttactgaggcttggccgggtgcagtggctcacgcctgtaatcccagcactttgggaggctgaggcgggtggatcacctgaggtcgggagtttgagaccagcctggcctacatggtgaaaccatgtctctactaaaaatacaaaaaattagccgggtgtggtggtgggcacctgtaatcccagctactcgggaggctgaggcaggagaatggcttgaacccaggaggtggaggttgcagtgagctgagatcacgccactgtgctccagcctgggcaacaagagtgaaactctgtctcaaagaaaaaaaaagttactgagtcttgagtctcactcccagagattgtggtgtaattggtctgggctgtggcatccctgtagagatttttaaaaggtcccaggtggtcctagcgtatagccagagctgagaaccgctgcctggaataccttctctccctaagatgagttacttctaggatgctccttggtctttggtataggtagacccagaaggctgtttctggcccctcccactagtgccatgaccccctttccctcccacgtgcagtcattgtgagcagagtctaggttcaagctgtccttgctttattgtcttctacaagcctcatttttgttttctgtgaaaaatgttaggacttacccttctcaggtttcagtgaggttacatgtgataatggtgtgttacctgtctcagggcttggcctgtgacaaggtgcttaacaaagtccttgctctttttttcttctcccctttcctaatggtttccagtcagtgaccaagtgctttttttttctgtaaagcagtgaattcgattctagataacatatatgtgtttcctagcctcaaagccattgattaagctctcgttaaggaggcaggacacttaggcctaaaatctaatagtctgtggggttgaactaaggaagggcagagctgggctgggcagacaagctgtgtatggtttaggagttgacgtaaaggaggatctggtctggggggaccacatgagcctgccactcagggaggatcggcttatctgttattactaacaatgggaccttgccagtttcccgaggagggattttggtttacatgtgaaagtcttggactgaaccaattatgctggttacatgagccctttccgtagccattattccctgacattcccctgggtgcttgagttctggctctaatatgcattcgtcttttgccagatctgtgtcgagggcaatattgcaagtgggaagacgacatgcctggaattcttctccaacgcgacagacgtcgaggtacagcctctatgctaggtttgaaggaagcggagaaagcttgatgggataatttatagagggtgtggactaaccttgtccaataggactataatttgagccacaagtgcaagccacaggtgtaatttaacatttctaatatcctcattaaaaaaacaaaaggggccggtgcagtggctcaagcctgtaatcctagcactttgggaggcggaagcaggtggattgcttgagcccaggagttccagaccagcctgggccacatggcgagaccccatctctacaaaaatatgccaggcatggtggtacgtgcctgtagctccagctacttgggaggctgaggtgggaggattgcttaagcccaggaggtggaggttgcagtgagctgagatcacgccattgcattgcatcctgagcagcaggagtgaaaccctgtctcaaaaaaagaaaaaaacccacaaaaaataaaaaggacattttatttcacataacatatgccaaatgtgatcatgtcaacatttaatcaatataaaaatcatcaatgagctattttgcattctatcttgttatactaagtctttggaatatgatactggttgagcatcccttatctgaaatgcttgagaccagaagtgttttagatttcagaatttttcagattttggaatatttgcataaatgtaatgagatatcttgaggatgggacccaagccaaaacacgaaattcatttatgtttcatatatacatagcctgaaggtaattttatacaatattttaaataattttgtgaatgaaacaagtttgtgttaagtatttatgtgtggaatttttcatttgaagtgtcatatcggtttccagaaagttttggagtttggagcatttaggattttggatttttcaattagggatgctcaaactgtttgtatttgtaaaataagtgtaacttatagcatatcttaatttggactactcatatttcaaggtcttaatagttgcctgtggctcatggccactgtattggacagtgcaagtgttgactgcctcaaagtctggttaggaaaagagtctacatgggtaagaagaaaggacaggctattgagcagggctagaagtgtgacatctgagatagcaatgtctgagcagtgggtattactatgcataggcaattaatttaatttctagttcatttaaagcctagtcactaaaactaacctcagagatgtttaagaatcatctctacactaagacattgacctgtcttccttgttctagattttagtggtataatcttctctattgatggctctcttttgttactacagaagctacaatttctatacttttatagtcattttctttccttcttcccttcctttcctgtttttacttctgctagaaatatatgcatggccaggtgtggtggctgatgcctgtaatcccagcactttaggaggctgaagggggaggatcacctgagcccagtagtttaagagtagcctggccaacatgacaaaaccacatgtctacaaaaaatacaaaacttagctggatgtggtggcacatgcctgtagtcccagctgctcaagaggctgaggtgggaggattatttaagcccaggaggttgaggctgtggtgagccaggactgtgccgttgaactccaacctgggtgacagagtgaggccctgtctcaaaaaaaaaaaaaaaaagaaaaaagaaagaaagaaaagaaatatatatagtttgataaaaataataataaacattatatagcccttgtcctgctgtgttcatgtgctgctgtgcaggaaagagttaacatagcagacctaagactgctgccctttagaaatgcctgcttgcaagggtggtctttggctggcatctgggaacttagatcttgggagggcccccaccattcctaactgataacagtggctctctgcttaaattgtttctgcaaacagtatggtttatgctgacacctgctttcttcctgggagtccggaattttggtacatgtcaggaagtggttgtctgcatggctgagcgctgatgaaaaccctgaactcccaggttcaggccagcttgcctgctagacaacatttcacatgtattgtcacatcttgttgcctggggaattcagtgtgtactgtgcagctcctctatgagaggacccttggaagcttgtgcctggtttcctccagactttgcacctgccctttttccctttgctgatccttttttctttttcttccttttttttttttttttttttttctgagatggagtcttgctctgtcacccaggctggagtgcagtggcatgatctcggctcactgcaacctccgcctcctgggttcaagcaattctcctgcttcagcctcccaagtagctgggattacaagcacccaccaccatgcccagctaatttttttgtatttttagtagagatggggtttcaccatgttggccaggctggtttcaaactcctgacctcaagtgatccacccacctcagcctcccaaagtgctgggattacaggcgtgagccaccgtgcccggtcccctttgctgatcttgttttgtgtcctttcggtgtaatccatcttagctgtgagtatgactgcgtgttgtgtcctgtgagttctcatgaatcatcaaacctggggaggagggggggcttggggactcttgacccctgtcctgagtgatatgactcttaatggcactttagaagtgcttatagtctcactgaagaccttggacccgattaacaacgatagttaacatccagtgagtatactgctatttgcccaacactgtgttgagggttcatcataaatactaaatgatctcaccctcacaagaatagtccctctgaagtaggtaccatttttaccacagttttagatgaggaaaccatggcctaatgaggttaagtggcttgtccagggtcgctaggccagtgtatgatacagccagatcccagcccggatacagccagatcccagcccaggctgtctggttccaggggccacacccttgtttgattctgtggtacgaagagctttgttggctttaggaagaccactctcccttcagatctgagctccgtgtcccctgaccttcccagcgaggttatgcttcctgacagaggatcccctggccgctctgtacctctcttttataccacttcttggggtttgaaaacatgttggcttctgtgattacctgagtaatgtctgcttcccctggtaggcttaaggttctgtgaaggcagaggctgggctggttttgctattgttgtgtcctcagtgcctagcatggatatctggcacacagtgggcactcaataaatgtttgttgggtgacagtgctatggatggagcacccctgagctgggtcggggagcaaggctgcctgtgacccagactctggtgggcctgtgtggtgctgtgtatgctacttaggggctaggaagaagacctagaagaaggagagggggtttgagaggggcaggggaagggcatatttgaactggattttgaagggtatacaggagttttccatgtgatgaaagttgatgtgaagtggaatggggtgggaatgctggtcagaagaaacaacgtaagcaaagacacagagtatcttgcttgagggtggatcacttgaggtcaggagtgaagggtggggggtgattacttttcttttctttttagagacggagtcttgctctgtcacccaggctggagtgcagtagcgcgatcttggctcactgcaacctttgcctcctgggttcaagtgattctcctgcctcagcctcccgagtatctgggattacaggcatgcaccactacatccggctaatttttgtatttttagtagagatggggtttcaccatgttggccaggctggacttgaactcctgacctcaagtgatctgcctgccttggcctcccaaagtgctgggattacaggtgtgagccactgcacccagccagggtggctacttttcaagagttccatgcattgcctgccattggtcttttgtcacctatggccccttctcacatgtactctgaaagttcccagatggatcctggcactctgaagatcttggccccaagaacaccatttaaatcttttctagcacacacctgcatacccagaaaggctctagcagagtctggggttgtcccagatttgtgtgtctagaccacagatggaggctctagaaatgcccagcagagatcctgatatgtgtctgaaaacacacaggatgttggagagattggcagtcatcctaaaaggtacaaacaggaccagagggaaagaatgcctccaaaccagtgagacagggagcgtactaaagaaacagggactatcagcagccagtgcacccagtgcagtgatcagaggcaggaaacggaggcaggtggcctgccaaggcctagccctgtccagtgtccctcctggcttctcccacccacctgccagcttgatgtggtaggcaggcaggggtgggatagaatacacagaagagggatggacagagccagctctgaccttggggaggctaccagggcaatagagaggtaggatgtacctatgcttggcacattgggtaacatggatagagttattctcaggacatttctggaagtaatgtgaggaagccgtgtctagatagagttgtgacctcacgggggttgtcagctattttggcctaccttgggcacccaaatttggatagtctttttctctctttttcccttctctcctcactttcccctcaacacttacacacttttacagggttcagcacagagaaacagtagctctgatgttttctttccttccaggtgttaacggagcctgtgtccaagtggagaaatgtccgtggccacaatcctctggtgagtgggttgttggttgcatgaacccccggcttccccttaagcacctgagaatgatggtgcctctgcctgagccctgcctgcccaggcattctctgcgctcttaactgagttggagaagaccagggagggacaagcagaaaatggtggcatgttggtgttctgaggtcaaggatctctgaggcctgagtggctgtgcacagagcctagggacttcccgtcagctatcccatactattcccagtggccgaccttagccactaggggtgtccatttcttgttgctcattccagccttcccctcccctagaagaaacctatcagaacccgggacttctcaggcctaacccccccaggacctatctctaagtaaccaggatccttggtggacccctgacttgggtttgcaaacttggccctgtctggtaacaggggccacctctggcttacctggaagccaccagcctgctttcccaagggtgaacctagcaacaggggctgtagtgtgctgtgtcccttccttcaccttccccaattcgaggttctgctctggttgcttgaaagagatggatagaatctgggtcctgcaagagagagctttagaagaggatgttggttctgagctcccatcccatgaggtagggatgattagtctcatttttcagcttaggaaattgcacttatataagttgcctgaggtcacacagctagtaaatggacttggaagcctgtgctgccctgtgattttttttttttttttttgagatggagtctcagtctgtccctaggctggagtgcagtggcgcgatctcggctcactgcaacctctgtctcccaggttcaagcgattctcctgcctcactctcctgactagctgggactacaggtgcgcacgaccatgcccagctaatttttgtgtttttagtagagacagggttttaccatgttggccaggatggtctccatctcctgaccctcatgagccacccacctcagcctcccaaagtgctgggattacgggcgtgagccactgtgcccggccatgccctctgatttttagcaacacaattggcatctcctgtgtggttcattagactctgagttctactaggagcagggactgtatctactttgttcattgttatttgctaaaaccaaggcacactgcctagcacttagtaggggcttgtgcattcatccattcattcaaccaatattcagtgcatgtcagccatgtggcagacactgttctggatgatatggcagtgataaattcaaagcccttgctctcctgcccctaatattccagtgtggggaggcagaagtcaaacatataatctggcgggtggtgatagggcctaggaagaaaactaaagcaggtgaaaggatgtttcttaaataaggcaaaacctctcagtctttcaataaagaatcctaaagagacatgagaagaatttcttctctgtgcattcgggagaagatggaataccagtcatcttctttggatataacaaagaaacctctgtaacattcatattctctagaagccaaggaggaacccaggcttagttattaagtaagacagctagagttgcaggtgttagggatcataagtgacgtttcacgggacagaatcacagcctcagaagtcttagtgtccttggtacagatagccttttcaatgagagtttcctaataaaaaatacaatagaagtagccatttttatataagtttccactctagaccaaaagaaagatcgatacttttgtgaaaaatctcaattcatcactttatctgaattggttttctgatgcagaaaggtgactgtttctgcggccatcaggcaagagggagtgtttctcctagcctttatgagattttctctcaactgcagtcagaggagtctgcagttctcaatgaagaacactggagtttcattagtttgcaccaagagaaaaatgaaaagcaaaaatgaggaaaaggccgggtgtggtggctcatgcctgtaatcccagcactttgggaggccaagatcagaggatcacttaaagccaggagtttgagacaaccctggtcaacataatgagacctccatctctaaaagaaataaaagtaaataaaattaatttaaaaatgaggaaaggagcagaacaggtttcttagcaagtatgctggagcatgaagtgttttgcttctagaagggatggagagtgattgagtaggtgggttggcttctgttttacatgagataaccagggaatgtgtctatgataaggtgcttaaacatgagggtgtgagcactgcagatatctggatgaagagtgtttaggcagaaggcgctgcagaggcaaaggccctgagatgggaccatgcttggcatgtttgaggaatgctaagtaagctcatgtggttggaagccaaccaggccagagggagatgggtaggagatgagagaaagccttgtgggccatgataagggtttggatttcattctgcatgcaatgggaagccactggaaggttctgagcaggggagtggcaagaactgatttaggtttcacagactcactcttgtggctggatagagaacagactacagagggctcaaagaccattcactgaacgacttgaacgcatgttccttggtgattttattttattttttgaatttccaaagaaaagtaatttattttttgcagttagggcagctgagaagtccagggttgaaggggtgcatctgctgagggctttcttgctagtggggactcttcagagtccccaggtggtacagggtgtcacatggtgagggagttgagcatgctaggtcaggtctctctcccttttctcataaagccaccagtgtaagataacccattaatctattaatccgtgaatagattaatccattcaagagggctctgtactcatgatccaatctttttttttttttttttttttgagacagagtctcactctgtcgcccaggctggagtgcagtggcgcgatctcggctcactgcaagctccgcctcctgggttcgcgccattctcctgcctcagcctcccgagtagctgggactacaggcgcccaccaccacacctggctaattttttgtattttttagtagagacaggatttcaccgtgttagccaggatggtctccatctcctgacctcgtgatccgcgcacctcggcctcccagagtgctgggattacagacgtgagccaccatgcccggccgatccagtcatttcttaaaggcaccacctgctacatactgccacatgggggattaagtttccaacacatgaaatttaggggattcattcaaaccaaagtattatttgttaaagatgatcttaaagagcttaacttctttaaaaattttaaacttatttatttatttatttattttggagatagggtcttgctatatcacccaagctggagtgcagtggcacaattatagctcactgtaacctttaactcctgggctcaagtgatcctcctgccttgggctcccaaagtgctgggattataggcatgagccactgcacctggctctcttttctttatgctagaaacattcaaattattctcttatagctttttttttttttttttttttttgagatggagtctcgctctgtcacccaggctggagtacagtggcatgatctgcctggccagcatggtgaaaccccgtctctactaaaaatacaaaaaaatttagctgggtgtggtggtgcatgcctgtgatcctagctacttgggaggctgaggcaggagaatcgcttgaacccagaaggtagaggttgcggtgagctgagatcatgccactgcacttcagtctgggtgacagagcaagactctgtttaaaaaaaaaaaaaagatttttatcaaaaagacaggtgataggtgtggagaaaggggaaccctcatacatagttggtgggaatgtaaattagtacagctactatagagaacagttatgaagtcaggcagtgtgatgcctccaactttgttttttttgctcaggattgctttggctatttggggtcttttgtggtttcatatcaattttaggattttttttttccctatttttgcaaagactgtcataggtattttgatagagattacattgaatctgtaaattgctttgggtagtattgtcattttaatagtattagttcttctgatccatgagtgttgaatatctctttttttgtgtgtgttctgttcaatttctttcatcagtgttttatagttttccttgtatagatctttcacttctttggttaaatagattcctaggtattttacttttattaattaattaattaatttattttttttttcgagacagggtctcactctgtcatccaggctggagtacagtggtacgatctcggcccactgcagcctctgcctcctgggttcaagcgattctcatgtctcagcctctagagtagctaggaccacaggtgcgtgccaccacacccagctaattttttgtatttttaatagagacaggatttcgtcatgttggccaggctggtcttgaactcctggccttgagtgatctgcctgcctcaacctcccaaagtgctgggattacaggcatgagccactgtgcctggctggtattttatattctttgtagcatcgcaaatgggattcctttcttgatttctttctcaggttgttcactgttggtgtatatacatgctactgatttttatatgttgatttgtatcctgtggtattactgagttcgttcatcagttctaacagttgtttggtggagtctttaaggttttttttttttttttttggtcatttcaacttttattttacttttagcggggtacatgtgcaggtttgttacctgggtatatttcatgatgctgaggtttagggtatgatggatcccatcacctaggtactgagcatagtacccaataggtactttttcaacctttgccccctcccttcctccccactctaggagtccccagtgtctattgttgccatctttatgtccatgagtacccattgtacccacttataaatatccacttaaagtgagaacatgcagtatttggttttctgttcctgcattaattagcttaggataatggcctgagtctttaagcttttctaagtgtaagatcatgttgtccgtgaacaaggttaagatgacttcttcctttccaatttggatgcccttcatttctttgtctggcctaattcctccggtccctcggagactttccataggctcctattatagctgttaccatactgtcctataattgtttcagtgtctgcctttgtccaccctgctgtcagagccctgtgatcatgctgggtttatctccagccccaaccctgcctgtgtaggtttcttgagctgtccttcagtgccttgtgagaccagggtcctcctgcagatgccactttgatggaaagtgctgtgttttcccttctgcagggcctgatgtaccacgatgcctctcgctggggtcttacgctacagacttatgtgcagctcaccatgctggacaggcatactcgtcctcaggtaggtttcagatgctcagtttcagccttcttaaacgttttcttcagacttggggtatgtgattgccaggaagggaaactttacaaggaagccaggctaggccttcagtgctgtgcaggcctctctgtgtggggccaaggtctctggcttctgtggttctcttctgacctgcctctagtgcccccacctgcaaacctcagccagccaggtggtgcccctgccaccattctgagctcacatctttatgacctgaccactgctgggcttaatgccgtttaactcagttcttctcaaagtgtggtccctggaccagcagcggaagcatcacctggaaacttgttagaaatgcacattttcagctgggtgtggtggatcccacctgtaatcccagcactttgggaggctgaggcatgcggatcacctgaggtcaggagttcaagaccagcctggccaacatggtgaaaccccatctctactaaaaaatacaaaaattagtctggcgtggtggtatgtgtgtgcctataatcccagccacttgggaggctgaggcaggagaatggcttgaacccaggaggcggaggttgcagtgagctgagatcataccactgcactccagcctgggtgacagagtgagactctgtctcaaaaaaaaaaaaaaagaaagaaatgcaaattttctagtcacatcccagacctgctgaattagaaattctagggatgaggcccagcaatctgtgttttatcaagccctccaggtgactcgaatgcatgctttgtttgttttcatatttgagaaccacttatttaaccttcatggggtctggctcttagttcaaattcttgagacaaagaatctgattggttcagctttggtcaggtgtccagccctggttcaatcaggtgttggggacaggaccccaaggcacaaacatggctgcttaggcctattccatcagtgaggatgcatctagagacagagtctcttagaagaaagggggctgtggaggtcctgatcagcacctatgtttcaaagctgtaagcacaacctatgatgccagctttaaggctctgcatgaaggagacagactgtccctacagccagttaacactggcacagctgctgggctggacagttcggtcccagtctgggtacctgcagcaatagctaccattcttctgtaagtctgtcttttaaaattgaaagatgtgagtgggccgtttttggtgaataagaatttccatctccccaaatatctgtctaaattgcacaaatccacaaatcgaaagatctgaggttagtgcattttgcctttgctaatttgcttttcctgagcaggcactcaattgcaaacctaagttgtatctaatgatatttgaataggaagggatataaatgcactcctctatttaaggaaatctacctcaggaggcagagagagatggacagaccaggaaagatgagcagaaggagaccagagggatgaatggggagctaggaagtaaggaaagagaggatggaagaatggaaaggaagatggatgggcagaggatggatggacagagggacagcagggagagggaggaagtgcctgggttatggctttgaatctgccttggatttgttggcccaggtcccatgggtgctgtgggccatggccaagtgagagtagtgttagtgtgcctggcatcaagggtcagggcgcctcttgcttcccagaggaacgctggacaaagggcaaggtcgtctgcagagggtttgagcatcctggcagaaaggggcactgtcaggctgtcttcctccctcttgggcatcgttcttaccagtttccttgggcagagcccccagaacgtcacccccaacccgaccctcttggggctgtacctcatgcatgtggtccctctgcttaagcaaactcaccctatttaggtccgtggtagtcaccacatgttgcctcaagtggacagctttggatggtttctccagggcttgaccgtgttctagttgagactcacctgccatcaaagaggcagctgctgatgagccctcagcctcggcattgctgggccatgcatgcagctttggggtgtggggcaggtcagggtggaagggggacacagcctgagcctggtggcagatgtggcttctcctcccggcaggggagtgaggaggtcctcctgcttcactctctctgccgccttgattctcatattcagcaaagtccccaggcagggggagtaacagacatttctcaaggcctcctggctgtctccttttcccctgagttagtgattctctttttgttttcctttaggtgtcatctgtacggttgatggagaggtcgattcacagcgcaagatacatttttgtagaaaacctgtatagaaggtactgtagtttgaatagttgataatttattaaaccactaatttttcaaaatgaaatagaaacttgtttattcgattgacagatatggagtacccgctgttgtatcagttatccattgccatagcaatgcggtgtaacaaacagccacgaatcctcatggcagacagctatctgcattcattgcccagtcagccagggtggtcaccaggcagctctgcttaccttggctaggctcaatgagatgtctggggatcagccgatgtaggatagcctaagcaagggtgactggaggtggctcatctcttttcctcttgcctgtcactctccttctgggaccagcaaaccagcccaggtgtccacttctcacggtgacaaagggtagaagcaacagcagagatgcaaggacatatttttcaggcctctgctccaagtttgctagcattccattggccaaagcagatcacatggtcacatgagcccagggtggaaaggtgggagggtccagtgagttacacagcatggtacaaggctaaagggaagggtggagagttgggcgagtcagacgcacagtgtgcgtcgcatttgttgtgtttttcactaaaagcttccctcatgagagcagactctgtgatgtatacctagttaggggcttctggtggcctgtcagtgccaagggctcaggcatggggccctccatccctgtgctcagagactgccgatttctaggggtcttggaaatgggttgcagaccccacctgtccctgccgcgagcttgggatactgctgtccttccctcgcagagctgttcggatgtcaacgctggaggcccttcctcccactctcatctgcagctgtcttcctaaatgccaccctgtctcccagccctccccgaccacgctgtctagatagggcaagctccttgttagtctttgtttcgtttttggttttggtttttgttttttgaggcagggtctggctctatcacccaagctggagtacgggggcacgatctcagctcactgcaacctccgtctctcaggctcaagccatcgtcctgcctcagcctcccgagtagctgggactacaggcacacaccaccacacctggctattttttttgtatttttagtagaggcaggatttcgtcatattgcccaggttggtcttgaactcctgggctcaagtgatcctcctgccttggcctcccaaagtgctgggattataggtgtgagccactgtgcctggtccccttgttattcttaaggactactttctgttagttttctttgtagtatttaaggcaatcatatgaaattgtttaaccaattatgacctacaaaaatggcagttttgtgtggttcaacttagtatgtgtctaattgtttattgccacccacccccccggaccataagctcctaagggcaggcaccaagtttgttgtccttgcctagggtggacccagcacagagcaggctcctcgttgatacctgttagctattgttggatgaggggacctgtggctgtgctttggtctccagcccaacttgttccccaggctctggtcccccactgttttgcacctttcatttgaggggccactaaaaaggcttctcctaggagccctgagctgccatggatcatgcctttgagcctgtgtcaccccccaaaatgagagcctctgccccaaatccacccagagcatcagagcaatgctgtgggctcaggggctggcagccaaggtgagtcctggccgtggctttgccccctggcctcagacttttcttgtgggctgcagcttgccctctgagcaggtggcattcctgaccttacggccccattttcacctgacaacctgggtttccaggtgtccactgctaggtttatccagccctctgcggtcctcagctcctgctccttagcacctcagccagagggaggacaggcaggacagaggagagcgagagcagaagggagcctctgttatgtttgtgtactgctctgattagaactgtaacccgaggcggaggttgcaatgagccgagattgcgccactgcactccagcctgggcaacagagcgagactccgtctcaaaaaaagaactgtagcctgaggaacagatcttggcagtggggtgggattacctatgaacctcgcagagtggggctgtgtctgtcttttaatcacattcagcttggcctgttctgtgtggggtcagtggctcttgttgctttttttatttttgagatgggcttgtgctctgtcacccagactgtagtgcagtgccatgatcatggctcactgcggcctcgatgtcctgggctcaagagatcctcctacctcagcctcctgaatagctggacctacagcacatgtcaccacttctggctaatttatttcttattttttgtagagacagggtctccctgtgttgcccaggctggtctcaaactcctgggctcaagcgatcctcctgcctcagcttcccaaagtactgggattacaggcatgagcctgattacagctctgctcggcctcgtggctctttttgaagcaagtaatctggaatggaatgaccagaggttaaggggagaggatagagtgtggcatttggtgggcctgggttctatcctggctctgaagtttgctctgtttgtgagcaagaccaagtttctaaatttctctgagcccatctctcatctctgattcctcttgtccatctctgaagagcctttggacctgccacctccttcgtgtcttaggacccttttgtgggtccttgcccaccttggtctttattaaatttgtgagttccccaatcctacccccaaacctgtaggccacccagcgctaggtagatttccccaggagccatttgtctttgtttggccggtcacagttcctgctgatggccatgggctttggtaactcacgcccatggtcctgcatcaccacatttctgatgcgtcagttctgtatctcccaatctctgtggttacggcattggtctagatgacatgggccttgcctggagctgttctgtgggtagtttaggaagagaatgtagcttttaatttttttagctcttttcctgtcctgatgactttatatttatgtctctccctggccctcccagaatgcatggcctctgtggttaggatttctgtgggacaatgaaccacagaagaaacttacagtgtcctttctgttcttgggatctaattgttttaagttcatatggctttcggggggctcagattcccctgaagaccttgttggggccttgagatccatcactgggatctcttgaagccaaaggctctcagtgggcatgtggcctcgggcactccagaggctactgggagcactgtggctgcctggagggccaggctatctaccatggtctccagagagatgagaaaaggcggtgttcctcagaccctttcatcggattcctctgaaggcagaggaaagctccccacagcactgcttcctcatcctcccagaccctgtggtccaaagcagccacctgccaacaacccagaagtttcttggagtctcctattttaacctagaattcattgggattttgcattttcctccataatatgttcttaagtttgtatctaaaaataataatttacataacttatcattgaggacaatggatgttcctgtattaaacaccatgctttgcatgtggcttggagttcccactccctcagccacataccccagagtccctaagtccaggaggcagagaaccaaggggtagcggcattcaaaacaccttcccagggcaagtgattcacttgtgaactgcacctgcttatgtgttccctggaaacgggggcatctgctctcatggttaaggaacagggcagggacccatggacaggagctgcatttactgtctggttgttgaccctattgggcagataaggaactgagaaaggattacaaagccagtgctccttcctgatcgggcaggaactaaccacaggaggggaaggtgttccgaaccctgctgtgtgggggcaagcagcaaatgaggaagtggcaggaggcatctagatttctctcatcaaggccaaaggcttcagggcccactgggttccccaaagctgagaatcctgaggtactagcccaagggggagactctgcctctttccagacaggctttaccctaagcttctcccacaaccacctgtgcatcttgtttacaggcagattccacttcagtagcactgaggtggggcctgagaggccacatttctagcaggtgcccaggtgggaccatactcctactggtcggggatcacactttgaggaatacgggcctcagaagaaggtggcagggccgggtgtagtggcttatacttgtaatcccagcactttgggaggcagaaggggaaggatcacttgaagccaggagttcgagaccagcctgggcaacaaagtaagactcccatctctacaaaaaatttaaaaaattagctgggcctggtggtgcacatctgtagtcccagctacttaggaggctgaggcaggaggattacttgagcccaggaggtcagggctgcagtgagctatgagcataccactgcactccagcccaagtgacacagtgggactttgtctcaaaaaataaaaataaaaaaagctggtagccaggtggtccacagggcgccctccatcccaatgccacgacccttttcccctggagttctgacggtaaggtgggcttccttggggcttcactggacctttgggggtcataagaacaagagcctcggcctgagggttgtctttgggaccatggtgaaaagttctgcgcagtgcaggatttcctgtttcctgcacctggcctgtggtttcttaatttcacatttgttgcttcatatttgggttgctgggggctgtgttgtgttatctttgtttttaaggtttctggacttattcctaggccaagaatcaggcagccatagggcaaagtaaaaagtatttttagccagagccacagaagggataaagggaaggaagactagagcttggccactctccggacaactccagctgccctcgatggagcggtcatccacaacgaagtattactgagaaagtagatgtggggtttttttgttttttgttttttgtttttttgattttgagacagaatcttgctctgttgctcaggctggatcactcaggcgatctcagctcactgcaacctctgcttcccagattcaagcaattctcctgcctcagcctcccgagtagctgggattacaggcgcccaccaccacgcctggctcatttttgtatttttagtagagacagggttttaccatgttggccaggccggtctcgaactcctgacctcaagtgatctgcctgcctcagcctcccaaagtgttgggattataggcgtgagccaccatgcctggccaaagtagatgtttttagaggtttcggctccttcaaaatgcagattactgtcattgtcactacctatgcaaaatgtagcatagaactgactttggctgggtcctttgcccatacctagaataaggtgtcttggttcccacctgcagggagttcagccaggtactgggaaccacacggtggcatgtggggcgtcagctcctgcctgggagctcgtgtttcctcatttcctgggatgctctaggaaaaggcttcccaaaatgccatgatggggagcccttcacaaggtgggagggcacattaccattgccccttcagtgcttgggttgatctttttctccctctcagaagctcttgcaaccttggttcaggatctgtgggggcctagacagaaggctatatggcaggctcaggtccccagaaaagcccacatattggaatcctgcatctcctcgaagtaaaatttcttgaagggtgttcttgctctttgggctgtgaacaaatgaagagctcgccagggaaaagacccacctcttctggcactgtctaccctggcgaggttggggtgtgcagaatgtaactgcagttatgccaccagggattcgagagggctgtgttaattgctggagaggaagattccagttacacagtatccttaaagacgggaacttctttttcttttttttgagacggagttttgctgttattgcccaggctggagtgcagtggtgcaatctcggctcactgcagcctccacctcccgggttcaagcgattctcctgcctcagcctcccgagtagctgggattagtcatgtgccacaacgcccggctaattttgtatttttagtatagatggggtttctccatggtggtcaggctagtctcgaactcccgacctcaggtgatctgcctgcctcagcctgccaaagtgctgggattacaggcgttagccattgcgtctggccaaagacaggaacgtgtaaggggcaggcagctggctggcatgaaaagctgaaggtggtgagcaagattcatgtagctaaagaggccacacaggtgactgtgtgggccgagtaatgggaagcaaaggttttacaagattgcctggtcgtccttttctaagaacagaagtgagggcgtggagtgggacccagctcgggaagtggcatgctgactcacctgtggcttgtggttggggacactgagtaagacctggtgtttggaaccacaggctgggcctcctcccctgctgattggcccaggggcttaagttcttcccagctcctgtctagactgaaacctcctggtgtgggtcatgcgcctaagagctgtggccttcctggagctcaggctagagagacactggacttgatccgagtcagctgacagactggggtgggcgggtggtgcaatggagagcatttgggtttgggggtagggagagccaggcttggacccctgctcagacagagttggccttcacttctctgatcctcaggtttcttctataaactgggactgaagccagcctcacaaggtcttgtgaaaacaaaaggaaataacgtatacaagggagctcttccattccattccgcacagactggggggctctcttggcctcagggaaggatgcaagaaattgtactgatgtaacagcaggattcatgtggatcaagaccttggttttgcccccttggggtcagggcaagggtgagacccccatgcccactgttgagttgtgtgcttggatttgccaagcttggatttgcttggtattgctctccgtgcattctgtagaaataaaggcagtggcttgtcttgtcggtggtgtggggagccccatgcttgagacagacacaggaggagctgggcagagttcctaggaggaaatacagttagagcagcgcccactgtgccccatgtccctcggagtcatggagatcaggcttctgtttcctcactcagctcagacactggtcattcagtcctcctggatcccccagcctcttctggcacatggttctagtcatggaagggttttcaataggtctggcctactgaccctgcccatgggaggccacccgaccaaggaccccttccaagagcattgggaagggagaggctgcccctcagtctgcaccaaccctgtgggggaagccttttgtttggctgtgatgggggtgggagtgggaggcccctgtgactacctggagccgattcccaggggagctgtggcaggggcagagccaccggagtctgtcagtcccagagtcccccacaggtgtgaccccctccccatgtctccatgtgcagacccccgtgtactgtgactgttttgcagtggtggttggtttggttttagttaacactgcttcatttgttctgagctgtggttcagttccatgatcatatctgtgggcaccctcccagctctgggattggacagagtctccctcgagctgtgcagacgcatgaggtactccggtggctagtccagccttggacacttgggagactgtcccatgggcagctcagcttctccccagttgctgctaactggccccacccctttggtgccacctcttctgtgccctcaagccatgagtttgctggagtaggcgagaagctaatcagcagcttcctcattgcacatcctcattttcttagagtcaattttgttctcagtcttctttttccagaaaaggaaaataagagatagtggtttggtttcttgaacatcaaatattcggagctgaactaactgaaacccaactcagggtagcctgaacaatgaggtgtcatcaactcccaacagatggcttatttggtgcctctggcctggtttctctacattttgctactgtgcatcctgttcgtgtcctcatgcagttctctcagggtgacaatgtagtcgtggcagcattgggcttctcactcgctggttggagtaagggcaggtgtcttgctagtggctcttccctaagcgtgcggaagtatcttttctgtaagtccctgcaaacctccctcacgcctgcctaatccaaattgggcccctggctgggggaggccctgcactgattgacttagcttggcttcctgaacgcattgctggaactaggggagacgacttcctttagaccgattgtgcctaccctaaagcttggaagcttggggtggggtgaggtttccctgaagcccttgggtctgtggatggaccctgaataaagaatgggctacttttaaggaggtaagcggagaggaggcagggaggcagcctgtggacacaaagttgtcacctgaacttgtagtgcctgagttttgttgcctgggagtcccctctgcaatgctgtaggatttccttcccactcctccagcctcccacgcagcttctccaggttttctgggagtcctggccgtcccacaggttggtctgccctggcctctgtgctgcagtctgctcaggccccgctgctgttctccgtccactctcccgctcctctgtcaaatactcttctcttctgaggacatgggggtggtctcagagactaggggagaatgtccctctccagttggtgccatgccttgctgttagggccccaagacagggctacttgtgcccttggcctcccagagtgcctgcctcactcttccagcctcttacttccttccatgctcatcccctcgtgggactggagtcagcccctccctgccccctccccactgagagcctcccattgcacatggctcaggtacggccactcccccatggccagtcttgccgaacccagctctgagcgggacccacatggagccactagtggaatggaggatgttaaagggagaattcctctgctaggcctgtgagggttgtctgcctgctgatgggcttgtgccctccagctgtgtccattcctgctctctctttcctgttcatttcctcccagggcacaggaaacccacaggaataccaggaatagatgccagatttctccttcaccctggctcgttcttccttcccactttcttgcctttttttctttcttttaaagttaacatttaaaatgtgtagtaggccgggcgcagtggctcatgcctgtaatcccagcactttgggaggccgaggcgggtggatcatttgaggtcaggagttcgagaccagcctggccaacatagtgaaaccccgtgtctactaaaaatacaaaaattagccaggcatggtggcgcacacctgtagtcccagctactcaggaggctgaggcaggagaatcgcttgaacctaggaggcggagattgctgtgagctgagatcacgccactgcactccagcctgggcgacagagtgaaactctgtcttaaaaaaataaaaaatagaccatcctggctaacacggtgaaaccctgtctctactaaaaatacaaaaaattagcccggcgtggtggcgggtgcctgtagtcccagctactcgggaggctgaggcaggagaatggcgtgaacctggggggcggagcttgcagtgagccaagatcacactactgcactccagcctgggcgacagagcgacactacgtctcaaaaaataaaaaaaaaaaataaataaaaactaaaatatgtagtaatgctccccaactcccactgctgatttgagaagtaatgtgttgttaaaatttggaaaatacaaaaaggtataaagaaaaaaagaaaagtctcatgtagtcctgcagcttgagaaaagcactttttacattttgatatttttctttcccacctttccaagatgcattggtgaatacttttggaaatgtggttgggatatacacagttttagatcctgttgctttcactgaacattagatttgaaatttttccatgccattaaatattattttacaatatcatccttcagttactgcgtgaattttctgttatatagatttaccaagatttagttttttattggtttaaacagtgccgcggtgagcatcatgattattttcacaaaataaatttttttgttttgtttgagtcaggggtctcactctgttgcccaggctggagtgcagtggcatgatcatgacccactacagccttaaacccctgggctcaagtgatccacctgcctcagtttcccgagtagctaggaccataggcatgcgccaccacccctagttaatttttttgtagtttttgtagagatgggggtctttccatgttgcccaggcagatcttgaacttctggcctcaagtgatcctcccacctcaccctcccaaagtgctgggattacaggcataagccaccaccctggtccacaaaataaatttctagaagtgaaattggtttgctgattcattgcctaacctgagcactgtctctgttctcagggtacaagctttaaagtccctttctctgcttagagttccaatcccaagtgaattctcccatcactccgtgccatggcccttgcagcattgtgccataagccgctcccaggcagcaggaggtcgggaatgcttagggtccttgtcactgcatgtccagtattgcacggatcacactgtgccctggtacccttggtgactcctttcattgagagccgtctcaagatccttttgggggaattgcatagcccagaagttttctcttaggtgaataagcccttacaactctcattgcagtgggaagatgccagaagtggactatgtagttctgtcggaatggtttgactggatcttgaggaacatggacgtgtctgttgatttgataggtgagatgcacccctcccacctccctctcttgtctctctcctgggtcccttgaggatgtgcttggctgggccccaacccttgggggcagtgggtgaggcacttgcccttggcagttccttccccatgggagttcagctttctccctgagggcagacagaattcgggacttctggtctctcatggagaagaaccctggcctttgttctttaaacttccctccctggctcagctactttcagacccaaatccactgtgatctgatgggtttttctagtttgcaaaggaacaggaaggacagagcctgaacattcactgagacctgctgggtgtgaggcctgttttgagctctgtctatgaacagaatcccattcagcctcaaaacgaccccacggggccgctgacactgaaagagaatgaaagtcgaggcggagggtcagtggtcaagccaagagctggccctccctgcttcctgctcgagctgtgcagaccttcctcccgcctttgcctgtgtgcctgctttgcttccaagccatgagcagagtcctgagagccacgtattcttttaacctcagtttaccttcggaccaatcctgagacttgttaccagaggttaaagaagagatgcagggaagaggagaaggtcattccgctggtaagaggcctctttgacttggttaaagacaaactgggaaaccacctctgtccaacccggcttcctctcccggccccacccccatgagatcattgtgcccttgtttgcagagagagaacaggaaccaagtgtatcagagggtgaactctgacttcctgtttggccagagacccacgtggatgtccagatctgcttggcttcctgtggtcgctgactcacagtttggcaaccctcctgcttggaggcgttcccctcccctccccacctgcccctccccatcttggcagcaccagggcttgtctgttctgcctcctgaagattgcctggccttgtgctctctgtgtcctccctagaatgcgagttccaggagggcaggacccagccctcttgttcactgctgcatccctagtgcttagcacagtgcccggcacggaggcggtgctcatgcttagtggtgtttgcccactggagagatgccatgcccttctgagttctgctcaggccacactgactctcatggggactctgccagtataggcccgggctgtgcatctcgccctggcccttccctccttgcatctcccttcaaaatctggcctccaggctgccgcccggctgatatttccaatactcatcaccactcgtgcaatttcccagcccagaacctttcagtgccttgctgctggctagaatgcagtccccactttgtaatacggcttatgacccggccccaactgcctctctggcgttatcatcctccattccctactttctatgctctggctataaggaactagttgtggccacacacaaacaaccacatacacagtggagttatgcaaatgtgcctttgcacagtcgtttcctttgtctttaaagtgttactcagatgtcacctcctccaggaagccacccctgaccttccttccattgtaaccccccccaaacccaccccctggctttctgtgatcatgggccttaggacagcatactgacactatttgtttatacctttgttccccatccctcactaatgtgagctttttaagattgggtcttattccctccgtgtcctctgcatgtgccttggggcctggtgcctagtagttgctcagttagtattgaactgaatgtcccatgtgagaagctgccactggagggagacagaggctgggcaagcattcagtggggtgtcaggggctctgagctcaggataggctggactgggggccctgggaagcctatccaactcctgaaatcctgctcagccttgtttttccttggtgccagcacgatgcattcctgccacgagggcccaggcgtcactctgggcagctcctttgaaatcttggagacaagaatgctaggaagatggaatgtggtggaatggggccaggctggaccatgctgtgatgcgcacagcagctctgtgcagtgacccagatgctccccaagcctgggggccgtccaagccgtgatccaagccattgtcttaagggtttgaccaggtccatgggacacatctggctcctattgccaagggagagctgggcaggagatgtaaaggctgctgcagagttgacacgcgagcctctgggatggcgagtggaatctgtgtgaggagccatcccactctgtgcctgggagagcacgagtatctgctctgcctggcatgcaggccccatggctcaggagggcctgtgccccttttcccttgggctccgctgcatcaggctttctgcagttggtggtctttatagtctggagggtctataggttacgagttgttgagggggtagaagggcaatgggtgagggtcacagtcctcttggtggcaagacagagcggagggtttagaggctgcccagggctgggcccctgcctgaaggaactgaggccctgctgctgcaaaagtggcagtaaatgggagaagccaggtgtgggtcctgcctttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggaatggtgatgactcttaatgagtatgctaccttcaagcatctgtttaacaaagcacatcttgcatcgcccttaatccatttaacccttagtggacacagcacacgtttcagagagcacggggttgggggtaaggttatagactaacagcatcccaaggcagaagaatttttcttagtacagaacaaaatggagtctcctatgtctacttctttctacacagacacagtaacaatctgatctttcttttccccacatttcccccttttctattagacaaaaccgccatcgtcatcatggcccgttctcaatgagctattgggtacacctcccagacggggtggtggccgggcagaggggctcctcacttcccagactgagcggccgggcagaggggtcctcacatcctagacgatgggcggccaggcagagacactcctcacttcctagacggggtggcagccgggcagaggctgcaatctcggcactttgggaggccaaggcaggcggctgggaggtggaggttgtagcgagccgagatcacgccactgcactccagcctgggcaacattgagcactgagtgaaccagactccgtctgcaatcccggcacctcgggaggccgaggctggcggatcactcgcggttaggagctggagaccagcccggccaacacagcgaaaccccgtctccaccaaaaaatacgaaaaccagtcaggcatggcggtgcgcgcctgcaatcccaggcacttggcaggctgaggcaggagaatcaggcagggaggttgcagtgagtcgagttggcggcagtacagtccagcctcggctgggcatcagagggaaaccgtgcaaaggggagagggagagggggagggggagggggtcctgccttttgccttggctttgattcaggcgccaggggaagggccagtgtttgtgcccacgaacccccagtggagcagagcagggtggctggtgacacttgtgctgttttgctcagcctggccaccgagtgtgtggctgcgtctgccgctgtccacttgagccaggtttgctcttgcagggttcctttgtctgagtcactgcccatggtcattgactactttgaccccctctgcttgacacccttggtaggtggggtctgctctgtccactcccgacagactgcttgtgtttccctggcaggaatacctggaagcaattcaccatctccatgaggagtggctcatcaaaggcagccttttccccatggcagcccctgttctggtaagtaagactcccttacagggtacgagactgttctagaaagaggagtgacccggggaatgtcagccaccttgcagacaggggagggcacagtcctttagagtttgacaacttagaagaaggaaggtgggaaggctggtgctctctctcccagtgcctgtttctgggctgagtctcagagtgagttggccagacccgagggaaggcagtctgtgccagtgccatcacacctggcagttgtcactgatccagcatcttcagcgaagactctagacccgggtctcagttttcaccatttgggatagtagttcctctgatgtgaccttcctccttccgtggatgacacagagcctcatttcacctttgtttggtgactcaggtcatcagaaggaatgtcattgtctggtctgggctgtcacacagtgatgcccttaggaatgctgaggtgtgtggaactgtctgccctgcccactaatgtctctgcgttcctgtgtttactttttacagtaatcctcctttctcttgctgccatgtgtcatttctgactgatattgatgtgtctgtcccgtcagcatttccttacttccccatctccttgttttccagtttgctgtttccagatttctttactcagacaaataagcagtggcccagatgctcccaagaaatgcggagtctggggtccctccgagtcttgattggagggaacctaagatggttacatatacaacatgggattggctgtgaggcagggttgtgcgcaagctttggtgcatggctataggagcattgtttgatgggatgtgaggcagggctgtgcatgagcttttgtgcgtggccataggaatatctgtttgggctcaaacacttctgcttatggctcttgcaggcagtgaggttgccggaaagtgagatattactgtagtaattttttgtttgtttgtttttgagacagagcctcactctgttgcccagactggaatgcagtgacgcaatctcggctcgctgcaacctctgcctcctgggttcaaatgattctcttgcctcagcctcctgaatagctgggactacaggcgcatgccaccatgcctggataattttttatatttttcgtagagatgggattttgccacgttggccaagctggtctcaaactcctggcctcaagtgatctgcctgcctcggcctcccaaaattctgggatcacaggcgtgagccactgcacccggcctactgtagtagatttttaaataagtacagcttatttttctccctcattatggaaaaaaaggagggtagaaagtgatgagggaaaaaaacaaatcattcatgagcttacagggtctcactgtgttgcccaggctggtctcaaactcctgggctcgtgtaatcttcaggtctcagcctcccaaagtgcttggataatagacatgagccaccatacctagctcttgtagtacattcttaagtgaaaacctcattggaaatgtagattgccctagagctgaaagcgatttggctctaaccttcctttttatctgcctgcaaccttctgtgcccttccctgccccctgctgcctgcttccatctgtctgtctccagctgtgaaaggaggatgctgctgaggtcagtgcagccttgtgacccatgtgtctaatttccaggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccg

SEQ ID NO: 13994 - DNA, 4543 bp, Human
aaagtctaaaatcaaggtgtggtggagccatgttccctctggaacctataggaatccttccttgcctcttcctagctcctcatggtttgcaggaatgtggttcggcattccttggcttgcagttgcaatattccaacctctgcctccatcatcacacagccattttgtccctgtgtgactctgtctctttgtctcttctccttttttacaaggacaacagtcatgttggattaaggccccaccctactccaggatgacctcatctgaactcattatatctgcaacaacccagttccaaataaggtaaggcataaggtactgagagttaggacttccacatatctttttggggaacacatcccataacacatactgatgcctgtttctgaactaaaggtttctgaaagtgagaggctcactggagtggccggtggatctgaagggactgtagcatagaccacttagaaagaagatggggccactcccaccctgctccagttctctataaagaggacctcagggattcctgcagttgtgcaggaagaagcctgtggtggctgggcgtggtggctcacacctgcaatttcagcactttgggaggccgaggcaggaggatcacttgatgccaggagttcaatagcagcgtgggcaacctcttctctaccgtgtggtggtgcacatactcaggaggctgaagtgggaggatcacttgagcccaagaggggctggagtgagctatgattgtgccagtacactccagccggtacaacagagtgagaccaccgtctcgaaaaaaaaaaaaaaaaaaagaaccaggagttccaggacagccacagagctgggtagtaggacacctaaaccagaggggacaagcacccaaagggagactgccgcccaccctggagggggttccttattttggaggaaaccgaggtgaagttgaacactgcccccaagaaagccaggcccggaagtctccccacactggcagggactggtcaggtagggaaagctctgcctctacccctccttcctgccctctagccccatcgaagagagagaaaaggagggagggttgcagaggcagactacaccatcctcctgttctccgggttgctgggagccaatgctctcaccagcccaggaggagggaggacagagtgttgcattgtgcttaagactgaagtttggaaatgtgaacaggcccaagccttaactgctggaatgagactgtgtgaatgtccaaaagtgacaggggaggcatggcacccatccaaggaagcattaggggatgtgaagcagcgggacagagggcctacactgtataaatgaaagcagcaattggggaaaataaatcataccattgcaagctcacacttcaacagttcagactcctccatctaaccagttataatgagtttctctgaacctgatttgtaaaagtgtcacatgcaggctgctgcctccaccagctaggctgtgcccttcatccggcgcttgggacccaagctcagacagccgtcttcctgcagcagtgacatgcccaggtgagaacaggtcccagccctcgtcactccaaagccagacacagaactacatgggctgcagcacaaagaggtctttgttggcatccatcctcagacaatctcaatatccctcccctcaggttgcaagtgtcagacatcaggaaactttctccaaggaagcaaggctgagtaagggctgccaggctaccaagaagccagctccaccatatatttcacagaatgaggctttttggagtgacacagaccagggagaaaaatgctatgggcactcaaattcttgagcttgttactgctctagggcaaggtgtgaagaaagcattgtggaagatgctgcaccatggaaatctgttgggagaaggagtgggagcgtcttggtaataataaagcaggttggggcgtgtgtatgtgtatttggggggactgaagggtacgtggggcgaaacaaaaccggccatggcagcagcggaggaggaggacgggggccccgaggggccaaatcgcgagcggggcggagcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattgaaaactccaccccgcccccagggccagagaccagctccagagagcagagggggattccagccatttggtgatacagggggcttccacttctcatttggtgttggtgcttttccctttggctttttcaccatcgtcttcaatgcccatgagcctttccgccggggtacaggtgtggatctgggacagggtcacccggcctccagctgacaggattccctcttcctgtttctcgccatcttcttctttttttggctgctcagtatttgagctatgtctgcttcccgcccacctccagccagaggagaatcagtattgagggtccctgctgacccttccttactcctggacccccttgacccctctatttctgttggctaaggccagccttggacattctccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttgaaaggtgggcaaagttccctctgactcttcccccactccccatcttattgatttaatttaatttttcactccccagagtctaatatggattctgactcttaagtgcttcctccccctcactacctcctttaatacaaattcaataaaaaaggtgaaataaaaaaaaaatcaataaagcaaaataaaatttgctggcatatggggctcaaacaactcaattagaatcaattcaccaaatatttacggaaaccccattgcatgcacgaaatagtattaggcacagttaggaatagaaagatcagtagggcagggtctgttttaaaatgtacctgggattggctgggtgaggtggctcacccctgtaatcccagcactttgggaggccaaggcgggtggatcacctgaggtcaggagttcgagaccagcctgaccaacatggtgaaaccccatctctactaaaaatacaaacattatgtgggcgtggtgggggcacctgtaattccaactactccggaggctaaggcagaagaatcgcttgaacccgggaggcagaagttgcagtgagccaagatcgcgccattgcactccagcctgggtgacagagcaagactccatctcaaaaataataataataataaaataaaatgtacctgggatttatttaggcatgatgagaccagcagatcaggagacaactgccattcaaactgttcccaagcagaggaagtgcacttaccacccagggtcccgtgggaagcaccagggtccgtcaagaagaaacacaggtaacagcctgtgtgtggttatcttggaaaggaataggcagggaagggtaagcagcccaacaggtctaggaatgaaaaatttgaataattttggcaggctctgggctttagaggtggttgtccagtatctggccctcaggcaattagggcaggggattagtgtcctggccttgggatctggtggggctatggacttggaattggttggtttgcatatcaaaaatgagcttgcaggaaatatggaaccagcccaaatgcccatcaattaatgagtggataaagaaactgtgatatatattggaatattactcagccataaaaaggaatgaattaatggtattcacagcaacctggatggaattggagtctattgttctaagtgaagtaactcaggaatggaaaaccaaacattgtatgttctcactcataaatgggagctaagctatgaggatgcaaagaataagaatgatacagtggactttggggactcaggggaaagggtgggaggggggtgagaagttagactacaaattgggttccgtgtacactgcttaggtgatgggtgcatcaaaatctcacaaatccccactaaagaacttgctcaggtaaacaaataccagctgttccccaaaaacctgtggaaataaaaaaattcaacactttttataaatgagcttgcaggagagttgtgttatctctaggaattagttaaccctggatggggcagtgcttcctgggtcccagatggcaaggaaacatggtcaacacagagtttctgctctcaagctaaaaattcaggaggaaggacctagaacatgtccacaagcataacacaagacagaatataatatgtggcataaaagatacaaatgaagggcatgggatttcctagagaaggagaaattatcc

SEQ ID NO: 13995 - DNA, 101981 bp, Human
  misc_feature (1)...(101981): n = A,T,C or G
aggcaacgctgaatgtgtctcaaatggagcataaaaacaaagtctcttggtaaggatgggatttagggtcaaaggaaattcccctaaggaactctaaaactgacattatcttaagttttagcacttggggaagtttcaaagactttccaaaaggataagtatatcatgatatgtaggtataaataccaagacaactgcagagttattttaatccaagtctgttgaggctttattatgtgatacagcattgtgagagttaaggtaacagaaaatgatacactttgttcttcaaacttatttggcaaatcaagggtactggaggtttataacaattagtagtgtctaagtcaagttacaccccaactataccaggaaaaagaaggacaggaaagcacacactgtgaaattttactgtgcaccaacatattttacacatcaggtgggctgttatggaaattaagaactctgcacaaaatgtattttttttaaaagttttatcaagaaaggaacattttcttctaaaaatgattagtacagctaaacaaaataaaaataataatcctatcgcacaaattaaaaataaaacctgagaagttttgatcaggcttgcctaaaacgagttgaaaccaaagccattttaagaatccaaaatatgagattagttttgttcaaaaagaattatccataaaagttaatagatgtttgcatagttaccataaaataagaggtaagcctttatgtatttttacttcataaagttgaatttctattaaaatctattacaagaaagggaaagtaactttccagtaatattcagattttttagtaatattgagcctacatttatgggacatcattttttaatgtttgtccactgaatattttaagttatgtttgtcataggaaattaaatttgcttaccattcttaacgataatctctttcctcatttggttatacttatctcaattagtataagagacttgttgatttttttaaaaattaaggacatactaaatttccccgagatagttattttgcagtaatatagataagcgactcagattaactttaaaacaaaccaccatacattccattcaatttatttttgccaggcattgttttagcggctttatacagccatgtacaaaatagacaagattccagcatcatgatgcttattttctattctaggacacaaaatagaaaaaaaaaatctcaaatagtgataagcgttttgaagaaaagtatataggacagccgggtagagaatgaccaggactaccatagctagggtggtcaaggaaggcctctcttgagtttgagttaagagctgaatgagcatggcagagagaaacagttaacgtggatactgttcaggtttctttctccctgggaccaaaatgtttcgaagtctgcatacctccgtttaccctaacttgtcatgaacataaaacctcttatattgcaggcaaaaatctgaggttcacagattagtagggcaagtagctgattccgaagtgtgtacttgcctttatgatactggatacacactggtgttaacaaggagaacgatgtacgtggcagacgttcggagagtactggacatgttggttctaatttgggtttatcctggcaggctctaggtagagaggctcagaaaacctgcgtccatccttcccatctttcctcccatttccgaaaccacggccccggtttcgagtccagaaaaaaaggaataagtagaactcccaaaggacagctttcctggctgaacaagatgtaaacagtttacgtgatgatttccaaccaagcgcaaaagtacaggtgcaaaagaagacggcagacaccaaacttcccctgcagccacgccctccccactttgggagtctgggtccccgggaaggaaggcctccctattggtgctcaacgtgttacgtcacttccgctacctccacggcaggcgtcgctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccagggtgagtgtcccgcgctggccgctggctccgtagaagccgaactggagggccaggctgggctcggcgcctcgcctggggcaattcgcccacttgcctttcgccaacctcagaaccttcctttctggcctccgcctttccagttcagcctgcgcagcccgcgggggtcctgacaggtctctgactctgatgccttctgcagccctagcatggcccccgcgggaacttgtgggcacctcgcgggccggattgcacctctgaagcctaccgctttgtaccaaacaaaatgttacgtgcgcatcgcggtgtcccgcggttactcacctccgcggttggaaattgcggactccgcaaagttccagggtctttggagctttccagcgcaccttcatttagcacttggttgagattttcttggccttctttttcttactctcccaacttattttcttaaattttctaaaaggaaggaggggtgctactcactacggatcttttggaagaagtacgaaagtatccgacaatcattgaatgaacccagtttgggtccgaaaaacaaagaaactcttcagttcggctgagcagtctttttggtgaaaaggtggcagttgtagtggtaacccagaaaaaaaggtggttgaagagaattttcgtctctctcaacattcttttctgactcaaatttaaatggtttgagagtttccaaaataacattgaactaatcaggcttaccttcgtttttgccgtagcttgacacacattgcttgacactgagaactgataggatctctgagggagaagacagaactaagtccacccttaacctaatccctccattcttgggatgcagagagtatttaccgaaacattcatgttcgaagccaggtgtggtggtgcgctcctgtagtccagctactcgggagactgaggcaggcagatcttttgagcccaatagttctaggctagcctgggcaacatagtgagctgtctgtaaaaacataggtttgaaaaaacctgtaacatgttcgtgacctcctgaaagaagtcggaagttgcagtcattcgagattttatgtaatataagctatagtaactatgctgtggatataaattagaatatattcgtatcttttatttgcaataaatgtaaagctgaatcttagaatttcaaacggataaattttaacagcactattcccagggcttttttggtagtgatagaaaagtgtaactgttgagtttttccatattggcaatatactgccaggttcccttatggacagaatgaatcatcggctgggtgcagtggctcatgctgctaatcctcaggaagattgtaaaccttaggacgctgaggtgggtggatcgcttcagcccaggagttccaagaccagcccgggcaacatggcaaaactgcctctctacaaaaaattagcctggtttggtgacgcgcgcctgtaatcctagcctgtactcaggaggctgaggtgggaggatcgcttgagcccaggaaattgaggctgcagtgagccttgagcatgccagtgcactccagcctgggtgacagagtgagacctgtctcaaaaaaaaaaaaagaaaagaaaaagaaaaatgaatcatacgtttatactgtactccagaatccccaagtaagtttctaacacaattgtttctattgaccaagcaattttggcattttacactgaaattacagtggctgttaaatttagtctaaactgccctttaagtgttggcaaaaaggagaagaaacagtgtaatttgtaatccctcttctgtgtagctgtcattatgttgaaaattatgtattctttgtctcatctgtctgtgaaacacagataattattacctaccttagtggtcaaaatgactttgcaaagttgtttggaatgtttattactacaaaaaattaaaattttttttacacttaaaaatgcttagtaggtttttaaaaataactttgtgaaaatttagtttcagtaatgaagcatttcttaaaagggcaaccattattatggcaaaatttaaaaatcatttagaaaaagagtactatttaaattggatgcatgtgagaagactatttgaagaacttttggagaaagaaaatctaaaaacagttgtttttatttgtctagaagtaaggtttagtttatgcttctaaaatgcctgtggctgggaaaagcttataaagcataaggagaggaggaaaccttgagggattgcttgaatacttaaaaatgaggaatgcctttaaaggcaaaatagaaactgtctaaaagaaatatgagagccctgtttgtaattttgagttgtctgatagccacattaaaaaaagtaaaattaaagatgaattaattttaatatattctagaattaattttaataacgaaatttatatattttaataataaaatatataaaatttaatactattttattaagtatattcaaaatatttcaacatgtaatcaatatcaaaattattgaagtattttacatcatctttttgtactgtctttaaaacccagtgagtattttacactttcagcacatcacagttcagactaaccacgttttaagtgctcagtaaacagtgactactcaattagatagtgtagttagagttagtatctaagttataaagaatttttacaaaccagtatacattccagtaggaaaatggacaaaggaattgaatacaaagttcataaagttgttcaagtggccaataaaaatgcaaaaatgttccatactgaaaaacagagactttaaagggttttacttctcactgcctatttcattttggccgaatttttcataatgataataccccatattgagggtgtgggaaaacaggaactctcttaactactgattgaaaacataaacggtttatgccctctgacctaacagtttttactcaaaaggatttactttaaagaaataatcaaaatacatattaaaatgtttgcagaagtttattatagtaataaattggtagttcatagttatggagagttggaaactgaaatatattatgatacctttattatgggctggtgatgtatacaaccatttttttaaaaaattataattcagggctgggtgtgttggctcatgtctgtaatcccaacactttgggaggccgaggtagggggatcacctgaggtcaggagttcgagaccagcctggccaacatggtgaaaccccatctctaccaaaaatacaaaaactagctgggcatggtggcgggcgcctgtaatcccagctacttgggagactgaggcaggagaatcacttgaacccaggaggtggaggttgcagtgagctgagattgcgccactgcactccagcctgggcgacgagcgaaactccatctcaaaagaaaaaaaaaagaagttataatttagaagaatagtgacatggaaaatactcttgtgttattaggtaaaaactgtagaaaaatacagtgaaaatatatactgtgatattaacagtgagtttgtctaaaaatttttttatttgtgttttacaaatgatctacagtacacatatacttctaaagaataaaaatgttacttagtttctgtagtaagtatatccttttttataaaaagttctttgggttaggatagagcacatatttctttttttcatgtatttataccttgcctcatttggcaaaaatttgagaggggaagacacttaagtatactagatgaacactgaaattaataaaagtgtaatttttaaatagaaaatagaaatcaaacatactatgttattattgtctccaatctgctagtatttattgtcataagaaaagtaggctgagaatttaacttttatccccagcagaggtccctcctcctcctcaacctctttaaataactaagagtattgacagttacaaaagaccagtctggccaacatcgtgaaacctcatctctactaaaaatacaaaaattagctaggcatggtggtgggcgcctgtaatgacagctactcaggaggctgaggcaggagaattgcttgaacccgtcagatgtggtctcaaaaaaaaaaaaaaaaaagaccatttagactgtcaatgctcttagttgtttaaagaggttggggaggaggagggacctctgctggggataaaagttaaattcttagtctgattaagagagcattgacagttataaaagaccatttagggctgggtgtggtggctcacacctgtaatcccagcactttgggaggccaaggtgggcggatcacctgaggtcaggagttctagaccagcctggccaacatggcaaaaacctgtctctactaaaaacacaaaaaaattagctgggcatggtggcaggcgcctgtaatcccagctacttgggaggctgaggtgggagaattgcttgaacccaggaggcagaggctgcagtgagccgagatcgtgccattgcactccagcctgggcaacaagagcaaaactccgtccccccaccaaaaaaaagaccatttaggcaggcagacaggaagattctatgcagatcaagttcatgatagaatttattgtacttaagtataaaatgaagctaactgtagtatgtgcctcctagagtttttgtgaatgagaatcattcagcattggatgccaggcattatagttgctgatagtgtagtgctgaacgaggtggatggtttccacctttcttccaccagaaataaatatatttaaagtgccatagaagagataggcaggatgatgggctagaaagtagccaggatgggctatttcattcgataagatggcctaggactccagcttttctgaggtaatgactgagcctaggcatgaaagatgaaaatgagcaagccacgtgaaggtctgggagaaagagcaatttgggaagagtaaagaggaactgtaaagatcagactagtatgtatatatgtatgtatttttgagaaagggtcttgctctgtcacccaggctagagtgcactgacaggatcacagctcaccgcagccttgacttcctgggctccagtgatcctcccacttcagccttctgagtagctgggaccacaggctagcgccaccatgcccagctaatttttatatttttgttagagactgggtttcaccatgttatccaggctggtctcaaactcctgagctcaagcattccacccatctcggcctcccaaagtgctgggattttaggtgtgagccactgcgcctggcccagacaaatagttttaaggagcagaaagaaacctgttgtgtctagggtatggtggggtggtatgaaaataaatttgagtttttttattttttgtggttttttttgagatggagttttgctcttgtttcccaggctgaaatgcaatggtggatctcggcagactgcaccctccacctcctgggttcaagcaattctcctgcctcagcctcccaagtagctgggattacaggtgttagccaccacgcctggctgatttttgtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctggcccagtcgtagtggctcatgcctgtaatcccagcaaaatttgggaggccaaggtaggtagataacttgagtccaggagtttgagaccagcctgggcaacatggcaaaatcccatctctacaaaaaaaaattaaaaaatgtagccaggtagggtggcacacgcctgcggtcccagctactcaggagtctgagatgggaaaaccacctgaggctggggaggttgaggctgcagtgaaccatgattgcaccactgccccagcctgggtgacagagcaacaccctgtctcagaaaaacacaggtgggtgcggtggctcacgcctgtagtcccagcactttgggaggccaaggagggtggattacctcaggttaggagttcaagaccagtctggcccacatggtgaaaccacatctctgctaaaaatacaaaaattagtcaggcgtggtggcacatgcctgtaatcccagctacttgggaggctgaggcaggagaatcacttgaacccgggaggtagaggttgcagtgagctgagatcacgccactgcactccagcctggatgacggagtgggactccatctcaaataaataaataaataaataaataaataaataaataaaaatgaaaaagaaaaatagaattaagcaaggcagtagagaggtatgtcaagatgcagtctaggaagttgtcatcatctcctattgtttcctaactcaaaaaaaaaaaaagattctctgttttttactctgctctggcgaaaagttacatcagcagtggtcttctagactgagctactccatccaggtcacacttttgcttgctacatgattaaggataaaaaggattttcctgtagttttggctagctgaaaggattaaagtaaaccagagatagtcaatctgttaatggtagactatattacaaattgtgatgatgatgttaataagaccttgatgaagttccagataatttagctatggacacattcttaggttttttttttattattatgggcattttttttaatacagggaaagtataaggtataaagtaaaaactatgcataattcagatatttcaccacatttttagtagttgaaatcatactgtataagtcttccgctttttttatgcaacattataacatgagtgtttttccttgttattaaaagtttttaatgaatacataataaaagtatagttacctgccgtaatttaatcattcttctattagggaacatttgagttgtttgttttttcctgtgataaataataccatgaggaatcatctttgcattctatattatgtattttaaattcacacttaataacctctttaaaaggttatataacctcttagtaacctctttaacagttatttagctttcatatattactgccttagaaattttggaaaagaattattgaaatagtctcttaagtaaggagactgaaatctagaagacaggctgcaagcttgactctggctctgaaattagccggaaataaactcacgttgcaagaaatctttttgtttatttttagttgttgttgcggaagcaacgtatacagtagactgagttgtcagtttgtgtgagagaaaaagagtgtctttttgttgttattcgtagcctaaaaatgatggccagattttctctggaagccagagtagtggtaggtgacaaaccagattggagagagagaggacaagtagtgatcactggcagtggccattaggtcactagctacagaggccatgagagtaaaataaagacggagaagtgtggctgttctgagtagactgctgataggataccagtaactctgcagtcttgaagacacagcccttatatacacagccataaggaagttcttgtccaggccagtagaatagtaagtgccagagtaaagacttcgatatgtagcttgtttagaagtcaccttgaaaaaagaatattaatggtgggtaatatttttcactatctctttgcttactggaattaatgaattcagtaattctttttttttgtttgtttttgagatggagttttacaccgtcaccctggctggaatgcaatggcgcgatcttggttcactgcaacctccgcctcccgggttcaagcgattctcctgcctcagcctcccgcatagctaggattataggcgcccaccgccacgtctggctgatttttttgtatttttagtagagatggggtttcactatgttggccaggctgatctcgaactcctgacctcgtgacctgcccagcttggcctcctaaagtgttgggattacaggcatgagccatgcaccctgcggaattcagtaattctttaaccagtggttgtgtttctattgctatgtgttaggtattatatttgttttattgagttaaatgtgcttcagtatagtttttataatatacaatattaggtggtaaatgtatgtgccattttctgtctcgtatgaatgccaaatgtgtacttttaaagttgctgttacctgaatttctactggtgttaaaaattaaggacttttcaaaacagccagcaagaaaaagctatcaaagattatgaagatagtgtcaaaagcacttaggagtcaattttaagaggcctctactggcccaaaatagaacagtttgagcattagtcaggataatgactaaactagattgaaaaatgccaagtaatgtttaaatttatgaagttgtaatgatatacacacaaattaaaaatgtgtcactattacaggaccttgggtaattaacgtattattttgagaactggtaaataaagggaaagaagcatttagtctgactttcctatatgaactacttttctgaataaccaataaatgatggatattttctctttgtagaaatattctgagtagtaaatgaaggagtaataaaattggtatcatcactttgtaaccacctaatgaataaatgattctaagcattgaagaacagtagacactatgatcacaaataaatcaaccagttactgtgtggttcctgatgaaagaactcatcaccacttaacaaagtagtgttgacctaataaaaatagcctgaagttagataaagcctttacagccattgatttatagaacatacagaagaatgggctaaacaataccataggaattcagtcagcaaaattcagcctgggaaactaccaggacaaaaattcaggacaaacaacctggctttttcaacataaaaattgcagttaaaaaaaaaaaagacattctgtagcttaaaagagacttaaaagacatctcaattagtcccaatatgtggactttatctggatctattcccatagaaactggaaaaaaattgtaacatttgtaacaactggaaatttgaaattgagaatatttgatattaaggtttttttttaatttctggtaatggtgttatggttgtgttaaagtttttgtctcttataaatacatactgaaatatttatggatgaaattatatctgagatttgcttcaaattaatattggtgcaggtagagatgagatgaaattgtccatgagttgatcattgttgaaagtaggcaatgggtacgtggcagtttattgtgctggtttttctacctttgcatacgtttgagattttctgtagcattttaaaaacaaaagagaacactgaaaaaaatctagcatcaagtcatggaaatgggtcgtcttccaaggaaggacttttaaactgtggagtaatccctctttaaacatcttagcacaaattctatgaaaatatttcatcagtgtatgaaaaaaaagttagtggcatattgtctttgtcaggtaataattacagaagatattttgaatagggctgaacagtcagaacaccagtggccaggatgaagaagatgcttttctggagtgtgtttcctatgaaaatctgctttagcccatatttactaattatttttgctagtaggcagcatattttaatgtgtaggaatcttctgctgttatatttgctttactgaccctttaaaaaatagacacaaatgaccaaaaacattataggccttcaacagtttctcaaataagtaaaagaatcagttcacatcagaaagtttttcaagaaaataagttctaggccggaaacttgagtgaatacttatgttcccttatgtcctttgtgctcttcatattattttcaacattcataataatttatgttcctgatgaattctctgagccattaagaaatggcttttctttcagaatgcatatatctgcacacacaatccatgaattaacatttttggaagatcattattaagcacttacaaaagtttcaactcttaaatgcttaaccctccatccttggaaaaacttgactatctgtaatgatgtaatttgatttcacctaaaactttacaaaatatatgaatgatatctatatagggtttttgggttctttcaaaaagaggaattatcagtactcatggtaaaaaaagagaaggagggtcacaggaaaataggaacaaatttggttttctagtacttgggtaaattgtggaatatactttccttctgtatttgagcccttcaaagctcacagtcaacccagatgaagcagctgaagtgctttgtaattagtcttctattcttcactcaattaaaattccccatttactaaggcatctcaccaaatgttgatctaattatctgattaaaaaatcggtgacagtatgaatgaatgattaatataattcacttgattgtgaaatgaaagaggaataaatctttagctagtggaagaaggacacaggataattttgtgtaggaagtcttcctgaccttccctcccagagtcctttattctgaaaagtaattatgccaacatttttttagcttgcaaccagcatgcaaaataaagagtatctactatgtactatatacctttcaaaatagctgaatagcataaatattttatttgattttttatatttttaaaaatttccaaataagtttacaagttagagaaaattagaatgttgtcactaatttttctttacaaaatggtatttcatgtgtacctagaagcagtgaaacacctctggagagggtggcttggcaattaattatgcagctaggacttggtttgaaattaaagtatatatattttttcttttagagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacaggtatgtgtaatttttttaatgtacttttttctgtatactggaatagtttgtgtaaaattatttgttccctggatgtttgatagaacttacttataatactgtctggactgatgttttctttgtgggaactattaaagcacttatttaatttctttattttttctatttctttttgactcagttttctacgaaaaactatctacttatctacttaaactaaaattttaatttattggtataaagtgtataataatgttccctgtttactcccaatagcatatgtagttatgtccttttttcattcctaatatttgtcttattttcttggctagtcttcccagaggtttgtgttttattatttttccaagtaattttttttttactttgaaccattatatgtttgtatcctatttcgtcaatttttactttttaattatagcctcctttctgcctttttttgggtttgttcagtcattattttttgttttgttttataacttcaacttttgtttagattcaggagggtacatgtgagggtttgttacatggtattttgtgtgatgatgaggtatgaggtacacgtgatctcatcacccagatagtcagcatagtaccaaatagtttttcaaccattgctgccctctctctctctccctcatctagtagtccccattgcctatttttgctatctttatgttcatgtgtacctagtgtttagctcctagttataagtgagaatatgtggtacttggttttttgttttctgtgttaatttgcttaggataatggcctctagctacatccatgttgttgcaaaggacataattcattcctttttgtggctgcatggtattccatggtgtatatgtaccatatttactttatccagtaccccattgatggacacctaggttgattctaagtctttgctattgtgaatagtgctgcaatgaacatatgagtgcatgtgtctttttggtagaataatttatttctttttgatatacactccctgatgggattggctggagttctttgagaaatctccaaactgctttccacagtggctgaactaacttacattcccaccagcagtgtattaagtattgacttttctctgcagtctcactagcatctcttgttttctggttctgtcattctgttattaattgtcagttagacacttagtttattaacccttccttcctttctgaagtagacatttaagccatgataacacatcccacagttttgatatataatatttttattatttgtaaatctaaatgtattcttatttctattgtgattcttctatgactttttagttgttaaagcatcattgtaaatttacagatagatggaatttttgtttatctttttgtatttaatgtatttcacaaaatgtggtctgtattgattcagtcttgaaatttgttgagtgtaacattttagtttagcaattggtcagtttttctaaatggttttcctgtgcttgaaaataatgtgtatttttaattgctggtgtggtgtttatacacatcaattcttatttttagttgttcagtacagatctttgtcctgttttaaaaattcattattaccaagggagatgttggagtatcacactctgatggtagatttgatggtctttttttatggttctgtaaatttttgctttttataatttgaggctgtcattagatacatacatatttagaattattacctaacactgatgaattattccctctatcattgtgcagctactgtttttctttagtgagctctccactacatttcttttggttactattttcccatcctttgattttaacttaattttgtcttaatatgatcatctctgtcttttaactggaagtttaggcagtgtgcatttactgtaatcactgatatagttaaacatatttctaccattttatcatgtttccttgtcctgttttcttaaattccttttttgcctttaattttttttcctcattccgtcatcctttctcctctattctctttctctcatttgaaagttttagactctgtgtctgtacttcaaagcctaaagttaattgataaatttactttccttctgaaaaacacaaaagctttagagtgctttaattctgatcaccgcctccaacttatgtgctatttgttggctaatattttctgtctactctgctctttctctgctataaagtatgcattgttgcttgcttagatttattcagaatctttgttagccatcttttcttatgtctgatctttctgtctgatgtacatcctatacaagttcgtttaggtgaggatcttttgtgggaaaggcacatttaagatgttactcgattgttttttggcttccactaattgttgagaagtcagatattatgcctttgtttgtatattttttctatttgacagcattttaaatttgattagctttaatttgaaagtctttttctttggtataaatggcagttttattatgaagtaactaggtatgtatttctttgtatttattctacttgagatttgttgggcttcctggatctgaggattgatatttttctacagttctggaattctacaattctcttattatcccttcatatattacatcttcccatttctgtattatctccttctggaacttcaattagaaatatgttacatcatcttatgtttttcatgtctttaaacctctctatcgtattttctatttctttacctttctggcctgcattctgtattatttcctcaggtctaccaggatcactaatttcctctttagttgcctctaatatgctggttgattatgtatgttgggtttttaacttaaatgattatattttccttttttttttctttttcttttttttttttttttgagaccaagtctcattctgttgcccaggctagaatgcagtggtgtgatcatggttcactgcagccttgacctccggggctcgacctaccttagccccctaagtagctgagaaaacaggtgtgtgctgccacgcccggctaatttatttttatattttgtagagacaaggtctccctgtgttgcccaggctggtcttgaactcctgggctcaagcaatcctcctgcctcagccttccaaagtgctgggattacaggggtgagccactataccggccatatttttcatttctagaaattgttttttaccttgcttggttggtctttaattccttggttgtattttcagacttaccttttattacattagatacgttaagcatagctattttatatttttaacagaaaattctgctatatgaaatctttttgtttctcactatatgagacttttcttcccttttttgctcttattcatgatgtcgtacctgtgttttataactgtgagttcgtcattttccatgatgtttttatatcttgaaagtatttgatgtttatctggactgaaaatgactttctgcctggaagggtttgtttttgcttttgtgtgctactctccagtagcattattgggaccacattaaattcagttctctgctttagatttacattgtgaattcagactgtgacttgtgttagggtccacttgtctgtaggattttcagaggagtatttttttcttccccactatttaacaccaaaatacagataggccagcttacttgctgttcccttctatgtgtattatttatttctagttcatagtgatcccatggctgtggctttttacctcagtgtcccctgttagactccttatcttggcagaacctagtcttattctctggtcttccatgcccgttgtagctctggaggtagaaataagctcaaagaatccaagcttcaatagaaatcgggggaaagctggctttgatatgttcatttgttctgtagagattctgctttcacttcatttttggccttttcgtatcattttttgctagactaacaatgcatttaaaaagattttgcttggggtacaataaaaggaagcattaaaggaagtcctttattcatttattcattaatttactcaagaaatatttattgagcactttttatatggcagcaaatgagaatgactcagagttgattactaaagcagaaaattaagcaaacaaatattgtattgtaacatttagccctgtattcatgtgttcagcatctgtggattcaaccaaacaaggattaaaagatttggggagaaaatggatggctgcatctgtactgaacatatacagacatttttttcttgtcattatttcctaaacaatacagtgtaacaacgatttacttagcatttgcattgaattcggtattataagtaatctagagatgatttaaagtacatgggaggatgtgcataggttatatgcaaatactgcaccattttataagatggacttgagcatccatggattttggtatctacagtgaggtcctggaaccaatccccaacaaatactgagggataaccatactgtgataggggaaattcattaatggtgctgcaggggcacataggagaggcacttaaccgagtcttgagtggttaggaaagatttccataaggaaatgatacctccttggagacatgaaagaaaagtaggtattggccaggtgtggtggctcacacctgaaattctagcactttgggagaccaagtgtgtggatcacttgagcccaggagttcgagaccagcctgagcaacgtggtgaaactctgtctctacaaaagatacaaaaattagctgggcatagtggtgtgcacctatagtcccagctactcaagaggttgaggtaggagggtcaccttagcctgagaagtcaaggttgcagtgagccatgatagtgccactgcactctagcctgggcaacagagtgagaccctgtctcaaaaaaaaaaaaaagtaggtatggatgtgtggtgaatggtggaaaaaggaggtaaaattcctggaatagtgagtagaggatttggcggtggggttggtagtgttgaaagtacaagagacgatgatccagcttccatattccttttaatttttttctactgctctcttgcttgctcactatgtttcagccaaagcagtctccctttttctcagccatgttctgagaaaatggcaagagttaagcactagtcagatcggggtcttgttcgggagtttggactttgttttgtaggtagtgggaataacagagtattattaatacaagtaggggaggtacttgatcagatttaaggttttagaaagataactagttgcaaaatgtcaaacaggttgcaaaggagggagattgaaagtagtagtacaaatgaaggtctagagtagggtaataataatgcttttttttaaaggagtagatgaccttaagagatctaggagctgaataattaggacttagtaattgaatctgggggatgaagaagagggtcaagccaagggcaatgcttggttactgtttggccagctgtctagatgatttcattgatttctaaaattaggagtaccagagctggagtatattttaatgagatgatggcttggtttgcacatctgaattataggtgcctatggaaggtcttaacagatgatgcagtgaccaataggcagttggttatccagtgaatctactagtcactgcatcgtctgttaaaatgtcacacatcaggtcgggtgcagtggctcatgcctgtaatctcagcactttgggaggccgaggcaggctgatcacgaggtcatgagatcaagaccatcctggctaagccggtgaaaccccatctctactaaaaatacaaaaaattagccgggcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcgtctgatttactgtggtagtattctccctgggatctctgcttccattcttgtccttctgtagttcatttttcacgtaacaagtgtggtctttttaaaaacagatcatgtcacttttttaattaaaactctccattggcttctagttacccatagaacaaagccaagactgctagaataaaattaaaatttactattctgactctcaaagttctttctagctgatctggcttccgtattcctctttattttcttctgctactctcttgcttgttcattatgtttcagccaaagcactctccttttggttcggagaaaatggcaagcttgttgttatagggcctttgctctagttgcgttctctttccaaggtgcccttctccacatggctcagcctcttctggtcattcatatctcagtttaaatgtcagctctgcatagagacattttaaaatcactcaacctaaagtagccacccagtaagtctttaatactaccctaatttaatttttggcataggtagcacttactcctgattgatgttttccatattttatttcctcatcacctacatgtttgcaagctccatgacagcatgaacctcagtgtcttgctgatagtagggacataataaatatttataagtgagtgaatgcttagagttctaacctggaactaaagatttaggagtttttacctatacatagatggaactgaagccatgggtctgtttgggacagtgcagggacagtgtttagagtgaggagagatcttctagtacaaaatcccccacatgggtgagggacaggtagaagaggagcctgcaaagcagacttgagaaggagtggctggagaaaatccagactatctggtgtcaggagaagacagtgtttgaagaataataaacatttcaagaccatttttcctttagttagatgtctttcacaggggaagattttacagattccttgagaaacctgtatacatttaatggctccttgttttcattctttttcctaagcctcatcctccctttgggtttacctatgcaatttcttctctttcttttgtggtgatggagaactgctggggtaaatattgattgagagtttgattttatgcaatgaaagaatgcagagtgtaatgagtccctaagttccagaaataagcatgtttattagaacacagttaagggaaaagaaatagtgatgaaataatataattaagggtaaaatatgttacaatgctctgcagaggtgaacacagactcaggggaaaatatttaatatggttccaccattcagaatctttcaaattgaaatccatgattaagtttcttttttctctgctgactggaataaaaatgttagtttattttcttatattagaaatacattgtttattgacagttttattttgggctcaatttttcagtacttgcttaggccacattagaccttgttagccatcagacagagtgcaagtaattgcttgattgaaagataatttgtatatttaaagatttgagattgagttttgaataattcaaatcacatgataaagtcaggaacagctcattaagaagcagagacttgctaaggaatccttaagtttttaaggagcattcagatttgttaaattttagtaaaattagttttaattttgctaatgacagcagatgtgtggcaaacagccagggtttgagcttaaaacaaatgtctagcgatattcatggatagaatgtttggttactgattgaaatcataaagattctactgcagtgatgcagtgtgagtttattaagttggtgctatgtaaaataagtattcatacatgtgtttaagccatttactagcattcttgtttgtgctgtataacactatatatttagtaacatctagacagtttgtagtgagaagaatatccagaaatatacagcttaaagcaactcattttatgtgattaagttcaataacgttgagcattgtagaaactagggttgtttctgaaacttttgacagtagatatcagttgtttggacattaggtaagttttgaaaatgtattattccacctttttcccttcactcctctctgccctgctctctgtttcccaaagctaaattgtaagaagtggatgtgtaggttctatagataaagatactttagaatttgcttgctgtgtagcgagacaaaaataaaatcataataatttaattttttaaggtcaaatgtagttactaaatagaagtgtttttaagcttatcttcaatttactagtatgacatcataacctacttaggatttggcaaacacttaaagcctttttagattttctgtacatgctttaggtaccaaaacgtactgtattttggtcaagtgaagtggctcacacctgtaatctagcactttgggaggccaaggtgaaggatcccttgaggtcaggagtttgagaccagcctgggtaacatggggagggagaccctgtctctacaaaaaataaaagaattatccaggtgtggtggcatgtgcttgtagtcccagctacttgggaggccgagacgggaggatcacttgagcccaacaggttgaggctgcagtgagccctgattgtgccactacactccagcctgggcgacacagcaagatcctgtctcaaaataaaataaaataaaataaaataaacacacacacagtatttggtcattttcctagtggttttcactgaaaaacaattgccaagaaatatactaaaacttacctgtaaaatattttgcttttatttcaaatagggctttgcttttgttagtgcttaatatattggcatttaattgcttcatataagctttgaaagaggtaactcaatggataggcagaacttctgatcacagtggtattgtgaatacatactttgaggcatgtgttctactaaccactcattggaataatagataaagtataaaaagagaaaattgaagacatagttggactaaaaaaagacatgttatatcaaagaaatggaacagaagcatctggactctgggtctgtaatctgggagtggcagctaggagtttggcttgtttggagtaatatgctacatgtgctatttgaatagcaaggtactggagtcagactcactatttgaacttatccacccacccccacagaaggagactgaaaatagctaattccagttgctacctgaggctgtgtcttacaggaagctgtaggcctagggaggcaaggagaagaccagtgtactagtccattttcatgctgctatgaggaaatacctgagcctgggtaatttatgaagaaaagaggtttaattgactcacagttccatatgactggagaggcctcatgtggcagaaggcacctcttcacagggtggcaggagagagaataagtgcaaacaggggaaatgcaagacacttataaaaccatcagatctggtgagattcactcactatcatgagaacagcatgggggaaactgctgcgtgatctgattacctcctcctggtcctgcccttgacacatggggattatggggattataattcaaggtgagatttggatggggacacagagccaaaccatatcaaccaggaactgaaacttgctgtttcctggcttagagactggattgaggggaaggaatttcaaactggcaatatgagatcaaactggcaatatgagttttgcatagaggtattagaatgaactctgagcacaagaatgtgaagaggagaatgaaaggatataccctattcagggtaagatggtgaactctaaaatttcaaaatacatgaagaatcctaatgctacgaaagccaatagaatcaataaatgtgaattaattccagttgaagctaaaataacagcttcaattgctttaaaataagtttaatgttctcaaaaggttaaatgaaggactcatattcattaaaaatgacagggaattttgaaacacaaacttgcagaaataaaaccagagcaaataattaggaaaaggagacaattagaaatcttagaaatgaaagtgtagccactaaagtaaaaatgtagtagactaaatagtcattgtcagtaggagagttagtaaattcaaattcagtctgaaggcacataggaaggcaaaaagatattccaaaaattgaaagcatttaagaacttgcagctctagcctacatttaataggtagagaaatggtgaggaatcaatatatagagatgagaatttttcagaatttgagaaaaacaggaattctcagatcagaaatatgttttgagtaccaagcaggataaataaaaagaaatctacccctgacactttgtagagacaccacagatttaaaaaccaaaacacgaaacaacccaacttaaaagctgacaaagagaaaaatcagaatactatcaacctaattgttgttctactgaagtagactttttacctgcaaaaatatgcagaaagcaaagatgggggagtgatttggaataatatccaggaaagagtaagaggaaaaataaatgctactctggaatttcatagtgatctaaataatcattgtagagtgaaggcaaaaataggaatgttatcatacatataaagatgaatgtcattttaaaaaaagcttattttctaaaattttgggaggtacatagtaggtgtatatatggagtacatgagatgttgtgatacgggcatgcaatgtgaaataagcgcatgatggagaatggggtatccatcccctcaagtatttatcctttggtttataaaccaattacattctgtaagttattttaaaatatacaattaagttattactgactatagtcaccctattgtgctatcaaatagtagatctttttctatttttttaatccattaaccatcttcatctctcaaagatgagagtcattttactaaacaacccctccacattaaaaaacaaacaaacaaaaaaaactattaaagcatgtacttctgcaagatgcagaagaaacctggagttacagaagggaaaggatgaaatatccaagagacaacaaagaacaagaaatggataaaatgtcctggtaaaactattgataataaaacagtaaacttttttttaatattaaatgctaaaactataatcaaccaggctcagtggctgaggcctgatactataaccaggctcagtgactcaggcctgtactctgagcactttgagaagctgaggtgggaggatcacttgagcccaggagtttgagaccagtctgggcaacatagtgagacttcatctctacaaaaaatttaaaaattaactttgatgtgatagtgttcacctctggtcccagctactagagaagctgaggtgggatcacttgagcccaggagttggaggtggcagtgagctatgatctcaccactgcactacagcctgggtgacatagcaagatcctgactcctaaaaaaataataataatagtatgatggaagacatttagatcactatgaaattctagagtaacatttatttttcgtcttactctttctcagatactactgcaaatcaccccctacccacctttgctttctgggcaacaagaaaaaaactgtggaggaatattaccagatttcaaattatactacagggctttaataatctaaacagcataggtttaggttactaaacctaaatcctttatgctgttttactgttataaagacagacacataaaccaatggaacagaatacagagcccataagtgaatccatagatatacagtgagctcattttcaacagatgtgccaaaaacatacattggggaaaggactgtctattcagtaaatagtgctggggaaaactggatatccatatgcagaagcatgaaactagaccccttctctcgccatttacaaaaatcaaatcaaaatggagtaaagactgaaatctaagacctcaaatgatgaaactatttaaagaaaacattggggaaactctccaggatattggactgggcagatttcttgagttagatcccacaagcacaggcaaccagagcaaaaatggacaaatgggatcacattaagttaaaaggcttctgcacaacaaaggaaacagtcaacaaaatgaagagacaacccataaaatgggagaaagtatttgcaaactattgatctcaccagaatatataagaagcttaaataactctatgggggaaaaatctaataatctgattaaaatgtggacaaaatatctcaagagacgttttcaaaagaagacatgcaagtggcaaaaaaaggtgtatgaaaaagtgcttaacatcattgatcatcagagaagtgcaaatcaaaactataataagatatcatctcactccagttcaaaaggcttttatccaaaagacaggcaataacaaatgctagtgaacatgtggagaaaagggaacccttgtacattgttggtgggaatgtaaattagtgcagctactatgaagaacaatttggaggaccctcaaaaaaccaaaaatagaactaccagcaatcccactgctaggtatattcccaaaagaaaggaaaacatacaaaaaaattagctgggtgtggtggcatgtgcctgtagtcccagctactcgggaggctgaggcaggagaattgcttgaacccaggaggcggaggttgcagtgagctgagatcgtgccgctgcactccagcctggcgacagagcgagactccgtcgcaaaaaaaaaaaaaaggaaatcggtatatcagaagagctatctgcattcccatgtttattgcagcactgttcacaatagccaaggtttggaagcaagctaagtgtccatcagcaaatgaatggataaagaagatatggtctatatatacaatggagtattatttaagcataaaaaagaatgagatcctgtcatttgcagcaatacggatggaactggaggttgttacgttaagtgaaataaggcaggcacagaaagaaaaacagcacgttctcacttatttatggagctaaaattaaaacaagtaaattcatggagagagagagagtagaatgatggttactaggggctgggaagaatagtgggaggtggagagtgaggatggttaatgggtacaaaactgcagttagatagaatgaataagagctagtatttgatagcacaacagggtgactacagtcagcgataatttattgtacatttaaaaataactaaaagagtataattgggttctttgtaacacaaacgataaatatttgagatgatcgatgctccatttaccctgatatgattattacactttgtatgcctgtttcaaaatacctcatgtaccccataaatgtttaatgtgtacccataaaaaattaaaatataaaagcaaatttaaacaaaaacccaaaaaataataaaaagttttttttaaagaaaaataatgttaaacaatagaaatacagtcttataaattccaaatagcaattgggggattggatgggaggcgaatatagaaaactttttcaatctaagagatggagacggcaggaaaagcgaaataaaaataaaagcaaagaaaacaagatggtaaactgaaaacaataagatggcagaagtacaaatgtaccacagttaagtagtcagacttagtggtgttccgtatcatttaaatgaactcataatctaaatatgtggaattagttaatttctgtttcattccatgttttcagagacttatattctggatcccctactaccccatctgctcaaggactttgcttttgggattatcctgttagcctactttatattttcttcgtggttattgcatcattcctatctctatgtaaaatgcagtcaacctttccttgattcattctcttcagctcctgctgaaagtccaaataccgcttccatttaatctcctattttctcctcaactattgtgtccattcccattcttgtccagaaactgctgttttcaggaggttccagtgatcttcatgttggtaatctagtatctattcttttttttaccacctagaaaaatacacaaatacctacacataaaattaaatattgttctaaacacaggcaatacaggaaggtggttaagagtgtagagtaatcaaaataactgtgcctccatgtttaaaatactagctgcgtgactttgggagaatttacaaaacctttctatgccccagtttcctcataacaaggaaaactggctctgtgactttgggggaagttataataatctctgtgcctcagttttctcataagatgaagataatagtattttcctcagagcaattttgtgacaattaaatgaaataatttgtaaagtgcataggacagtacatggcacatgttaaatgcttagtatatatagccattcttcataaactctgaaatgttattgaatgaggatataaatataatggaaaatgttttaagggtgagatttttacaatatatttgatacatacaaaaggatattataatacatatgtaagttaacaacataataaaatcaaaccttggaatttactactcaagctaagaacttcactgtcttgatcacatcctcctatctccatttgtcctatgtatccatgtgaaaaaaaagaggaaatagctttatacatttgtatatagccctgattatttacttttgcttgtttgtgaacttcgttgtgatagcttattgtatatattcttttgtgatttacttttttcattaaatttagttgctaagatttatcttattgattggtgtgtgtgtctgattcattaatgttcttggagataattatagcacatactgttcagggatgttgtatgagttaaatgagttgatacatgcttagagtagtacttagcacacagtaaaagctcaaagaaagatggccattattatgtttgttactatgcactgctgtatgaaatgttgtgtgaatataacatggtctatctgtctatctatctatctatctgttctcttgctaatgggcatttgggttgttgccagtttacaacaacagaacagagtcctgctctgaacactcatgtacctctgtccttgtgccctcatgcaagagtttcttgaagccaaatatattgacctagaagaattgctgggtcataaattatgcttgtgttcaactatagtagataatgccaacttgtttaccaaggtattgtgcccatttatatttccaccagcagtgtatgcattttcattgttccatacccttgccaacattaggtattctcatattttcctttttcttgatctgatggttataaaatagcatcttatgatttcatttggattctattaataatggggcagacattttttcaaatgtttattggttatttgtatatccttttctgtgcaagattgtccttcctattttttctaatggattgtcatttttttgatctagaggacttatttaaatattcttgattacttttgttgattctatttgttggaaatatcttctctcagtttgcggcctttcttttttctctgtttttttttttatgggattacttgatgaacagtttttctgagttttaatttggcagaaatttatccagtttttcttgtgttgtttatatcttgtttaagaaatctttctgtaccataaaagtattctgtattatctactataaggcatgtaaataccttaacatttaaataattaattaatctacctgtaattgttttttctttatggtgggaggtagattcaaattttttaaatttaatgtgttttttggtaggtgtagggttgtacagttgtcccagtcccacttaataatcattctttattgattgaatggtatctctggtacagttttaaatagaagaactgtgcattcttttgttccttaatttaaaaatgcatttaaacattcaccattaaagacaatgtttgttgtaggtttgttttaccctttaaagaaattcctatttgtcctaattttctaaaagggtttgagatttgcatggatgttgaattgtattaaatgctttttctttagcttctgaaatgattgtatagtttctcttctttaatctgttaatgagataaatagcttttgtaatgtttaactactcttacattcttaagatgaatccaacatggtctgatacattgtcgtttttatgcattgctatattacattggctaatattaattaagtttatagatttatgaaagcagttgtttaatgtaaacttcttttaataaactttacagcagaaggtataggcgcagaactcaaagctccacttaagcaagaacctctccaagtaagaggtaaatatattttatcctatttttgtattataaagatgttttgaattaaatatataacattggtttatgtagagctctttatagttatattattctaagagtatagtttattttttacttttatttaaatagattgaccataaggatttattctcttacgtataaactaattttctattaaatttattttgcatttttgtcacaaattttttcaaaagcccaagaaaggaataatggcaaataagaatcatcaattgcattatcatttttagaagagtaaggcaattaaagaacaagaggcccacacttttcagctactgcttattcaaatccaggtagagtttggccgttattgtctgactttattttctaggagaaattgaaggaattcctgtttgtagctctcttctgtataacaagctgtggttcccatctccaaagcagctgtttcatggaggcagcaactctatgattaacagcactgtggctttggcatcagataaaactggattaaatttgtggctccagtgcttaccagctggctgaccttgggcaatttacttgacttctctgaggcttagttttctcccctataacgtggtgctgaaaatgagacttcttttctagggtaactttgattaacacatggtagacaattaataacaattaatgttgttatagcagccatcattatcattatcatcctcaccttcatcattaataacctgggccagggttttttagctatttggaagaaatttttttaaaaattttttaaaaatttaaaaggcggtttagagacatgaaactcacgcaaaaaaaaaatctgtatttccttatattttttttcagataaggttttgattttttaattgaactttatttttcaaatattcttattacataatatttgtgcatttaatgtaagtatgtattattttaggaatctttttacccactgtagtgataggtaatcttaggctgaatttgctctttcaacttggaagtagaacagaaaattgtgaaataataaatatgagaatagaacatgaagtgaatagatgacaattcgaaatagaacacataagtttgttattttgctcttgcacttcaggtatttgcttatttatctctatcatatgaccaaaagtctcaccttataatgatttattaacatagaccaatgttctgtaatttttaactcacagactataattgatgccaaattggtattggtattggtgtcgctggcctttttatgagcagtttgatacttgacaatagaaaaacaatttattagaaggcaatatttaacctataatctgtaataattttttttgtaatttttaactgatgaaattattctgtacttttcttcagttttattacattatgtgaaatggtctagtggctttaaacttttttgactgtaacccacataagaaatactaattagcaactagtatacacatagattagtatatgtaaatgaaacaaaggttttcacaaaaaaataattatatgtagtagtctttgattactttatatttctactttgtatgaaatgctgatttcacctcacagtttgaaaagcactcaactactctgttattttatttatttatttatttattattttttttggacagagtctgactttgtagcccaggctggagtgcagtggcatgatctggctcactgcaacctctgcctcccaagttcaagtggttctcatgcctcagcctcctgagaagctgggattacaggcacccaccaccacacctggccaattttttgtattttttttttagtagagacagggtttcaccatgttggccaggctggtctcaaactcttgacctcaagtgatccacctgccttggcctcccaatactctgtaattttttatcaaaacttcagttcattttcatttagaccctaagcaatttaaattataccaatatgatttagacagaccagtaatacctgttcaaggtgttcattagacaaaggttgacattttgggatcagttatagatgacatatagagacaaaagctagatggctacaaatgcaatttcatcctattctgcacttggataattttttctctgatgtcattcagtgaaaaagatcagttttctgtgaaattcattagtgaagcctcttaagtatcagcctatattcatcttcacatgtgactttcaatgtgcatatttattatgttttcctgttttttgtttagttaaagcagtccttaagaaaagggagtatggatcaaagtacactcagaataatttcatcactggagtcagagcgataaatgagttctgcctcaaatccaggtaatttttttaaaaaatgtagccgtgtgtcatatctaaataatctaaataactattcctttcttagagtgtgttacctgctaccatccatatatggaaaatttgctactggctccttaaaatgaagagatatttttattcagtcaaaaatgttaaaaattgttagcaaactaaactgaatcctgccccagcattagcaattctagtctttcttagtttcttaaacccacaatggtaaattcttcaaaacctttccatcacacaagaatcttaggagttaaattgttaagtcattggtatgtgacagaattctcaataagattatttgcgtatttgtatgtttgactgttttggttttttggccagcagagttgagtacttaatttagtgagttaaatttatgttcatgctcccaactgtgatttctgttgagtataaattatttttactactttccaatatctgttattattaattttctcatatttatatttattgaaattatgttagtcacagatttaaacttttctccctcctttgtgcacgaattagagaaatcagatgatctatctttttttcagtcttcctcattgtcacagccactttggtatatatcaagaaataggtattcctataatttttaacttttataactattacatcaacaaccaattataatattgatttagttctgacacaaattttgtgaattaagtggattaggcattgctgtctccactttaatagaccaggatgagcataatacaagatgttagtgattgacccagctcatttaagtgagtcagtgacagggagaactagaatatatatcttttgaaagctgatccatacatttttactaacatgtgatggttattgatgttttttaaatctaggtttaatttctagaacttgataacattacatagtcacagactttttatttatagattgtttcattgctttaacaaaatttccataggaagatccatgattaaatatagaatgactatttagcagtgacttgatgaatatataagcctttcagaatttaagagaaaggaaaataaataacatgtaattgacacaaactctttatgacatcattcctttgaatggatattaccacttagtattaatctacatataaacaaataatgactgtaaatttttaacttaaattcttaagtagagggatgatattctaatccatgttctttcttcttttcgttttttttgtttgtttttttttgagacagggtctcactctgctgcccaggctggagtgcagtggcacaatcatggcttactgcagcctctacctccctaggctccagtgattcttccacctcagcctcctgagtaactgggactacggctgtgcgccaccacgcctggctaattttttgtattttttgtagagacggggttttgcaggttgcacagtctagtctcgaactcctgacatcaagtgatccacccacctcagcctcccaaagtgctgggattacaggtgtgagctaccgcaccttgcttatttttcactttttttttttttttttttgctttatctcctaggccaaagtacagtggcgtgatcttggctcactgtaacctctgcctcccgggttcaagtgattcttctgcctcagcctcctgagtagctgggattacaggcaggcaccaccacacccagctaatttttgtatttttttttagtagagacagggtttcaccatgttgaccaggctggtctcgaactcctgaccacccacctcggcctcccaaagcgnnnnnnnnnnnnnnnnnnnnatataaacaaataatgactgtaaatttttaacttaaattcttaagtagagggatgatattctaatccatgttctttcttcttttcgttttttttgtttgtttttttttgagacagggtctcactctgctgcccaggctggagtgcagtggcacaatcatggcttactgcagcctctacctccctaggctccagtgattcttccacctcagcctcctgagtaactgggactatggctgtgcgccaccacgcctggctaatttttttttttttttttttttttttttttgagacggagtctcgctctgttgcccaggccggactgcggactgcagtggcacaatctcggctcactgcaagctccgcttcccgggttcacgccattctcctgcctcagcctcccgagtagctgggactacaggcgcccgccaccacgcccggctaatttttgtatttttagtagagacagggttttgcaggttgcacagtctagtctcgaactcctgacatcaagtgatccacccacctcagcctcccaaagtgctgggattacaggtgtgagctaccgcaccttgcttatttttcactttttttttttttttttttgctttatctcctaggccaaagtacagtggcgtgatcttggctcactgtaacctctgcctcccgggttcaagtgattcttctgcctcagcctcctgagtagctgggattacaggcaggcaccaccacacccagctaatttttgtatttttttttagtagagacagggtttcaccatgttgaccaggctggtctcgaactcctgaccacccacctcggcctcccaaagcgctgggagtgagccaccacgcattacctaacttttcacttttttccccatatattagagatggcagtggtgtgcccatagcagatacaaatacaagtactggtgagggaagtgaatctctacatattatattgtggtgtctacactgagcatcaagagtaattttttttcactgtctctattttttgtatacaaaatgtcatctttaaactgatctttaaaagccattcacatcaatatttctctaagatggggatcagtgttgttgcttttatctgcccttagtaatcctctttaagtatataaactatatgcactttgtctgaataaattcaacatgtttctttctctagtgatctagaacaacttcgaaaaatcagacgacgaagtccccatgaagatactgagtcttttactgtatacttgagatcagatgtggaagcaaagtaagaacatagttctttcagaataaaagtgcaagccaaattttggattaataaaaatacattttagacagagtcagaattttttaaatgactttttaaaagcaatatttttgtatttgcaaatctgtttatttgtgagttactaatatgtactccttaactaaatatatgtcataatgtgtaagaaaatttgctgttgaatttactctagttgtttagatttcatttggaaaagttcctaagtcctttatgtttctccgaaagcaccttacactttgttgtaagattctcattagagaatttagatttaaatgtgatgtcaataaagtcattaaaattgttcattgtggtgaccatgtgtgtatgcacagatctttggaagtttggggaagccctgaagctcttgccagagagaaaaaattgcgtaaggaagcagaaatagaatacagagaaagtaagtatattcaatttaaagtcaagttaattgaaaaataacttgtagatgagaactgtatctgtaagaactctctagtgctagcatacctgttggcctaggctctgttgcttccagcaaatgctagtttccgttttgggattcaattatttcacaaaaacaggaactgtatttttgttttctcctgtatagctttttgaagatgatgagaggaagagaagctacagtttatcatttttataagacatataactatcaaaacttatctgatttaaagattatacttgttataaaagtgatagaataggaagtaattgctgtattagtctgttttcacactgctataaagatactacccaagactgggtagtttataaacaaaggagatttaactgactcacagttccgcatggctggagaggcctcaggaagcatacaatcatggcgcaaggggaagcaggcgcatcttaacatggtgtcaggcgagagacagcgtgtgtgtaggaggaactgtcaaacacttataaaaccatcagatctcgagaactcagtatcatgagaacagtatgggggagaccatccccatgatccagtcacctcctaccatggcctgtcctcggcacatggggattatggctattataattcgagatgagatttgggtggggacacagagccaaatcatatcaattacttttttacagaagggtctattaactcagctacattaattaattcagcagatatttatccgatacccgctatgaacaagaagctgtgcttggtgtttgaaatgtatatgcaagtaagactcttaggagccaggtgtggtggcacatgtttatagtcccagctacttgcctgtaatcccagctactcaggaggctgaggtgggaggatcacttgagcccaggagtttgagaccaccctgggcaacatagacataaatggggtgataccatacatattgtacatcttgctctttatagatagtggtataatcataaccgttttccatatctacatatagaaatctacctcattctttttaacagttgtatagtaccccattgtatggatgtagcaagatttatgttcttcagtttttcactgttagaaagaatacatcaataaatatttttatttttttaacgtgagataattgtgaatatttacataggattgagtgttaataatacaattttaggatcaaatggcataggcatttaaaaatttgatagatcctaaagaattactctctgaaggaaatatggtaccaatttacatttacaatcacagtgtatgagggagactattttttcatacccttgcccatgctggatattaacaagattttaacttttttgtgtatttgatgggcaacagatggtacctcgtttaattttgaatatctctgactactactgaggttatcttctatgtatagtggtttttcttagttcttctgtaataatttttatatgttttgttcacttttctattagattgtgtgtctcttaaaattgatttaaataagtttttggtggattttaaccaaaatctaaccaagttagtttcatatgttctaaatattttctaacagtctatcttgaaatttggtttctcctctttttagtagggaaatttcaaacatattcagaagtgcagagaaaaacataataaccttttaatgcccatcatctggctttacagctaccaacacatggccagccttgtttaatgtatatccctctcactaaccttcactctactggattactttgaaaccaggtccagacattatatcattttatttataaatattccagtatatattaaaaggtcaggatgtttgttttagtcagttcatgtgatggtgatggttgaactgttttagaaaagttaactatccattgcctgtagtaagctgtcagtcttagtaatcctctcatttgccctttggttgaaggtctaggatgttctcaaatagctttaattctgacaaagaaagtgattgaccttctgttgatgattccttttctagacaaaactgaaaatagtatgtctcttttcagctaacctagtcaggaggaataaggagtatatttgtgtgacctggaatatataatattaaatcatctagttgttgaataagtatagttttccttgtaaaatccaagttctttaaatcattggtttggcattttcaaaagtttgaaggagacagtgaatcctagtatcaaaggatttttggcctcagaaaaagttgttgattatttttattttattttatttttcgagacagagtcttgctgtgtcacccaggctggagtgcagtggtgcaatctcagctcactgtaagctctgccttccgggttcatgccattctcctgcctcagcctcccaagtagctaggactacaggcacccgccaccgcgcccaactaattttttgtatttttagtagagacagggtttcaccgtggtctcgatctcctgacctcgtcatccgcccacctcagcctcccaaagtgctgggattacaggcgtgagccactgcacctggcgattatctgtttttttttaagagatgaggtctcactatgttgcccaggctggaatacagtggctattctcaggtgcaatcatagtgaattatagccttgaactcctgggctcaagtgatcctcctgcctcagcttcctgagtagccaggactacaggtgtgtgccaccgtgtctagctgacaatccacagatattataaagagggcggcacttaaattaacagaagtgaagtatttactttcaatggaagaaatacatactggggacggatagtcctggaaattctggtgtactattcagttaatggtttccattgagtttctttataggtaatacaggtactaacacaggatgcaatcagatagggcatattccattggggaattagatattgccagtgcagttatatagttcttttactcttgggcacttatatatggtaatgtatcaggattaaagtagagatcgatgtactagtatttatgaaaaatgtatacatatttttctttgataatcaggctgactttattgttatctgttaaacgactaacagattttattaagcatcgtgaggtttctcagaagaatatcattgctgctattccctttctggtttgatagaacaatttattttttagtgttcctacttcttatcaatgacactgatttttattagtattagaaagggactgcacttgcttagggtttgagaagttaataaattttgccttgtatggctgttaaaagccctaagtttgttcctttttttttttttcatcttctcttttggtttcttgacagtgcattgcaatttagtttttccaatgtgaactaactgccagttcattttaatctttcttaccaccctatttttaatttaaggccctttaaccaaagagagcataaagggtcccttggcattctacatcagggtcagtgtccacaaattgtttatttctagaagtctaattctaaatttacctattaattctgtggggttttttttgtttatagttttggatcttagtgtaatcaattttaatagaggatggcttcctggatagcttacaacaacctatgtccctggctcttaataaataacttttgccggtgttacggcatctgtcttcagtagccagagttggctaactatggcccgtggaacaaattggtctgctgcctgtttttgtatagtttataagccaagagtggttttcatatttttaatgactgacaaaaaagcaaaagagtaacaatattttgtgacagatgaaaattaaatgaaatttaaatttcagagtccacaaataaaattttattgggacgtagccatgatcttttatttacatattgtctgtggctgcctttgcactaccaacagcagagttgagtagctccgacagagaccgcgtgtggtgctcctgtcactttgcactgctactcagttacaattcagtaacagttataattcaacagtatttcaaatgtcataggtatccttgtacatgacctttttttttttttagtatgagtgcatacctgtctggtgagtaagaaaagtagacatctagtgttgtgcttttaagtcacagttgagcatggattattttttattgaattagatggcaaagtactgtgtctactatgcagtgacaccatagctgagttaaaggaatacaatatatgttgacattactagattaatcaatcatcacagtattcccaactcacaggagtgtaacaatcagaaaaactagagaatttaagatggaatatattacagcagaatttgttcacaaaaatagaaaatgaaaatgaggctgcaaccaaagtttggtttctgagtggcttattagtcaagcaaagaaagtgggtttctaatggcaagtaaattaagtcctgtttaatttaagcagctgaagaaatgtatccaggactagtagtctttaggcaagactagttgcttcaagagttgaggacactgaggacagacatcagtagtcaattaaaaagcaaggcaaattattttgaatgatgttccttggctcttgataagttgacctgtgtaccaatactatttgaggagtgagtgctgagtttgaagagactggagaattaccctttgtgaatagtgtatgtggaacaaccacaggcaagaatttattttattttattttatttttgagacggagtctcactctgtcaccaggctggagtacagtggcatgatctcagcacactgcaacctccgcctcctgggttcaagtgattctcctgcctcagcctcccgagtagttgggattacaggtgcgtgctaccatgcccggctaattttttttgtatttttagtagagatggggtttcaccatgttagccaggatggtctccatctcctgatcttgtgatcctccctccttgtcctctcaaagtgctgggattataggcatgagccactgcgcccagccacgtgagaatattttcaaagaaaatgtgaaaatactaattcagtaaacctgatgtggaatctgctaagatgtcttatatagatgatggtggtaaaaatacatgtggagcagaaaaagccttagttggacaaatttataaagtttgtgaaaacataagatatttaaagccttttcatcagtagatacttcccagaaaatatttgtcatgagtaggaactttgtggaaaatgcttaaatcttgtttgctgttgaaccaatagtatcacctttgaacttgtggacttaaccactgaaagaaatagaagctgataatcctgacttgtccttctacactgcatttcagtggtttagcagttttactgccattttttgagctcaggattgaaaaattcaaaatggaaatttttctgaataagaagacccacctgtcaaccactattatcaaacactgagtggcttagaaaattaggttttgctgcagacgttatttttcttaatgcattcagtgtaaaattacaggggaaaacagtgcttatatacaaaacttactctgctgtgaagtcatttcaacagtagatacattatttgaatcaaagtaatgtcagtcagctttatgtacttcccatgctgttaaaagtttaacacaagcactcagatccgcagtggcagtggtgtgtcctgtctgcggagagccaggccagagacaatgagcaacacctcagagaacacgagggcgtgccgcgaagccgcccacccttccgactgcggcagctgctgacctgctgttgccatgacctgcaggaaagccaatgaggagggcagttggaagaaattcttctggaactcagagaagaaggagtttttaggcaggaccggtggcagttggtttaagatcattctattctacataatattttatggctgcctgactggcatcttcatcggaatgatccaagtggtgctgctcaccatcagtgaatttaaacccacatatcagaaccgcatatcaggaccccaccaggattaacacagattactcagatccagcagactgaaattgcctttcatcctaatgatcccaagcactgtgaggcatatgtgctgaacgtagttaggttcctggaaaagtacaaagattcagcccagaaggatgacatgatttttgaaaattgtgacaatgtgcccagtgaacccaaagaacgaggagactttaatcaagaatgaggtgagcgaaaggtctgcagattcaagcttgagtggctgggaaattgctctggattaaatgacaaaacttacagctacgaagagggcaaaccacatgttattataaagctcaagtgagttctaggcttcaaacctaagtctcccgagaatgagtccttggagacttacccagtgatgaagtataacgcatctgtgtttcctgttcagtgcactggctagcaagatgaagataaggataaaaatagaaatgtggagtattttggactgggcacctaccttggttttcctctgcagaattatccctactatggcaaactcctgcagcccaaatacctgcagcctctgcttgctgtacagttcaccagccttaccatggacactgaaattcgcctagtgtaaagcagatggtgagaacattgggcacagtgagaaagatggttttcagggatcctttgatgtaaaaattgaagttaagagctgatcacaagcacaaatctttcccgctagccatttaataagtttaaaaaaagatacaaaagcctgttagtcttgaacaaactgtcatatgtatgggacctacacttaaagcataatctatatgctttacacttgctttctgcatttaattggttagaatgtaattaatgtaaactaaagtgtagcaatagcaacaaaatattctactgtaaatgacaaaagaaaaattgagccttgggatgtgctcatttttactgtaaattatgattccataagtgacttgtaagcagtgtttctggcccctaagtattgcctcctatattttatttaatgtatagtactataggtgcatactctggtcctttttcaagccatgtgttatcgtatctgttttgtactttatgtgagcaggttttgctgtccaaggtgtaaatattcaatgggaatgaaactggcatggtctttttttttttttggggggggctctttcaaagataatggcccatcaatgagcatctttaacatattctatagtcttttcctgtggtgttaggtcttactttattattattttttctcctgggaatgggacagggatttgtcatgggggaactgccctttaaattttaagtgacactacagaaaaacacaaaaaggtgatgggttgtgttgtgcttgttttgaatgctgtcttgacatctcttcccttgtcctctagtatgttctaaagctgtgtctgagatctggatttgcccatcactttggctagtgacaggcctaataaatttgctttgtacattttcttttactttccttttttcctttctggaggcatcatgctgatggtgtgtctttatgagtgttttaaccattttcatggtggaagaattttttatttatgcagttgtacagttttatttttttctgcaagaaaaagtgtagtgtatgaaataaaccacagtcacttgtttgaaaataaatctttattttgaactttatacaaagcaatgcagtaccccatagactggtgtaaaatgttttctactatgcaaagtccatgttctaataattgccaggagtacagtgctcttgttgatcatgtattcagtcaagttaaaacaatggacaataaaagaatgaatacatgaaaaaaaaaaaacagaagacatctgcagcagatatattttccaagcccaacctatagttccagaagtgtttttcagatttccatgcaagtgcagaggaaatttacatatttcaaaatccattaaatagtgtagttgagcagctttctcctgacttcaattggaagtgattagtcgtcaatgtaagaagatgctaaaaggcaaatatcaacaagaatttcatagaattctataaatgctttcaaagcaatgaatatagttatttaaaattatgtttatagatttatatcagcatttggcagtacctatctgtaagattttgaatatgaaatagtaacatatcagatcatcatcaatagatgaacatttacaattaattttgatgataaggaatactaactgaatcccaattaagtgaaatattttatcctatccccccaaaaagaattctgttcttctcattagtagacctgtattacaaagaattgcactcacatatttttattatattttaaattttgtcaaaaaatttcatggaaatttgtagttatttcttgctataccttcatcatgtcctttatattacctcttggcctccaaagcatgaaatatttgctatctagctgtttagtcagttctcgtattgctataaagaaatacctgagactgggtgatttataaagaaaagaggtttaattagctcacagttctgcaggctgtatagaaagcatagaagcttctggggagcctcaggaagcttccagtcttggcggaaggcaaagatggaacaggtatcttacatagcaggagcaagagagagatgggggaggtgcctcacacttttaaatgaccagatctcatgagaacgaactcaccagtcgtgaggacagtaccaagagggatattgctaaatcattcatgagaattcacccccatgacccagttacccccccaccaggccccacctccaacaattggatttcaatttgacatgagatttggatggggacacaggtccaaaccatgtcaccagccctcttcgaaaaaagtttgccaaccctatttcaatggtttcgttaggattccaccccattttatttatttttgttattagtaacctggaaagaagctatgaaactggaaggatgtaactagaagccttggagtataaatatttaggaggattctaaattatttgactatctcagttctgcacaggaccaaggcttagaaatgacaatatttccttctccagatgagttggcaaaatttcaaagtggaaattgtgagacaattatggtcaataacccaggaagaaaagggatggagggagtttcttgagagtataggagttcattaccaggaggggagcagtgggataggaagatcaaggaagagggaagagggagaagaagatatgcaaggaaagaacaaagtagcagtgctcaaactgtcctaatgttggtcaatggaagcacctcagttggctcctaagtccctttgtcataactctagtatcatggcgtccttactttcaggaataatatgtttcagattcatcttgtacgtttcctgtcctgggttggtaatcaactatttctaaaaggagccacttttctttttactggaaaataaaatcaagttaaagtaattacatacttgatttattctatgtctctacacacatagagaataaagtgtagtttcaaatagcagtattaatactaacaatgtaatttaagatttctttgcttttctttgtatctttagtatatatatcccactagagatgtatagttcaatttctgtgtgttaaagtcacttaaaatttttctatatagaaatatcatcagtagatatacagttaggctcatttgtttcattttgcttctgatttttaaaaataattttgattttattttataattgcctaaaaatttacatgatttcttagtcaaacctacagaacagatatttcagagaactctagcttccatctctgtcctttccactctaagtcctctctcttgtataagtaactgttttaaagtttttgggttttttttttaatacttaaaatataagaaaataaagccaggctccatggctcatgcctataatcccgggactttgggaggctgaggtgggaggatcacttgagaccaggagtttgagaccagcctgggcaacattagcgagaccattttccttaccaaaaatttaaaaataaaaataatattttttaaaaaaacgtacacatttgtattaaacgccatacccttcataaataaggcatactatacatactttctgctcttgctttttttttgaggcggagtctcgctctgtggcccaggctggagtgcagtggcacgatcttggctcactgcaacctccgcctcctgggttcaagcaattctcctgcctcaacttctcaagtagctgggactataggcacatgccaccatgcctggctaattttttgtatttttagtagagacggggtttcaccatgttagccaggatggtctcgatgatctgaccttgtgatccacccgccttggcctcccaaagtgctgggattacaggcatgagccaccgtgcccggctgctcttgctttttttacttaactctgtcatgaggactatgctatagcggtaaatagagacatttcttcatttattttataatactctgttttttgatataccgtaatgtattcaatcattcccccataggacgtttctagtgttttgctattaaaacgataccatgagaagccttgtaaataaaagttaaaagaattttttgtaatacaaaaatactctctcatatttttcaactttgaggtaaaaatgaaggacttgtttttgtatcaggcttagttaacttttataaaggtaatattgagaaaagaatcttaccaaactgtctttatctcattgcaaatccagattttcctgcctccttttttattgtaaaaaacacatagcccaaaatttaccatcttaaccatttttaaaggtacagttcataagtgtgtaagtatattcacattgttgtgaaacagatcttcagaggtttttcatattgcaaaactgaaacactatacccattaaataactaccccccatttccctgccaccccccgtccctggcaaccaccattctgctttttgtttctattaatttgaatactttagatacctcatataagtggagtcatacagtgtatgtccttttgagatgggcttatttcacttagcatagtgtcgtcaaggtttatccatgttgttgcatgtgacaggatttcctttttcaaggttaaataatactccatcatcatatgtatataccacattttgtttatccattcattcatccatccacggacatttgggttgcttcacctcttgactgttgtgagtactgctgctatgaacatgggcatgtaaatagctttttgaggccccacttgctattctttggacgtatgtccagaagtaggattgctggattatatggtaattctatgttacaattttttttaggaaccttcatatttttttccataacaattgcaccattttacattcctaccatcagtgcaaaaaggttccagttttgacacattgccaatccttgttattttctgtttcttgtttttttaatagtagccatcctaatggatgtgaggtggtatctcattgtggttttcatatgtatttctctgatgattagtgatgttgagtatctttccatatgcttgttggtggtttctatataatctttggagaaatgtctattgaaatcctctccccattttttaatcagtttacaaatccaaattttttataacttaatatttttgctgttagctagtagcgcatatttaacatagtcctgaagagaatatcatgttcatctaaactgtgactggtaagaatatctatgacctaaatttattttgttattcttacagggctatttagaaaccaaaaaatattaagagaatacagagatttcttgggaaataccaaggtatggatatctttgtaataatgtgtgtgtttgtgttgcacagcaaaattctaatatcagtccattgtaaaattctagcatgtctgtgatctcaatctaagattttcttgagtacattgtagttcactgaattatagtcaattcattcatttccgtctgattttcctttttttttttttttgagacagagttttgctcttgttgcccaggctggagtgcagtagtgtaatctcggctcactgcaatctccgcctcccaggtttgagcaattctcctgcctcagcctcccgagcagctgggaccacaggcatgccaccatgcccagttaatttttgtgtttttagtagagacagagtttcaccatgttggctaggcgggtcttgaactcctgacctcaggtgatgcgcctgcctcggcctcccaaagtgttgggattacaagcgtgagccaccgtgcccggcctgattttcttgaaatttaaaacatttgtacataagttttctttaaagtcataaccatgttatgaaccttaagcatgtagatatagatgaggaagactttattttcttaggttttagtgagatttatatctgtcatacacactcttaattttctttagcctctctctttctgctcctaactctggttcaacattcagactgccaactctgtgcttgtatccaagaagcttagcccttggagaagaaaattacacagccagtgtgattgttctttcttccttatatgactatacaaaatcaatggatactcaatattatttgacagtcttactaaacttccagagtatgttcaccttcccactctttgaaatagctattgcatatctttttctttcttgccaacagcctcactctttactcttcagctgttgactttgcttcatattttattgaaaaaataggtgtaatttcataaaagtacctcatctttttcatcacctcatcttttcatcaccaaatttactaactcatctacacatgtgacaaaatactctgctttccttcctactagaaggaaattaatattgggacacatgtagaaagtttgcctctactgttctacctcttattttctcctgaacctaatccaattgggctttcaaccccaccaccccactgaaatgacttaccaaagtccccagcacctttaagatgccaagcagtctatggccaagttgactttccatttaaacttggctgggaggaatctcctatcaagaagttaatgtcatatttggataaaaggctacctatgcacattttcttctctctggtggcatttgagacattgcacccattttgcaaagtttagacattggcagtgatgataattttagccaaatcttatttgatatgctttccttttccatttattatcttcaagacctcttaatttccatttcccctttgatcactgcatttctggcaccccagtactgccctgaagatgtggactctcctctggtagagccttcatatgtcttacgagccagcattttcactctcatgcctcaagggctattgccattgcctcttgtgctgggataacttaggctggtgagacctgcctcctgggaagattcactcctcgccttcacatctgtttcacatggagaatcatcctcaccagattttctaatagtagctgttgacttatgaaatctttgttacttcagaagattaatactggtcaacttttgaatattccatgttttgaaatgattttttttgctattacaacgtttttttgctgggacattaggataaaactagtatttcatttccctctactgtacccctattccctttaggaatggttgttctctcactgaagatggttgctttccttctctaaaacatagggctaatcctgtttgcaaaaaataaaagccctcctttttttttttttttttttttttttttgttatttctgacccagacacttgtttttccaatatattcttatctcatgagaactccaataatgagatatatgaaatcacagtgttctgggtctgctcctctggtatttaatttcttatataataatttcccctttaatacctttctactttcccatgccttcccttctatttctaattcatgggtttcttgatatagtacttcagagaattggaagtacctttatctctgcttaatatatttaactccacaatagtatcaccttgaaatgcaccaataatgctttgaacaatttatgctccttttcctggtagttctctctgaaatctatccaaattttctgcacttgtcccaatattaaagaaccttgtttattgtgaatgttctcaaagatatataaaaatagaaaaatagatattggctatccagtttcattaatttctaacattttgctgtcctggtcttcaaaaaggggcagttctccaattgctctgattatggaattttttaatattttattttattttatttttgagacagagtattgctgtgttgcccacgatctcagctcactgcaacctccgcctcccgggttcaagagattctcatgcctcagcctcctgagtagctgggattacgggcacccactaccacagccggctgatttttttgtattttagtagagacggggttttaccatgttgtccacactggtctcaaactcctgagctcaagcagtctgcccatcttggcctcccaaagtgccaggattacaagcgtgagccactgcgcccgacctgattatggaatttttgagtagcttttacaggaagcttcccaagcaggttgtggatcctggctccttgtgatctcttgtttttctagatttttattctcttgttagagttccttggaccttatcattatttctagtttctaccaacacatcttcccgttttctacagccttctttattagagtggtttgggccgagtgaatctttttccttatttttcttattatttcttattctgatcttaaagatctcatttcctttccctgttttgcccctcccatgagttcccaaacctttcttctaaagaaatcttatttttcaccgtaagcagcattctattgttcccataataatttcattgagttttttctctattcatccaaataatacaatatattcttattttaataaaacatacattctgtttgttatcaataaacagtataattcagaaatctagacccatagtcagagtttatggcttacaaatcgaagtaaaagttgagatcacatggacaaggtttatccctgtgtagttccttctcttagctctgaaggcaggtcaatacagaattttgggtgtctgatttcacacattcttagagcatatgaatttcagcacagtgcatttttctactttattactagtttttatgtagccagctcagatcctttctggaagtaggcaggacatgaattacaaggaaacaaaacaaacaagtttctggaaagagacccagatatgctttcggttttaatctttccactttctaaacaagaacttctagagaaaaataagtaaatctaattcagaagttttgatagaggaaaatgttctggtctgtcaaagccaccagttatagtgcttctctgcaaaattttggaggtattaaaaaaagtttttgtttttttacagccacgctccagaacagcatcagtgttttttaagggaccaggaaaagtggtgatggttgcaatttgcatgtaagtactgaaaaataagctttgtgaaatagaatatattcttttaaatatgtatatccttaaatatgtaaatttattacatggtagctagctatagagtttgaggtttattttgttttaggaggaaattgaataagtctttattattgtcagtaaagtggtggggaaagagcatgaattcatatagataaccatgctcattctctgtatatttttgatgtagttagatctaagaatagttgctacctgaaaatcctttcttgtttttattggagttgatagaagtcttttttaaagaagttagctaaaccaacctgggttacagctactgaagaatatctttgtgcttattatctttattccacttatcttggaagaacataattatttgttcttgttatttttgcctcctctttttttttttttttgagacagagtcttgctctgtcgccaggctggagtgcagtggctcaatctcagctcactgcaatctctgcctcccgggttcaagccattctcctgcaacagcctcccaagtagctaggattataggcgcgtgccatcatgcccagctaatttttgtatttttagtagagatggggtttcactacgttggccaggatggtctcaatctcctgacctcgtgatctgcccacctcggcctcccaaagtgctgggattacaggtgtgagccactgagcccggccttgccttcccctttttccctctatcttcttgattcctattgttttgttcaccttttgtctgtttttctgactaatctattttaggatggatgaaatcattcaataattcattagttcttttattcttaaatatatatatgtaaaatatgtatcagatagtgtgataggatatgaaaatataaagatataatacataattctttaaggattggagggacactaaactagaggaagacatttataatacagacaaggaataatgctgtcataactacaatagtggtggtacagatagacgtagacagtttcaacttcttagaaggcatgttcaaggatagtgaccaggtttctggctgtacaattgtgtaaataatgtaccattcactgaggagagtactggaaggaggagcagggtgggagcagagaaaatgatgagttcatttttgagctggtggtatgtttagggcacccaggtggagataagtcaacagggttctttccaccagtaatacagggatagtgattatagcttttctcattggagggatgtatgtgtgaaaagtgcttaacatagtacctgctctaagatatgtacttaagaagtattattgttaatatatattggtctgaagctcaggagagaaatctgagttagaggtttgatagtttttagtatatagatgataactaaagccataaaagtaaagatcacctgaggaatgtatgtatatatagtatcaggaataaaaagtcctcaggaaaaattccttgaagaatgttaacattaagaaaaaggtggaggctttgggagacctcgtgatccgaggtcaggagattgagaccatcctggctaacacggtgaaaccccgtctctactaaaaatacaaaaattagctgggcgtagtggtgggcacctgtagtcccagctacttgagaggctgaggcaggagaatggtgtgaacccgggaggtggagcttgcagtgagccaagattgcgccactgcactccagtctgggcgacagagccagactctgtctcaaaaaaaaaaaaaaaaaaagaaaaaggtggaggaaaaagtgcctgcagaggagattgaggaggagtaaggagaaaagtagaaagaaaaccaggagtgtattagtccattttcacgctgctgataaagacatacccaagactgggcaatttacaaaagaaagaggtttaattggacttacagttcccgtggctagggaagcctcacaatcatggtggaaggcaaggaggagcaagttatgtcttacatggatggcagcaggcaaatagagcttgtgcagggtaactcccatttttaaaaaccatcacatctcatgagctcattcactatcacaagaacaacatgggaaagacccaccctcatgcttcagtcatctcccactgcgtccctcccaaaacatgtgggaattataggagctacaagatgagattttgtgggagacacagagccaaaccatatcaaggagtgtcaagaaagccaagggaagaagcatttgttttttttttgtgagacggaatctcactctgtcgccaggctggagtgcagtggtgcaatctcggctcactgcaacctctgcctcccaggttcaagcgattctccttgcctcagcctcctgagtagctgggactacaggcacacatgttttaaggaaatagcaggcctggtacaggcacacacctggaatctcagcactttgggaggctgaagcaggaggattacttgagctcaggaatttcagaccaccttgggcaacatagtgagaccttgtacctacaaaaaaatttttttaattagctgggcatggtgggtgatgtgcgcctgtagacctactcaggaagctgaggcaggagaatcatttgagcccaggagtttaaggctacagtaagctgtgattataccactgcactccaacgtgggcaagaacaagaccctgtctttaaaaaataaatagccagctagggggtggcgggcaagatggctggataggaagagatcctgtctgcagctcccagtgagatccatgcagaaggtggataacttctgcatttccagctgaggtacctggctcatctcattgggactggtcagacagtgggtgcagcccatggagggtgacccgaagcagggtggggcattgcctcaccggggtagtgcaaggggtcggggaactccctcccctagccaagggaagccatgagggactgtgctgtgaggaacggtgcattccagcccagatactacgcttttcccatggtcttcacaacccacagaccaggagattccctcgggtgcctacaccaccagggccttgggtttcaagcacaaaactgggcggccatttgggcagacaccaagctagctagactagttttttttcatactccagtggtgcctcgaatgccagtgagacagaaccttttaatcccttggaaagggggctgaaaccagggagctaagtggtctagctcagcagatcccacctccagagagcccagaaagctaagatccactggcttgaaattctggctgccagcacagctgtctgaagttgacatgggatgcttgagtttggtgtgtgttggggagttgggggttggggaccaccattactgaggcttgagtaggcagttttcccctcacagtgtaaacaaagccatcaggaagttcgaactggacagaacccaccgtagctcagcaaagccactgtagccagactgcctctctagatttcttctctctgggcagggcatctctgaaagaaaggcccagcagtcccggtcaggggcttatagataaaactctcatctctctgggacagaaaacttgggggtaggggcggctgtgggcgcagcttcagcagacttaaacgttcctgtctgctggctctgaagagagcagcggatctcccagcacagcgctcgaggtctgctaagggacagactgcctcctcaagtgggtccttgacccccatgcctcctgatggggagatacctcccagcagggatcaacagacacctcatacaggagagctccagctgacatctggcaggtgctcctctgggatgaagcttccagaggaaggaacaggcagcaatgtttgctgttctgcagcccctgctgttgatacccaggtaaacagggtctggagtggacctccagcaaactccagcagacctgcagcagagaggcctgactgttagaaagagaactaacaaacagaaaggaatagcatcaacatcaacaaaaaggatgtccacacaaaaaccccatccaaaagtcaccaacatcaaagaccaaaggtagataaatccacgaagatgaggaaaaaccagtgcaaaaaggctgaaaattccaaaaaccagaacacctcttctcctccaaaggatcacaactcctcgccagcaagggaacaaaactggacggagaatgagtttgacgaagtaggcttcagaaagtgggtaataacaaactcctccaagctaaaggagcatgttccaacccaacgcaagaaagctaagaaccttgaaaaaaggtaagagaaattgctaactagaataaccagtttagagaagaacataaatgacctgatggagctgaaaaacacagcatgagaactttgtgaagcatacacaagtatcaatagccaaatcaatcaagtggaagaaaggatataagagattgaagatcaacttaatgaaataaagcataaaggtaagattagagaaaaaaatgaaaaagaatgaacaaagcctgcaagaaagatgggactatgtgaaaagaccaaacccacatttggttggtgtacctgaaagtgactgggagaatggaaccaagttggaaaacactcttcaggagattatccaggagaacttccccaacctagcaagacaggctaatattcaaattcaggaaatacagagaacaccacaaagacagtcctcgagaagagcaacctcaagtcacataatcatcagattcaccaaggttgaaatgaaggaaaaaatgttaagggcagccagagagaaaggtcgggttacccacaaagggaagcccaccagactaacagcagatctctctgcagaaaccctacaagccagaagagagtgggggccaatattcaacattcttaaagaaaagaatttttaacccagaatttcatatccagccaaactaagcttcataagcgaaggagaagaaaagacaagcaaatattgagagattttataaccaccagtcctgccttacaagagctcctgaaggaagtactaaatatggaaaggaaaaactggtaccagccactgcaaaaacataccaaattgtaaagaccattgacactataaagaaactgcatcaactaatgagcaaaataaccaactagcatcataatgacaggatcagattcacacataacaatattaaccttaaatagaaacaggctaaatgcccctgttaaaagacacagactggcaaattggataaagagtcaagacccattggtgtgctgcatgcaggagacccatctgacgtgcaaagacacacataggctcaaaataaaggaatggaggaatatttaccaagtaaatggaaagcaaaaaaaaaaaaaaaaagcagggttgcaatcctagtctctgacaaaaaagattttaaaccgacaaagatcaaaaaagacaaaggtcattacatagtggtaaagggatcaatgcaacaagaagagctaactatcctaaatatatatgcacccaatagaggagcacccagattcataaagcaagttcttagagacctacaaagagacttagactcccacacaggaatagtgggacactttaacccctcattgtcaatattagacagatcaacaagacagaaaattaacaaggatattcaggacttgaactcagctctggaccaagcagactaatagacatctacagaactctcaaccccaagtcaacagaatttacattcttctcagcaccctgtcactcttattctaatattgaccacataattggatgtaaaacactcctcagcaaatgcagaagaacagaaatcaaaacagtctctcagaccacagtgcaatcaaatgagaactcaagattaagaaactcactcaaaaccgcgcaactacatggaaactgaacaacctgcttctgagtgactactgggtaaataactaaattaaggcagaaataaataagttccttgacaccaatgagaacaaagacacagtgtaccagaatctctggaacatagctaaagcagtgtttagagggaaatttatagcactaaatacccacaggagaaagtcggaaagatctaaaatcgataccctaacatcacaatgaaaagaactagagaaacaagagtaaacaaattcaaatgctagcggaagacaagaaataactaagatcagagcagaactgaaagagatagagacaccaaaaacccttcaaaaaaccagtgaatccaggagctggtttttttaaaagattcacaaaatacatagaccactagccagactaataaaaaagaaaagagaggagaatcaaatagacaacaatgaaaaatgataaaggggatgtcaccactgatcccacagaaatacaaagtaccatcagagaataatataaacacctctacgcaaataaactagaagatctagaagaaatggataaattcctggacacacacaccctcccaagactaaaccaggaagaagttgaatccctgagtagaccaataacaagttctgaaattgaggcagtaattaatagcctatcaactaaaaaaaaaaaaaaaagcccaggactagacggattcacagccaaattctaccagaggtgcaaagaggagctggtaccatttcttctgaaactattccaaacaataggaaaagaaggactcctcctcaactcgttttatgaggccagcatcatcctgataccaaaacctggcagagacacacaaaaaaaagaaaatttcagaccaaaatccttgatgaacatcgatgcagaaatcctcaataaaatactggcaaagcaaatccagcagcatgtcaaaaagcttatcaccaccatcaagttggtttcatccctgggatgcaaggctggttcaacatatgcatcaacatatgcaaaataataaatgtaatccattaaataaacagaaccaatacaaaaaccaaatgattatctcagtagttgcagaaaagcccttcaataaaattcaacaccgcctcatgctaaaaactctcaccttaaactaggtattggcggaacgtatctcaaaataaaaagagctatttatgacaaacccacagccaatatcatactgaatgggcagtagctggaagcattccctttgaaaaccagcacaagacaaggatgctgtctctcaccactcctattcaacatagtattggaagctctggccagggcaatcaggcaagagaaagaaataaagggtattcaaataggaagagaggaagtcaagttgtctctgtttgcagatgacatgattgtatatttagaaaaccccataatctcagcccaaaatctccttaagctgataagcaacttgagcaaagtctcaggatacaaaatcaatgtacaaaaatcacaagcattcttacataccaataatagacaaacagccaaatcatgagtgaactcccattcacagttgctacaaagagaataaaatacctaggaatacaacttacaagggatgtgaaggacctcttcaaggagaactacaaaccactgctcaaggaaataagagaggacacaaagaaatggaaaaacattccatgctcgtggataggaataatcaatatcatgaaaatggccgtactgcgcaaagtaattaatggaatcaatgatatccccatcaagctaccattgactttcttcacagaattagaaaaaaaacttctttaaatttcatatggaaccaaaaaagagcctgtatagccaagataatcctaagcaaaaagaacaaagctggaggcatcatgctgcctgacttcaaactatactacaaggctgcggtaaccaaaacagcatggtactggtaccaaaacagatatatagaccaatgtaacagaactgaggccttagaaataacaccaaacatctacaaccatctgatctttgacaaacctgacaaaagcaatggggaaaggattcccgatttaataaatggtgctgggaaaactggcaagccatatgcagaaaactgaaactggaccctgtctttataccttatacaaaaattaactcaagatggattaaagacttaaacgtaagacctaaaaccataaaaaccctagaagaaaacctaggcaataccattcaggacataggcatgggcaaagacttcatgactttcacaccaaaagcaatgggaacaaaagccagaattgacaaatgggatctaattaagctaaagaacttctgcacagcaaaataaactattatccgagtgaacaggtaatctatagaatgggagaaaatttttgcaatctatccatctgacaaagggctaatatccagaatctacaaggaacttaaacaaatttacaagaaaaacaaacaactgcatcaaaaagtgggtgaaggatatgaacagacacttctcaaaagaagatatttatgcagccaacaaacatatggaaaaaagctcatcatcactggtcattagagaaatgcaaatcgaaaccacaatgagattctatctcacgccagttagattggcgatcatttaaaagtcaggaaacagcagatgctggagaggatgtggagaaataggaacacttttacactgttggtgagagtgtaaattagttcaaccattgtggaagacagtgtggcgattcctccaggatctagaaccggaaataccatttgatccagcagtcccattactgtgtatatatccaatagattataaatcattctactataaagacacatgcacatgtatgttttttgtagcactattcatattagcagacttggagccaacccagatgcccatcaatgatagactggataaagaaaatgtggcacatatacaccatgggataatatgcagccataaaaaaggatgagttcatgtcctttgcagggacatggatgaagctggaaaccatcattctcagcagactagcacaagaacagaaaatcaaacaccacatgttctcactcataagtgagagctgaacaatgaaaacacatggacacagagaggggaatatcacacactggggcctattggggggtgggtggctaggggagggatagcattaggagaaatacctaatgtagatgacgggttgatgggtgcagcaaaccaccatggcacatgtatacctatgtaacaaacctgcacattctgcacatatatcccaaaacttaaattataaatttaaaaaataaataaacattgtttaaaaaaagaagaaaatagtgtcagatgctcccaggaggttaagagaaatgctaaaatatttccaggaatttagtagtatggaatggtaggtggtattgataagatgaaaactgtgacagacagaataaatatgatgtttttaagaagttatctgaggtggaggagatgggaaaagggtagctaaaagggaacatacagttctctcatttataaaatgggggtgttaatatttgtataacagacttgtaatataacatggtaactcactagataacgtctgagataaatcatattagtcattactgttagtatctgagcagctagtttcctcagagttaactgtgtttattttggcatctagctgcttctagtatgactctgagactgcttagagtcacctctggcatctgcctccttaagtaaacagattttcactgaagtcttgcctttgacactggcccaatggacagtatcaggtgcagatctgcttttatctacctgaaacacataattttcttttacattttatcttgtccacatatagaagaccgtcttttctcaccagttttcaaaatatacttaagtaatttgcttacacatagcatgcctcttaacagtacataatctatattttttcaaatttttactcttgttacctaaacaaagttttttaaggctagggattcttttaattgtacttgttttttttgttattgttgttgttgttttagcgatggggtctcactctcttgcctaggctggagtgcagttgcacgatcatagctcacttcagcctcaaactcctgggctcagatgatcttcccacctcagcctctcagtagctgggactaaaggcgtgcactaccacaccagactaagtttttaaaaaattttttgtagagatggggtcttactttgttgcccagactggtcttgaactcctgtcctcaagccatcctcccacctcagcctcccaaaatgttggcattgtaggtgtgagccattgtgcttagcctaattttactttcaacagaatctagtgtagagatatacagctgattgagtatgcttttggcttaaatttttgtccaaacctatgctaaattgttttctctttctcttctagcaatggattaaactgcttctttaaatttcttgcctggatttataccggttcagcaagtatgttctcagaagctatacactcattatctgatacttgtaatcaggtgaggactaaagctttttttataagtcaattttaaagtaatagttgtaggctttaatctaaaagttgatctattttaaaactgaatgattccagtagttggcttgtgggataaaataaaagtttacttttcagcaatgaagtgcatagaaatttaatcatagtattttaaagcagattgttatgctttaagaacctctgacaatggaatgtgaagtataacattgtcagtcactgagcagaaatctggtctctgaatatgaattctcaatgactgtaatagtcaatgaatttaaacttttggaataaagatgtaaaatcatatgtaattggttaaaatgctttcacattagattcataatttgaattactttccttggctttgcaaatggagaaaaatttttgtattaatacaattaaaagaccttctaaaccccctgtggcccaaattgtgaaaactagaaacccaaaacttttctaagaatataataaaaatttctgtgtgtgcatcctattacattttaaagagtgtggtatattaagaggataccttttcaatatttacttatttttagtcctgttatgtaaaaactgatttgggagaacttcaatgagagacacaggtaaaataagaatatttaagacaaggataaaaataacgtgaagataaggagcaaggagagcaatattaattaaaaattaagcctgtgaacttgtctcactcactgtcaaatcagatggattaaaacccttcataaaagtaaggaaagaagacaagcgtttgccattagtactaagtatttaccttgaacttaatttttatactcaatatatacttaaatactgtctctataaaattttaccattcaactgtggtatgcagtgggaggagaggggatagggagagatatataacttataatctctattttcttgtaagcttatcgaggaaagttgaaatacagaaatatttgtccatatggcaaggagatatgtatgatgttattagtttcaatattagtttttatttcaaacattgaagacagtgtttaagtgttcattctctatgctattcaggcatttaaaaagaatgtagtagatatctgtgtactgacctggaatgataaccatgataaattgagtaaaaaatcaagttgcaaaatactatgttcagaacttctgctttcacccatgacagactaacagggattgagtttaatcttttgccataaacaactaaaagctagacagtatattggataatagcagcataagaccatgatctctgagagataagaaacaaattatttgaactctctgatctctctggctttttgcttgaacacatatttgggatagtggagcaggatgggaaataacagtctcattgagttgagaagacagaaatcagtgttcagggcgtctgaggtggctagaacttacaaggaagagttccacagaggaaggagctacaaggacaaaaagctatagaagtctacatagggatttccttgaattgaatgtttgctgaatgttaagttacacatgtgtaagatgtgagcatcaatctgggcagagaaccagcagggagcagtaactgactaattcccactgctcacacaaagctaggttacattcaggttctgactagctgacgtaagagagttctcattgattatcgaggccaatggaaggctcaccttaggagtagggctaaattattcttaacgtaaaggctgttctagaaccctccctaacaaatcttcctaaaagttctaaaggatcaagctgatcttcaaataatttaatcacttgccagaacaaagcctcacattctttaataaaggcagcaaaatccaaacactcagtataacattcacagtgtttagcatccaataaaaaagactaatcgccagtataagaagcaggaaaatttgactcataaccaggagaaaaatcagtcggaagcagactaaacagatgatagaattagcagacaaggatattaaacagctatttcaagtacagtcatgtattgaaaggaaaatatgaacataagaagataaatcaaaggtataaaaaataaaccaaatgaaacttttagagctaaaaaaatatatctggtgtgaaaaattcactgtatagaattaacagcacattagacactgcaggtaaaacagtcagtgaacctgaatatgtaacagcagaaaatattcttactaaagccacagacaaaaaagattgaaaaaaatggaggaagccttggtaacctatggaacaatatcaagagtattctgtcaagcatttagggaagaaacaatgctgagtacacagactttcagaaatagagaatgaaatgtttttctactgctttaatgaggctagtataaccctgatgccaaaattttacgaagtcattatgagagggaaaaaaccctacagaccagttattcctcatgaacacagatataaaactccttaaaatataatcagattttattatataaatatataaatatgatatatataaaaatgatattatatcataagtgagtaagatttcaggagtgtaaagttggtttaacattcaaaatcagtaagtatagaaggttaatatgaagaaattaattgcatttctactatcagcaaataaatggggaaggaaattttaataaattccataagtagtatcacaaaatattaaatacttagagataaatctagcaaaagacatacaagacctttacgctgaaaatcataaaatgttgctgagagaaatcaaagaagacctaaagaaatggagagatacaataccgcgttcatagattggatgtcatagatctgtcaaatctccctaaattgatttacagatataatggagttccattcataatatgaacagacttctctgtacaattgacaaaccgaataaattccaaaattcatacggacatgcaaagaacctggaatattcaaagcaatcttgaaacaagaaatttggagaacttcaagacattataaacttatatagaaattaggacagtgagttactggcataaggattgacaaatcaatggaacaaaattgaggatccaacaacagagccacatttacatggcccgtgcctttcggcaaaggtatcaaagcaattgagtgaggaaatgaaactttttaaaacaaataatgttggaaaaattggatccatatggggagaaaaaggaccttgactcctacttcacacactgtatacaagtttgaaatggatcatagtccaaatataaaagttaaaactatgaagattctagaagaaaacctaggagaatatcttttagacctggtaggcaaagatttcataaataggacacagaaacaatatcataaaataagatttacaaattcaacttcatcaaaattaaaaacttttgctcattgaaagacatccttaaggaaataaatacgcatagattgggagaaaatagtcacaaagcattctgacaagggactggtatccaggattaagaaattccacgattcagtaataaaatgagaacccagttttttccccccaaggataaagatttgggcaggtacttcacaaataaggaaacatgaatggtggccagtggacacctgaaaatgtgctaacaccattaatgatcaggaaatgtatattaataccacaagacatctctgcatatccactataatggctacaagtaaaaacctgacagccaaatgttggtgaagatgtggagcagccagatctcccagtcattgctggtgtattactaaaatggtacaaccactctggaaaatatttggcagcctcctataaacatatacttatcctgtgacccaccaattccacttctaagtatttacccaagggaagtgggaatgaatggtcccaaaagatttgtataagaatgttggctgggcgcggtggctcacgtctgtaatccgagcactttgggaggccaaggcaggcagatcatctgaggtcaggaattcgagaccagcctggccaagatggtgaaattccatctctgctaaaagtacaaaatagctgggcatggtgatgggcccatgtaatcccagctactcgggaggctaaggcaggagaatcgcttgaacccgggaggcgggggttacagtgagccgagatccgagattgcaccactgcactccagcctggatgacaagagtgactcggtctccaaaaaaaaaaaaaaaaaaaaaaaggaatgttatagcagctttacttataatggctgaaaaaattggaatcaacccaaatgtttatcagcagtacagcagataaacaaattgtggtatactcatacaatggaatattatctggcaataaaagggaatgaagtacctttctgactggcaacatagatgtatctccagcaaggaactttaatttttaatagtttaaaaaaattgggaaaaatggttgcgtctgatgtcggggaggaaagaggcacagggagctttttgggaatgatggaaaggttctgtgtcttcataggaatatatgtttcaagggtatgtgtatttgttaacaaccagaactgtacattctgggccaggtacggtggctcatgcctgtaattccagcacattgggaggccgaggtgggcagatcactggaggtcaggagttcgaggccagcctggccaatacggtgaaacccgcatctctactaaaaatacaaaaacattagctgagcgtggtggtacatgcctgtaatcccagctactcaggagatggagacaggagaatcacttgaacccgggaggcagaggttgcagtgagtcaagatggcaccactgtactccagcctgggcgacagaactagacatctcaaaacaaaaacaaaaacaaaactgtacattcaggatttgtgcatttcattgtatgtgaattttacctcaaaaaaattctccctatgtggaaatgtgattacttagtagatatttgataatagtaaggaattagtattgattttttttttttttttgagacagagtctcgctctgtcacccaggctggagtgcaatggcatgatctcagctcactgcaagctccgcctcccaggttcacaccattctcctgcctcagcctcccgagtagctgggactacaggtgcctgccatcacgcccagctaattttttgtatttttagtagagacggggtttcaccgtgttagccaggatggtttcgatatggtcttgatctcctgaccttgtgatccacctgcctcggcctcccaaagtgctgggattacagacatgagccaccgcacccggccaggaattagtatcgatttttaaaagtctgataatagtcttgtggctgtattttctaaaaagcctagtttttaaagagattcatccaaaatatttaaagatgaaatggtacgatgcttggaatttacttcaaaatattcatgagggagtagatatggatgaaataaaacatatttggttacatatttataattgttaaagcttaatgatggatgatttgagtttttaaaaatgttctatcagggccgggcatggtggctcatgcctgtaatcccagcactttgggaggccgaagcaggcagatcacctgaggtcaggagttcgagaccagcctgaccaacatggcaaaaccccgtctcttagagttttcaaaaagacttcagttaaaaatatttcaactggacctttctgaatagatggaaattgtatttcagaaagttgtttctttcgagacctataatatttttaaaattttaattcattgtaacatttttatgccatatgttttccctcacttcttgagagacttaagtacctccaacttttaaattagacctgtgtctctaattataatgtagttttttatttatttatttacttattttttgagacagagtctcactgtcttgcccaggctggaatgcagtggcacaatctcggcttactgcaagctccatctcccaggttcacgccattctcctgcctcagcttcccgaatagctgggactacaggcgcccgccaccacgcccggctagttttttgtatttgcagtacagacagggtttcaccatgttagccttacaatttctgttacagttcatgttggaaaacttttctgttaaatattgcacatcgtatcatttaatatcaactgagatgaatttattgagcacctgagtttgcaatgtagcaagtgtttagaagaagacatggttctttctctgtcttctttaaacaggttatatgcggttatatgcacataaaacaactagaaagatcttctaaggtaccatttatgcaggtgctggatagtatgatacttaaggaacaccagaaacgtgaagggtgatcatggagtagagagcatttacagtacttcttagccactagatgttaatgttcgttatgctgcaaactaaacaaatgctctgtaggttatatatacgtactgatagagatttatgttgtaaatgtgtagaaaaaggtctggaaggatacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacctttaatgtacaggtgtgtattagtccattttcacactgctgataaaaacatacccaagactgggcaatttacaaaaaaaagaggtttaattgtgactagggcaggctcacaatcatggtggaaggtgaaaggcatgtctcacatggcagcagacaagagaagagggcttgtgcagggaaactcccctttttaaaaccatcagatcttgtgagacttattcactatcacgagaacagccgaggaaagacttgcctccatgattcagttacctcccactaggtccctcccacaacatgtgggaattcaagatgagatttgggtggggacacagccaaaccatatcttcccgccccagcccctcccgaatctcatgtcctcacatttcaaaaccagtcatgccttcccaacagtcccccaaagtcttaactcatttcagcattaactcaaaagtccatccaaggtgtcatctaagacaaggcaagtcccttctgcctatgaacctgtaaaatcaaaagcaggttagttatttcctggatacaatgagggtacaggcattgggtaaatacagacattgggtaaatacaatgtctccatttggcgacattgggtaaatgtctccaaaagggagacattggccaaaacaaaggggctacaggccccatgcaagtccagaatccagcggggcagtcaattcgtaaagctccaaaatgatctcctttcgctccatgtctcacctccaggtcacgctgatgcaaaaggtgggctcccacagccatgggcagctccacctctttagctctgcaggatatagcccacttttggctgctttcaggggctggcattgagtgtctgtggcttttccaggtgcactgtgcaagctgtcagtggatctatcattctgggatatggagggcaatggccgccctctgctcacagctccactaggtggtgtcccagtaggttttctgtgtgggggctcccaccccacatttcccttaagcactgccctagcagaggttgtccatgagagccccgcctgtgcagcaaacttctacctgggcatccaggtgtttcccatacatcctctgaaatctaggcagagatttccaaacctcagttcttgacttctgtgcacccacaggcccaacaccacgtggaagctgccaaggcttggggcttccacctactgaagcaatagctggagctgtaccttggccccttttagtcacagctggagcagctgggatgcaaggcactaagctcccagactgcacacagcagagggaccctaggcccagcccacaaaaccacttttcttcctaaacctccaggcctgtgattcaaggggctgccacaaaggtctttgacatgccctagagacattttcccccttttcttggtgattaacattcagttcctcattacttatgcaaatttctgcagctggcttgaatttctcctcagaaaatggaattttcttttctattgcattgtaaggctgcaaatttttgaaacttttatgctctgtttcccttttaaaactgaatgccggggctgggcacagtggctcatgcctgtaatcccagcactttgggaggctgaggcgggcggatcacgaggtgaagaaatcgagaccatcctggccaacatggtgaaaccccatctctactaaaaatacaaaaattagctgggtgtggtggcacttgcctgtagtcccagctactcgggaggctgaggcaggataatcgcttgaacctgggaagcagaggttacagtaagccaagatcgtgccactgcattccagcctggcgacagagtgagactttgtctcaaaaaaaaaaaaaaaaaaactgaattcctttaatagcacccaaatcacctcttgaatgctttgctgcttagaaatttctccagccagacactctaaatcatctctctcaagttcaaagttcacaaatctctagggcaggggcaaaatgctaccagtctctttgcttaaaacataacaagagtcacctttgccccagtttccaacaagttcctcatttccatctgagaccacctcagcctggactttattgtccgtattgctgtcagcattttgggcaaagccattcaacaagtctctaggaaattccaaactttctcacattttcctatctttttctgagccctccaaactgttccaacccctgcctgttacccagttccaaagttgcttccacattttcgggtatctagagcagcaccccactctactggtaccaatttactgtattattctgttttcatgctgctgataaagacatgcccaagactgggcaatttacagaaaaaggaggtttaatggacttacaatttcacatggctagggaagcctcacaatcatggcagaaggtgaaaggcacgtctcacatggtggcaagacaagagaagagagcttgtgcagggaaactcccctttttaaaacaatcagatctcataagacgtattcactagcacaagaacagcatgggaaagacctgccctgatgattcagttacctcccaccagatcccacaacacttgggaattcaaaatgagatttgggtggggacacagccaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattctgtgtatttagggtagggtttccaatattaagacctaaaaatatatttgtattaagtattttcaagtttctttaatctctattttttattagaaaaaatgtgtctattaaatttcttgtaacctaagggaaacctcatctgtgaagaagtcattatctagaaacttcacttatctgattatttgatatgatgctggaaaaaggaaaagcctcagattaatcaactaaaattacatagggaattcactcagaggctttatatttttatcaaatagttctaataaggtagtcttatgatgtgatttctagattcacatcaaattaggatggaaaggacttactagggacaagcatactactattgagaagttccagtggataactctttaacaaagggcaaaactttaaaaaccacctaagtggaaatgaaagaaagaaggaagaaatgatgaaggcaagtgagacagaggagaggcagtcagaaaggaaggaaagaaaagaatatgatatataattcctgtgcatggttttgcagttttaatagaaatgtgtgtgcccatacacaatatatatatattgtttaaagttgttattatcttttacttgtacagctatacaagttattcttcctgtaaaaagtcaaatattagactaccttaattctgcctctcttcagagatacaaacatagttacttgcatgttcttttaaaccttttctgtgctttacattatatgtagtttataaaaactacaaagcgtaagttctgtactgtacatactgttcctaacttgcttttttctcttcttccacttaatggtatgtctaggagctttatccatgtcagtatagaaagctctactctaaccctatttttttaacctactgtagaagtaatttatggtttatcatttattttgtcattcccaattgatggattttttttaggttgctttcatgtttctcatctttataaacaatggtgttttgaacccctttgagttcatctttattttttaaggtaagtactagaaaccagaattgctgggtcattggacatgcatatgttgagtgtttctttgtcattgttagcctgcaccctccacattggctttaccatattatactctccatcttgctaatgattattcacctttttttcttcttcttcatagggtttactagcattgggcatcagtaagtctgttcaaacaccagatccttctcatccgtaaggacattgccttattttgtttttgtttgttttggcgataagtcattgaaataactaaatatcagaaatctcctgcaatttatgtacctgcagtttgttcaagatttggtcatttcttccactgtagtatctaaaatgcagaacttcccactgtgtcaaagtaaattcaaggtataatttgaaaatggagttcaagttatttttatgctttgtagcacggcatggagatcttgttttctccatatttgataataataaagcacatattttgatcttagaggtctgttttatttggtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaaacatcattttaagactagcttcagtaatataatttgataaatcttaagaccaaaaaaagtgcacttttatttctgtaaaggagtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtacaaattttaaattttaggttgtgaagatttcttctcaaggtatttttatagtctactttagtgctgcccaacagaattttctgcaatgatggaaatattttatatctgtccagtatggtagtagctaactacatgtagctattgagcacttgaaatgtggccagtgcaactgaagaactagattttaaactatatttagttttaatttatttaaatttaaattgccacatgtggctagtggctcatcatattgggcagtttagacctacataatcaaaattttcaataagttaataattccttgaaatcacctgaagtaataccatttattttagatcttaatttactttaacgtgaatatatattcatgttactttagaagaaagtaaatttttctgagtgagctgattgtcacattgtcacatctataaactgggaattccccatggcaggattactctttgcaaaaaggaattccaagagcagcttgattaagaattcttgttgaaagccgggtgcagtggctcatgcctgtaatcccagcactttgggaggctgaggcaggcagatcacctaaggtcgggagttcgagaccagcctgaccaacatggagaaaccccatctctactgacaaaacaaaaaaattagccgggtgtggtggcgcatgcctgtaatcccagctactcgggaagctgaggcaggagagtcgcttgaactcaggaggcggaggttgtggtgagccaagatcacgccattgcactccagcctgttcaacaagagcgaaactccgtttcaaaaaaaaaaaatgtcgggcgcggtggcccacgcctgtaatcccagcactttgggaggccgaggcaggcagatcacctgaggttgagagttcgagaccagcctgaccaacgtggagaagccccgtctctactaaaaatacaaaattagctgggtgtggtggtgcatgcctataatcctagctacttgggaggctgaggcaggagaatcgtttgtactcgggaggtggaggttgcagtgagccaagatcctgccattgcactccagcctgagcaacgagcaaaactccgtctcaaaaaaaaaaaaaaagaattcttgtttaaatttgtatttctcagaagagtgccactgagtttgggtttgggactaaattttccaggaaatatttttattaatgagtgattcttttcctcctctagtatgttattaatatatttttgagcacctttaatactaagtattgtgtcagtactaacaataatacaaaataatgtacatattgatgaagcatgcttgaaaaataattgagattttagcaccatgaaaacacccagaaaactgaaggtcttagttctagtaatagttgaaagttgctgtgtgctaacctattcagaaccagcaataaattatgtgttgtaaacttctgtatccagcatcaaattataggtattataaataatagactggctgcacacaaagatgaaaatattcaattagaagctgcattacaaggaaatttaaatgttatcctgttcattaaacatctgaatgcattttttaaaagattaattttaccaggatctgtggtacataatagtaaagtagctctctaaatcaaaataggctatttggaaaagagatcagaaaatacctgaattaaatggtattcactttatgtattttcaaaattcttacagttttttccactttacatattgcttttcaagtttggcacttaacatcttacttaaatataaaattataacatcttgatattgttagtctttttcattgacctattaagcacatatattttaaaagaaaccatttgtatttcttgcgaactatattcttttctatttttcaggtacggattttcaaatatgcgctatatttcttcgctaattagtggtgttggtattttcatgatgggtgcaggactatcttggtaccatggagtcatgggattgcttcatcctcaaccaatagaatcccttctatgggtaatcctctttttttctcctcagttttgatgtcttatgacatagtgattgtgtacagtagaaggcctttgtcatattggtgttaaaggagaatgacatacaccttcttgactgtgtattgtagggttatgtatctatagtttaatttttagaatgtgactggacataacctctaaatccataagattcaatgatgttgaacaagatctctgtaggtaccaattatcaagccctgctccttggttaaaatcttgggcagttccactaatttctccagttactgttgaagaacaagaaaacctctgttcacttttggtcccaagaatagtctcatttcagtaattaaaatattcagacccatgtaatagtcataagttggaactatatttgaagttaaagcttctcttttcccgcatcctgggcttccttcaggtaggaagcctgcactgggggaatgggaggatagcaggatgatcacccgtatgatcccctctggggcttctgcccctctctcctattccctggaaagtgttgagggtttggataagggataaaaacataccactttactgactacagtgttattttgcattggtttcctctggcctttgtagatgtttaaaactgtctttttttttctcatgggcacttcttggagattaccctgcttggctgctctggctatggctgcccaaattgatcacatagcctaccctctcagcttctgcatctcatggtgtggtttccagacagtgctgaagttgtcttgcatttggaaagaatgccctttgagcagctgatctccttataaaagactcctagggacctgtgtgttaaaacagacatctttaacacactttctgtgggagtgcaggtttttctctcaagcccaatgatctactctgctgatacagccaatatcagttagtaggcttgcgtatggatgtatcactcaggtatgcatcagacagtttgctgtgatatccaatatcccgggggacacacatcaaggctactgaacaatcttagtagctcaacagctttcaccaaagaaatcttcatttttggcctcctcaatttcagctcttcttatgtggtctagaggatgtggagctagcatgtagtctagtgggtagaggccccaggtttgggctaccttctgtgcaaggcctgaatagatggtataacacctccttttggaatgtggggatacttgtacctattttcttctctattttgggttgtagtcagaactagacagaatcaatctgtctacttttttaatatcctgttatatcatacaaatctacttaataacaagcacattaaactaggcttatttgttattctctagttttctatagttttgattgactagtttcttaccataatacatttcatataattaaaacaaacaaatgtgtttcctccattctgaaaagatttggccactttatgggtacttcattgttctagcgttcttctaatttgtatagtgtcactttataggggcaaagcactctctgtagttagagattaggtaattagttaaattttcagttgtgtataagttttaaaacttctaaaagctcttgtgtctttcagtaactaaatgggtttccattagactatggccctttttaaaatagtgttggactaggttcaaagttttcagacctctattttaggaaagcctagggttctaaacattgttgaaaattctgtagatgtttggtttgaatttcattaaaataaaaaaaatgtgttgctaggttaactttttttttttgatacacccctgtctaaagctttttttaccatctttaattgaagagtgtcctgggattgcagggaatgtggtattaccaaaaaacaaacattggttactgtttgtaactacttatctttctgaatcaggattttcttggtattaggcatggaagcaaaatccagaagttacttgagtttgggtgtggatcttactgtatctggtgtctaccactcctgatatcaaatattgtattcatatctcattgtcctcctcatttgagttgtttcccattagtaaccttactgtctggcttaaatttgaattcgtgtttttgttttagacattacggactttatatatgaacaattgtgattggaagtacttaatttatgctttattttaatatttcttttctaggcatattgtattttagcaggatcattagtatctgaaggaggtatgtactgtcacaaagtatgtctctattcttaatttagtaatatatattcagctgtccattattatagtttgctaagttctgttgattaaagaaaagcaagtgtgggaataggcatctaagctttctctacttttagggagtaaagtctttgcataatgtactgtggttgttctgtaatggatagctgtgggggggtgtgtaactgcgccctgccatgggatggcatcctggcaaggcctcatttctctttgtgtcctgagctgctaggataggctcaagtaggtgactatcagatagatggaagacagtaactgatgtggcatgaaagcgcttagcaagcccaccatatttgtggttatttttaaactatgtggtggtaagaggtgttccttacagttttcactttgcaagcattattccttgattgaacccaccaccactactatcgctgttacttgccgattcactaaaaattggataaataattattttacttatttaaaagggaaagtatgtttcatttttgagtatcataccataatactcaaaacatttgaaatggagtataaaaaacataattaaactgaacttttaaaattagagtttaataatattcaccagaagaatattatttactggctcttgtgagacaaatatttcaaagtttttgaaatacacagctatagcagtatgatgacagagaactgctaatatcagtataaaactgcctgattcactgctgtgctcatgtttacttctgaaacattgtaactttctatgtataatgttcccttcatctatttttaaaattaacattttttattgacagatcctaattgtatatgtttatggggcccctcgtctttgaaagtctatgaaatggttataacacaacctgcttcaaaagattgggaggctcagaaatgaatgtggttagtgtggtgctgccaaatagcagctcttcaataaactaaagctgttgttattagtaattatatttaattattatggtttagaactatggggttcattttattataatgattaattgataacaactaattaacatagaacttgtccttattgccaaccctagttttaaaatgttgtgcttatttgtttatcttttgagatgccatctttaaagtttggaggcatgaagtttctgtcttgctgatatgaatgcttttcttttagcaacacttcttgttgctgtaaatgaacttcgtaggaatgctcgggctaaaggaatgtcattttacaagtatggtatgtattttagaaaccaagtgtttgtttcacctcccttatttgcttaaaattacttagtactgttattgctttgttcctaatagaaatgtacaaaatatatctgaatatcatccctgtgtggctcttacatatccttcagcccttattaaaaagaaatgtagtatagaaatttgaacatggatactttatatttggatttgacttaagtgaactaaggtatttctttatatggttatataacttgagaaagtaatttgactttatgtatcagttattgttgacatttaagccaagaaattatgtttgcattgagcaaggtttttaaaatcataatctctcatacacttttttatcttaacttatatcttgattttaaatggatacttactaaaatgttacctgatagtatcaagttaagattttagaaattttcttgtcttgtctcttccccaatgactagtaatggaaagtcgtgatcctagtacaaatgtgatattattggaggatactgctgcagtcttgggagttataatagcagccacttgcatgggccttacttctataacaggtaaatattccttaaattacaggtgatttatttgtcctacttaaataattctctaatatgtgggaattttctcttatatcattgaataatattaaaccaacaaattgttaaatgttaattccatactaatcattgacttatgtaagacatttggtcagcagaagtattcaggtttatttgaattaaaaatgtctctaaattagaaataaggaaggctatttgtaaaggatttctgtaatgctgtaagtctttctagctgtgacttaaaaaattgtgcaatcactctgaactttttatttacctataaaagtgtggataatatttaccttggtaacctcttaggtttattaagaaaatatgagagttttaataaactctaaagttccaaataaatatacataggtcctcaaataacattgttttgttcaacttgattttgttataacattgttgcgaaaaatatcaattcctaactggagctaccatctctgtggagtttgctcattctccctttatctacataggttttctttgggcaccccaacttcctcccacatcacaatgccgtacatggtcagtgaattggggtgtctaaatagtcccaatctgagtgagtgtgggggtgtgtgtaagtgtgccctgccatgggatggcatcctggccaggtctggttccttcctgtgtcctgaactgctaggataggctcaagtagatgataatcagacaaatgcaggacaataactgatgtatgaaagcgctcagcaagcctacatatttgtggttgtttatttttgaattatgtggtgataggtgttccttacaattttcactttgcaaacatttattctttgatttaactcaccacccctactattgctgatactcactgattcaccaaaaattgggtaaataattattttacatagtttttattaatttttaaaaatgtatatgtagcccacatttatttcagtgttcaatattagacatgttttgggtcttagaagttgagtgatgtttttgtgaccagaaatatgccataggaacttaactcttttttttttttttttgagacagagttttgctcttgttgcccaggctggaatgcaatggtgccatgtcggctcactgcaacctccacctcccaggttcaagcaattctcctgcctcagcctcccgagtagctgggattacaggcatgcgccaccacgcccggctagttttgtattttcattagagacggggtttctccatattggtcaggctgatctcaaactcccgacctcgggggagatcctcccaccttggcctcccaaagtgctgggattacaggcatgagccaccacgcccggccggaacttaactcttgtttgtatcagttagcttatggtaaaattggttttgttatatgttgttccctataaagtcgcagtttctaagaacctattgacaacatgaatgaggacttaaccgtatattgtggctcttgttcatttgtctttttccacacttaatgccaataataactactgttgccttcctatttctttaattctaagttgtttgtgtccttattttggtagctaattaaagtgttttgagggccaataaaatacaagtaaatgaaaagacaattctattttatttttattttcgaaaacaaccatttagcatgaaaagactcaatttatgaagttggaattctcttggaaaggaacttcttccatacttctctatttgtccttacatatttaaaataattttaggtgacgagcttccacagttctgcagtgtttcttcaaatagtctgaaatatgaatacttctttctcattctgagtgtgcattttaataccaaactagcattctctgatgtttattgtgatccaaaatatttgtaaaaatgttgattgtttttctggttgaccatatagttttagactgtttttgaacataaattactagcaaaattttaggcttaagaaaagtgtgacttgatgcagatgtcaactttgaataatttattttcttttacataataatagaaaccaatcaaatcaaacttacaaaaatatgtaatgtgttttacatgaattaaatttttcttaattagctaatttattcaaattaaattaaataacatgccaagaaataaaagttttcttaaaaaaggtattttctttcagctaatattcctgtgatttctttaagagtacatgaatgtatatatttaaataaaaataactcctcacatttggatttctaaagagcagtatttgattttgagctctataattacaaaacttctaatggataatgttttacaagcggatcatttttaacacttagtatagattaacaagtttgctttttagtgttacagcttagcaaaatatatgttttatcaagcattaagaagagttaaatatattgatgacatttcatctttgggataaaaagacttgtagtcataaaagccatgtgtaaaatttattataaagatttaaaacgtatttattggtgtctattatataaatattacctatacattcatagatgataaatcagcctttctcattggttctgggagagaagccctgacaacctaaggcaaatattagaatcagaatcacctgaagggcttggggaaacacagaatgctgaaacccacatccagaattttttattcaggggcctgaaatgaggtctgagaatttgcttttctaccaagttttcaagtgatggctgctggtccaggaaccacactttgagaagcaccaccttgaggcacctatggcatgtaatgaattaagttctctcctttttatctagaatgatactagctatatatcatccttggttggatgagaagagagtcacccatattattttctgtagggcttaattctcttacagaacattagtaggaagaagatacggaaaaaggtttctttcagcttttgatttcactgttattttgtctatctggtgtaggaaaagtgctatggatatagctaaaagaaatggactcttcattatgtcatttttttgtattggtgtctctaatctaaatgtgctcagaaacttcacatatgtaatgacaggtacaagtaagagatcttaattatgtcacatagtactcttatgaaagcaagttgtagcatcctcattttgtggtatattaaaactattaggagttgttaaaggaagtaattaaagaaattaggaataaatttcaagtgccttgatttactcgttctggttctttgctctctataaagttcactgaaataatataaactgttaatttactgatttttttatgtgcttcatttaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaaggtcagccttattccagtaatcctgttaaggcttacaaaaacatattaaaaaacagaaatgcctggtttgtaaatacttccagaggaagttttggattcctcgtcttcagaacgttttagtctgtaacttttcagaattataatcctggaaggaagaaagaatacacttaggaaactccttctaagtttccttttaaattttctatacttctaatttttagagtaaggaagagtcaagttgatataatgagaatggaagtttgcaaagtagttgtcttcttagtggaaatacttaatatggaacctgtagagttgccttatattcgcattgcaattacaaattgaatatattaaatttaaaaagatttttgttcattgggcaatgattaccaaattaaatataatttatatttactttgaaaatagactttgttttagcttattttaagtatttttcttataatctttatcttttaaattatgtaaaactaaagaactggagacttaggagataatcagcagaagagatacagaattctaatagtgcttttcagtgaaattctagcagcattgtggttttataatgaaataaaagaacaaacctttaaaaacccagttttctactaactcgctctatattttttcaaactttaaaataagatttttttgtgtattgtacttgaaatctttaagttaaatctttttaaaatgacccgtatatctgaattagtaaaatatattaatgattactagatttatattctgtgccctatatgtttaatcttgaaaagtaactatcttattggaacaagattagaaaatgagagacgggcacagtggcacatgcctatagttccagctacttgggaagctgaggcaggaggatcacttgaggccacgagtttgaggctagtgtgcaatgatcatgtctgtgaatagccactcactgtactatattctgggcagcatagcaaaaccctgtctcaaaaaaaaaaaaaaagattagaagttgagcattatgaaagtcagtattagagttattaacataatgtgagataatccaaattaatatcctttccttgtgatgtttttgtctggttttggtattaagataatactggcttcagagaatgagttgggaaatgttctctcctatttttttggaagagtttgtgaataattggtgttagcttctttaaatggtagaattcaagtatctggatatgagctttgctgtgtgggtagttttttgattagtaattatatctcttgttatggatctgttcagattgtttcttcttgacttagtttaagtagcttgtattctaggaatttgtcttttacttctaatttacctaatttgttggtatacagctatttataatattcctttgtaatccattttatttctttagtgttggtacaaatgtctcatctttcatttctgtaatttgaatctctccttttcttggtcagtgtagctaaaggtttgttcattttcttgatctttctaaagaaccagcttttggtttaattgactttctctgttgtttttctattttctttttcatgactttctcctttaatctttattatttttttccttctgcgtgctttcagtttagtttgctctttttccactgtcttaaggttaagcttttaatttgatgtttcttcttttttaaaatagacaattacagctacaaattttcctttaagtattgctttctctgcattccacacatttccatatattgtgccattttcattatctaatagtattttctaatttctttttttattcttttcagttatttaggggagtatgtcacttaatttttacgtatttgtaagttgcacagatttctttccattattgatttattattttgttctattgtggtcaaagaatatgttttgtattagttctgtccttttaaatttaccaaggtttgttttatggccttacatatagtcttggataatattcatgtgcacttgagaagaatgtatattctgctgttgttgtagagtgttctgtagatgtttgttaggtttaattggtttatagtgacttcaatttccctaattatcttcttgctctattgttctatccttttttttttttttttttagatggagttttgttcttgttgcccaggctggagtgcagtggcacgatcttggctcactgcaacctccgcctcccagattcaagtgattctcctgccttaccctcccaagtagctgggattacaggtgctcaccaccatgaccagctaatttttgtatttttagtagagacgaggtttcaccactggccatgttggccaggctggtctcaaactcctgagagacgaggtttcatcactggccatgttggccaggctggtctcaaactcctgacctcaggtgatccacctgcctcggtctcccaaagtgctaggtgtgagcaccgtgcccggcctctgtatccgttactgaaagtatcgaagtctctagttattgttgttgtattagctcttcctcccttcatttcttcttggttttggcatcatatattttggtgctctgttgttgctacatacatgtttataattttgtatatattgtttaataagtaatgtctaaaaaagagccataaactgaaagactggcaaattcgaaattttgtggaagagtgaatatctgtggattcaattattggaaaaaatacgttagtaatccagaaaattcatacaatttttttaaacagtatattagttacctactgctgtgtgacaaattggcccaaaacttagtggtttaaacaacatattaccatcttacagtttctgtgagtcaggaatcagggcacagcttatctgggtcttcgacttcagggtttctcatagactgtaatcaaggtgttgactgggattatagtcatctcctggggaaggggctgcttctaaccttactcacatgattgttcgcaagatttagctccttgccaaatgggcctcttcaacatggcagcttgcttaatcaaagcgtgcaaattgataaggcaatagagagtgagtgtgaacaagacaaaagtcacaggttagtcacctggtcttggaaatgacatctcatcactttgccatatttggtagttatagcccacattcagtgagaggagatcacacaagggcttgcgtataggtggcagggattgatcatatgggagccctccaaacagttttctgtctgtagttagttatatgtaagaacataaggaaaaagtatatctaaatatatttattagttgctactcacataccagccaaataatgaaatgtgttaatactctgtgaagactaaagtagaaatgatttttgaaaatgaataaatatgttctgtgagttaccaggagagaaaaaaaaaagaataaatgatatagccttttgccaatctgaaaaagttttgttttaacttgagcacatgtaactataaatattaaaacattaattcttatttcatccttgatggttgattaaaatatagcttccttatatggataaaaaattttggactcagtgtttagtaacctgctcaggatccctcagaaattagggtctaatgttgtaagaatacttggagtcttacgtaggcttgtttttctagtaaatctccatgtcctcagaattcagagtgttttgttatttcttatatgtgctgtacagaaaagatcttacagtgatcactgtagaaagaagagaatttctcagcagtttctagggaagattgtttactgagggttagagcaggaggggtgaaaagtagttatgcttgagtatctgctttcctgtctgggaggcaaaagggtatgatgcaaataccactgggcttggatttctgaagagctgggctggggagtcctaatctgctgtttactagctaaattaccttgagcaagtcacttatgccactctaggatggttttatcatgtataaaataaagatgtcaccctatccacttatgaaagccatccattaaatgcctgccttatagttcttactgtattaaacattttatatatgtattagctcattattcctcacatcaagtcccatgtggcagttattattaacctcattctaatagagaacttcacagcattgtatgaagacttttaaagaagctagtgaacatacaattggttaatatactctacaacaccattataaattaaaacaaatttttatatggcatttaggaaattgataagtagatatatggagacaaaggcttatgagataacatgacattttagaaaattgatttagagttaatgaatatatatatatatatatatatatatatatattttttttttttttttttttttttttttggaaacaaagttttactttgttgcccaggctggagtgcaggggcacaatttgggttcactggaacctttgcctcccaggttaaagcaattttcctgcctcaccctcctgagtagctgggattacaggcatgcaccaccatgcctggctaatttttgtagttttagtaaagacagggtttcaccatattggccaggctggtctcaaactcctgacctcaggtgatcctccctgctcggcctccgaaagtgttgggattacaggcatgagccactgcgcccagcagagttaatgaacttttaatacatgagctttataattcataaattaccataaaataatatttgttaagtttgcacctttgtatgatatcatgccaaaaaaaaagctaaacggacaggccttggaaaatgataggtggtacttaatggtgaatactctgaagccatcttagtccattctcgtaactagtggggaaaaaaacaataattcaagcctttgtgctattaaagtatatatatgtgtatgtatgtataaataaatttgtatgcattgttattgattgcagggcaattcatgatgttaaagccacagatctgggattaggtaaagtaagatttaaggcagaagtagattttgatgggcgagttgttacaagatcatatttggaaaaacaagattttgaccaaatgttacaagtaagtttatttgttgttttcttacataactgagggttagaaaaatgcttttaaggtaaacaaaatgaaatttttttttatagatcttaaaggcactttagctctcaacttcttaggttccaaaatttaacagagacctttatatttactatggaggggttcagaggagacagcaaaagaacaaacttactatttcatgcttgctatgtgcatttaatctttttttatctaatttaccctcaacaaccctgttatttcaacaatgaaataacatttttattttaacatatatagaaattgaaagacagagattaagtaatttgccttaagttgtagtgccacagagatggagtcatatatgaatcgagatctgcctgactccagaatccatttttttattaagaatagtttaaaagagaatttataaaacagaatataatgaacagcacagatgttaccacttgcccctgtcaaatcttaacattttgctatagtgtatttgcttaaggtcttaaaaaaagaaataattacaaaaacagttcaagcccccattttctctttctatatctcattcttcttcttccatccctagaattaaacattatgctgaatttggtacctgtcttttccattcagatttttatacttttcagcattttttagtgtaatatgtaacattttgaatgtttaaaaattggtataaatggtatcctactgtatgcgtctctacaattggcataacaacatattttttagattcttccgtgttaatttatatatctctagtcagtttaccttcattgttatagagcatttcaccctatgaatatgctgtaatttatttattttgtctccagttgatggacatttatattactgttagaaacaatgccatggccgggcgcggtggctcacgtctgtaatcccagcactttgggaggccgaggtgggcggatcacgaggtcaagagatcgataccatcctggcccacatggtgaaaacccgtatctactaaaaatacaaaaattagctgggtgtggtggtgcgtgcctgtagtcccagctactcggcaggctgaggcagtagaatcgcttgaacctgggagttggaggttgcagtgagcctagatcgtgccactgcactccagcctgggcgacagagcgagactccgtctcaaaaaaaaaaaaaaaaagaaagaaagaaacaatgccatgattgcattctcacacgtttccttgttcacatatatgaaaatttctttagtatggtgtatatatagatagctagattttaaataggtgggccattgggtgtacttaccttcagcttgcctaggtcttaccaagttattttccaaagtgtgtcaatttaacttccatcattgtatatcaaggttcttgcttcctattcttacatgattgtattaatagagttattaaatttttgccagtttgataggtgtgaaatagtatcttgttctaattttatttcttggagcattgaggttaataaacattgaagttcattgaccagtgggatttcctctacattgctccctgatttttcatgttttaagttcatttgcattacacttatagatttgaaaggtctttattttattgcattgtattattattttttgagacagagtctcgctctgtcacccaggctggagtgcagtggcgcgatcttggctcactgcaacctccgccccccaggttcaagcaattatctacctcagcctcccaagtagctaggattacaggtgcctgtgaccacacccggttaatttttctatttttagtagagatggggtttcaccatcttggccaggctggtcttgaactcctggaaaggtctttatttttaatatcctggatgctaattcttacttgtatatatgcaattatttttttctagtttataacttccttttctttttgttgttatacaaaatatttaatatgatttttaattttaatgtgagatttgtaatcttttcctctgtgctttttattcttttgcatgaaaaatccttccatatcccattatcataaaaatattctcttctcatctagtagttttgtggtttgttttttacccttatgtctttcatccactttgaattattttaatggtctgacatagggattcaatttttttttcttaagggaaaatattctaacactatttattgactatattatttccccagtaattttgtagtgctacctctgtgtagtattatactcagttttcttgatccgaattgttttggaaataggtaatccattgcctgtggcttaaagttttaaaaatgttcattaaacttaatggcgtttgttataggtttgtttttttttaaggagtcataagtgtaccactatggttttttaaaaatttattttcctgttttcattttctttataggaaattcaagaagtgaaaactcctgaagaactagagacctttatgcttaaacatggagaaaatattattgatactttaggagctgaagtagatagacttgagaaggaactgaaagtaagatgtattcataaaaataacataatgataatggcagctatttttttgagtacttactctacagcagacactaagtgcatccatcacatgcatgctttaacccactcataactccacagtgtgtaggtatttataagcaagaaaatgactgggttagataagttgaataatttacccaaggaaatagggaaattgtgatttgaaccagattctttacttttaaacactattttatgcagcctgcttagtttctaaaatagtcaaagggggtttttttgtttgttaataaataagcattttgaaagttcctagagaaagatgaaaaggaaactttagactgtggtcaaaagttagaaaaaatagaatgtatatcttgcttttagcccatttgaaattattttctgtttttgtttgtttctattcagttggatgttattgtaatttattgattatgttactgaaatattacctgatcctgatcaggttgtcttttaaaatgtctcagtgttctcaaattgccatttattgacatttgaattctgtttgcaatgaataaaaacttgtaaatgatctttaatgtatataatttgttgaaggcagtgctttttctgcagttgatattgaccattctttaattttgtaaaaaattgaagaaaaaaacttccatctctacttttcaagttttcctttgagaatctggatatccgattagattaatacaagtacttcaaataagattttgttaatattatagttcatgagctttatttgacataatttttgaattttctagatgatattttggtcttaagacgctttcattcttaaaaattattgcagaccccaaagagattttatttatttgagttatagttattgatatttaccaaatcatgcatgaaagtagataaattttaaaatatttatcatttacttttaaaaacatacacctatttaatataaataactttttttttttttttaactaagaatctcactctgttgcctaggctggagtgcagtggcacgatctgggctcactgtaacctccgtctcctgggttcaagcagttctcctgcctctgcctcctgagtagctgggactacaggtgcctgccaccatgcccagctaatttttgtatttttagcagagatgaggtttcaccatgttggccaggctggtctcgaactcctgacctcaagtgatctgcctgccttggcctcccaaagtgctgtgaagtgctgggattacaggagtgagccaccccacccagtcacattttttttttttttttaactgagacggagtctcgcactgtcacccgtgctggagtgcagtggcacgatctcagctcaccgcagcctccgccttccaggttcaagggattctcctgcctcagcctcccaagtagctgggataacaggcacccaccaccacgcctggctaatttttgttttgttttgtacttttagtagagacagggtttcactatgttggccaggctggtcttgaactcctgaccttgtgatgtgcccacctcagcctcccaaagtgctgggattacaagcgtgagccaccatgccaagcccacatttttatataaatagttatattttccaaaatgaaaaaacgtagttagaagagtgatatttcacatttttgcaaaagtctcttatgcctggcttagtagaagacagctacattcccatatctgcttctgccttcagttgtagtgatttgattgtttggccgaagaacatgaaggaaagggagaactgttcctatagccttttgagataattgtgatactctcttttggtgttataacagctggtagaaaccaaatcaatgaatgaacttctcatatgctacttgtgaaggtagggggcacagtctacaagactgtccttccttctaataccaactgtgagttcaggaggttccctagagcaccttcagatttaataactcactaggactcttagaactcaccgaatcatgttatacccatcatggtttggtttattacagggaaaggatactgcttgaaatcagccaagggcagaagaagtgcatagggcagggtccaggaaagttccaaacatgaagtttcagttgtcttttctctgtaatgtatagtattactctcctggcaatgaagtgtgacagtagcatgacgtgttgccaaccgggaagctcatctgagacttgatgaccagagattttattgaggctccatagttgactgcataagtagctgaccttttgtctctagcccttctagaggtagagcagatactgtgtggccaaaggcccccatcatatatcacattctaaagttaatgcccccagataaacaaagacactcttaggcaggacatgtcaagggcctagaaattccctcccggttatggagaacaaaagccaaacctccctttgggtaagattaattctctactatacactgttatattaaaatctgttggtctatttttatactctgaatgaatcttttacccatgcatgattctataacattatgaattagtattttggaaaatactggttcacagaagtacttagatctttcagatgttgatacatttctaaatatgggtacactctcaggctgatggggtggatatgtttttcaacttaaatttccacttaaaagcttgcattttatcattagcaacaaatactgttgttttccttgaaataagactcattttgttcattttttaggagatgcctgccaaatacccaaatttgaataaaccgagtttgttaatctttcaaataaaaatgtactctagattaaaaagcagtttattcagctcacaacttaagcaatcaaagaagtacttttacgtactttccattttgtcacagtatttttaaaagtgaactcaagggtttaggtttaataaaatggatacatttgctatttcatgaaagacttttttaaatgaaactggctttttttttaatgtcaagtgtgggacagtagagacaatgactactggtattgtttgatgccatttgtgttgaattgtgcaaaggtgcaagcagttttacccaccattgtttttatgccatcaggaaatgtcagcatagtaaaaaaagcaaagaatgtcttacagttactgtgaaaatagttgtgaccttagagtccccctaaaaaggtctcaggaccccagcagtccttgaaccgcactttgcaaacaactaatctgtataaaatgtgagacaatggttatttttgtgcaaggtagcacaagattgaataaactttgctctttattctatttgtttttattttgctggcaaggaaaataatggactaaatatttgctttacattttagtagatacaagaaatcagaagccagatttaagaataatcaccaaattggtccttgtcacctacatttactcttacaacaatcagaccttattgtttttgtttagctaactttgtactttaactagaggctattaaatcattaataatgtttttgaattatgtaagtctttcaaaccaggaaggtaagtataatccatacattcaggtggaaacgtctttggctaagataataaagcatggccgggcgcgtgcggttgctcatgcctgtaatcccagcactttgggaggccgaggcgggtggatcacgaggtcaggagatcgagaccatcctggctaaaatgacgaaaccccgtctctactaaaaatacaaaatattagccgggcgtggtggcaggcacctgtagtctcagctactccggaggctgaggcaggagaatggcatgaacccaggaggcagagcttgcagtgagccgagttcgagccactgcactccagcctgggtgacaaaccgagactccgtctcaaaaaaaaaataaataaataaataaaataaagataataaagcataattaatcttaagtcaaaggacatgttcatagttgaggtgccaaaccaaaagggaatgcatgaatgtaattgtttttcttagtcatgaaaataaggtgatttccttttgaaaactaaaactttgttcactggcatattccttcatttttagtatctcagtttaaattgtaattattattggattattttgggaggtcacactcatttatataattctgtaccagtggagtcatctctgttgagtaatgccattgagtgttgaaatagattatatttttggcttaaaattccagaacttgtggctgggcgcagtggctcacgcctgtcatcccagcactttgggaggccaaggcgggtggatcacctgaggtcaggagttcaagaccagcctgaccaatatggtgaaaccccatctctactaaaaatagaaaaattagcttggtatggtggcgggcccttctagtcccagctacttaggaggctgagacaggagaattgcttgaacctgggaggtggaggttgcagtgagccgagattgtgccactgcacttcagcctgggtgacagagcaagactccatctcaaaaaaaaaaaaaaaaattctagaacttttgtatagttatctgtaaaggtgttaaaaataatagagactaattcatagattcccatattacaagataggaactacaaaattaatataaaatatatcttgttattattttgaagttctttgacctgttaaacattttttgtcttatctctgtatttcagagtatagataaacctttctcctatccctccattaagttttttgtttatgatgattaatggaaattagttcattgggaggctgctgtagcattcataaattccttataaataatggctgaattaaatgctctgttctttactttgcctttgtttctccagtttctcttaaagcattgtttttaatgaatctgcagcattgtaaaataaattatgtaatttgggctttaactctctgcaagtattggaataaaatcctcatggtgtgtaaaatagcctaatcggtattgagcaatgcaaggaatatagattttaaagtatttgttgaataagtgggtgaaaattttaaattggataccaattattgattttcagttctgttcaataaatattagtttctactatacacatgatatcttgttaagcagtaaacattgaattttaaggatattaatcatatttattcattcagcatatattgtatgctttgtattgtgcacatatacttttacaaatttgattagtttactctgaaaacttgattttaaaaagcagagcaaatttttaggctttttttttagataaagcttttattagtacacatatatttatatcatgctttttagacagaataatgtcaaacttttaatgaacaggtaaatttttcaagtcatattaggataggtaagggttgattggagtaggaagatacaatttagtttcatttctgtttggagaatttttttttaattctatattgagtttaaggagttctagagacagggaatagttttaaataaggaaaaagttgggaacaaaagtgtgccctccttgttaaaaggtccctggtcattcccacattaggatctaagaggaaagtacccccaggcacacctgatcgacactagttataagaaaaatccctgtgtgcactcagtagagtgttcttgctggagcaaaactccaatattctgcgagattttgtttttataactggatgcctttaatacgagtaatatgcacatggtcctaggttatttttaagctaggaatcctaactgaatcatttacaggaacttttctcccctttttatttttgcaatttttatcaataatgcacaaagtttataaagtcaaatagaactgaaaagattataacagaaataactatcactgcctcacctgcctcagtacttatattttaagagataaccatttttaatacttttcagtgtgtctttatttattgccatatttctgcataaaagtcttatactacttctcttgatttaacagtatttcctctacgataggtgtagatttagttcttttatacactactttctgtcctcccttctcacagtattaatatgttacattttattatatttgtaattccccttaagttgatttaggtgcccttcctttattttattttattttttatttttttatttttttgagatggagtcccgctctgtcgccaggctggagtgcagtggcacaatcccggctcactgcaacctctgcctcccgggttcaagcgattctcctgcctcagcctcccgagtagctaggattacaggcatgcgccactatgcccagctaatttttgtactttttaatagagacggggtttcatcatgttggccaggatggtcttgatctcttgaccttgtgatccgcccgcctcggcctcccagagtgctgggattacaggcgtgagccaccgcgcccggccaggtgcccttcctttgtgcactcacaggaaaaagaaacccaaaatctttactttgctctgtggtagccgagtgttgtaattgcctacttaatttacctatatcacctcactaccaaacgtaagtccactgaaggcaaatactgtttgttcccagctcattgtcatatacacttcaatgcctggcacagagtaggcatgtaatagtagacagtattggttgttattgaattgaagttccttaagctagcatataagatttttaacaacctgatttctgcctgtctttccagcctcattaccaaccctaccctttttgcagcttctgtgctagctataccatagtgccagtgcacactttgcaggctgtctgactttgctgatgttgtgttttctgtctaggcactcttcattatctacctggaaggctcatcatatgcagacctagcttagatattatatcctcagtgaaattttctagatctcatgagcaaaatggctgtctcatttttgctcccagtgttattatttagtacagtgtaataggagcttgggatctggaatcaggcctggagtcaggcctggaatcaatcctggctccatcacttactagcagtgtgacttcagacaggttagttaatttcttcatacttcagttttccctgatgtatgtataagatggaaatagtaattaggttatgaggcttttaaaacacacatacatgtgcatatgtaacacagtacttgatacatgagtgagtgagcaataaatgttaactttttattattagctctaatactttaacttgtagatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgtatttccagtgcttcgcaatgcttggcatgtactagatccttaatgcacttttgtattaacaaacacatgaacaaacttaggaatgtgatactacttattgtactgtttatagtatgtctatttacctattgatcttactttttttcttatgcaactatttctctcattagtatgctatagtgaaatagtttgcaaatgttttcattggctctaatgaccaaaaggaataaaaagaaacaagattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaagaaacaagattttattttgctacaaataatgtggtggtgatttttctttccagaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttctttttttttttttactattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttcccaagacgaccctcaaagttaatgtgcagcaggtattccaaatggtaatttttttttttaggattccctaataaaaaaaaaaaaatttctgatatttctttttaaatctgattttggttgaggtcataccattcttaaataataattgaaggtttatgttgccatcttttctaattctgttttgcactgataaacttacataaagtttgtttatgtaaaataagacataaaggagtacaacatatcaaggaatttgagtatttatgtggaatcaggaaatttttctagagtcactgaattttcaaatcagagaatttgggctggatatggtggcttatgcctgtaatcccagcactttgggaggccgaggcaggaggattgcttgagctcaggaggtcaagaccagcctgggcaacacagcaagacctcatctctactaaaaaaagttagccgggtgtggtggtgctcacctgtgttagtccattctcacactgctataaagaaatacctgagactgagtaatcaaaaaaagagctttaattggctcatggttctgcagactgaacaggaaacatagcagcttctgcttctggggaggcctcgggaaacttcattcatggcagaatacgaaggggaagcagtcatagccagaggaagagcaagaggcggggattgggggtaggtgccacactcttgtaaacaaccagatctcatgagaactcactatacagtaccaagaggggaaggtgctaaagtattcatgagaactccacccccgtgatccagtcatctcccaccaggccctacctccaacatgggattacaattcgacatgagatttggtggggacaaagatccaaagcatatcagcatctgtagtcacagctacttgggaggccgaggtgggaggatcacttgagccccagaggtcgaggctgcaatgagctatgatcatgccactccagcctgaatgacagagtgagatcctgtctcaaaaagagaatttgggtctctttctccaaaaataaggctatatttagtttttcaggtttcttgttattttaccaaattaatgtttcttactttgtttgtatctactttggcatatagcatttgagtattaaagcatataaatcatttttaaggaaaatattctctgcaggagaataattacaaaaataatactggacagaggaggggcagtcaagggtccatgattgattccttcttgcccaaaactaaaatctaggatttatcaaaggtgaggtatacagtggtccctgacttataatggttgcatttaagaatttttatgatgggtttattggcacataaccccataataagtaaaaagcatctgtacctacttttagctttggctgagaatggatctctaattcactgtaagtagcagtccccaaactatataaggtggcacagttttcatcatggcagtgggaggatgaggggtggagtgtttttgttttttttgtttttttttgagacagagtttcgttcttgttgcccaggctgcagtgcactggcacaattgcagctcaccgcaaccttcacctcccg

SEQ ID NO: 13996 - DNA, 4482 bp, Human
tcgggattatagtctatttttctgtttcttaaggttgctaacgtccagacacataggtactattatatttcagaggagatatttttaaataagaaataataaaaagagggaatctttcattgctttgtcaaggagaattcatgcatttcataatcccacagatcaaatacaataagtcagaatcttacttgtatttggtagaaaaatattcattcatctttgacatccgggctttctttttctgctgccttgtttcaggattaaagtctgctacctgtggtccagggtttcgaaatgccaagcattttaactgccgctctatttgttgctattaaacaaataaatgtattaatagtaagaaccagatagttttatctgttttacatttccccaaaatgaactttctgtaactgtcaccataaaggcatgaaagtatatatgttttacacaaagacataaacgatttaatctaattaagtttcaaaagatggtgtacattttctcaagttgggccattctttctgaataaagaaatagtataacactcataaaataaaaatgtaaaaaacaatcaaggggaatagaagaattctttttaaaaccgcaaaacgccactcagctttccaaatctgatggggatgcacatcagaattagcatttgatgtgggtaaggacgaaggagtagagacccttcctcggctgttagctaaagaagcccatgtagtgtctcaacccgcagtgagaacccaaagtagatccggcactccccttcagtgtcctgggatgcatttcggagctactccctacccgggactggcctccacgcggggggtctccaattcagaactcagccacctgaaggatcgactttcagtcaaagccagattggaacaagagaaatattgctaggatgactttctagggcatagggggacattttcaaaagtctctggaggttttttttttttcctttcttttcttttttttttttgagatagggtctcgctctgtcacccaggctgcagtgctatggcgtgatcatggcttactgcagcctcaatccccggggctcaagtgatcctcccacctcagcctcccatgtaggtgggactgcaggcacgcaccaccatgctcggctaatttttgtgtacatatgcagtagagatggggtttcaccatgttgcccaggctggccttgaattcctgggctccaaggatccaccatctgccttgggctcccaaagttctgggattacaggtgtgagccactgtaattagaaattagatggggcctgagctgaaagacaattagaaattaaatgggcctgagctggaagacaaacaacaaaatgcttcaatcgaatattgtactgataacttattgtgaacatgtagcacatgtcatgagggaagaaaatgctcttttgaaggattgtagaagaaaataatctcagaagcacaaaaacatataggctgacatatacatgaaataccacacctggaaacaaaagggaagctttcaatgtaggaatttcaatgtaacaaattagtaacagaatgtcatggacttttctgcagtttatttagtttaataagagtctagtaagtctaaaataatataatgtttcttttaaatttcatcttggtgtatatggttttgtttcataaacttaaccttaaactgttctgcattagatatggttatgacatatacatacaacttagtacgaagcgattactattctaagtagcacagcaagaggttaagaacagagacccagggtcacctgcctgtgctcaagccttggctctgccacgtactagtggtgggccttgagcaaattgctacatctctaggccccagtttctctctttgtaaaatggagttaacaatagtatggtgtgataaggattagatgagttaatacatacagttttagagccataacatgacataataataacaaaataaaggttcattaaataaaaacatttgtagcttttttgtccgacatcttggcgaggctgcggtgtctgctgctactctccgagcttcgcaatgccgcccaaggacgacgagaagaaggacgctggaaagtcagccaagaaagacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaataaaaataaaaataaaaacgtttgtatatattctccacaaaaagcagaattttattgtacagaacactgggctaaaaatcagggtacacaggaggtggagaggagatgtgtgaggcgagagcagcccgcagcgagcagtggggaggagggaaagctctatcagcctgggcggcagagctcctccctgtgaggtcctgcctgggcccaccttcccacccacatccatgggcatctcagagatcctcgagggggcactccccagtagcatggaatcatagaatctgtgtgccataccagttgtttctgtccaatttgacagttcttctcaggaaaactatgatctgtgtgtctctcttgaatggaattgtttttctctgattgttcattcatctctgatcacttaaaaagtaattggaaaaagtaaaacatattaatatcatctatctccagtaactatatctggtgattcttttctactctccctacacgtctcactttattcaaaaccagactgtatctgtactcccagaaccttttctcccactcactgttaaaccttgcctctgactcccccagaccaccctactgaggctctcctctgccgggggttccaggagaaaatcaatagtacctttgacagtccttagcatcataaacctctcttaagcaggattaagaagactctgagtttttagaactccattcttccttctttacacacactcttgaaagaaaaagtatgatacgttaataccatatgtacacagtaatgttgtgaaaagctcatccactcccatggtttcagctgacacctcttcatgtatcattcccacagtgactccccaaagccttgatctcctcactcaacttttctgataaatttctaatgcagcttgtgctaaatggtaatcaggttttcataaaaccccactgctaaaatgcctgtaacttacttcttctaaattacttcagtagtatatatacagggtgcgtgcgtctgtgtgtgtgtgtgtgtgtgtgtgcatgtgtgtgtgtaagagagagagagagagagagagagagagagagagagatggagcccatacaatatggtaatcatgagtgacagtccagggctggtctgcaatgttctgtcagaaaacaccactctccagaggaggcttccacaggccctgctgttttccctgattctcatcaactaccattgctgactacagggtgccatttctactgaagtaacttaagagttaggcgttatcatgttggcttgactcatttagcatcacctctctgctgaccaattggaaattccaattctatcagtgggaaatctccaaactgctctcgacagtggctggactaatttacattctcaccaatagtgtgtaagtatgcaccaaggaataccacgcagccataaaaagaactagatcatctcttttgcagcaacatggatgcagctggaagccattatctgaagtgaacaaatacagaaaacgaaaaccaaatactgcatgttcttacttaggtgggagctaaacgctggctacacatggacagaaagatggcaacaatagacactgggagctactgggtgagggtaaatgggttgaaaaactacctattgggtatgatgctcattacctaagtgcattatccccctgtaacaaacctgcatatgtgtctaaaataaaacttgaaagaaataaaatattcacattcttttaaaaatcaccttgttatttctccttataaaattcaaacaatggttctcaggaaaagtaaataacagctattttaaaatgcatatattcataaatagaattcataagcagatacatatgtatacaaaataaacacattaaagcctcagtggtgaatttaattttgtttatcttaacttttcagtctttgcatttgctgccataatttctactgccattattttggagaattttaatttatttttttgggtgcgttaagtaaatatttgg

SEQ ID NO: 13997 - DNA, 13644 bp, Human
aaagaagaggagggaaactgaattgaggctagagctgcactctatctgttagaagcaatctgggacacatgcacaagtggctgagtgtataaagttataatggacaaagctaaattcctggaatcctgggaactaaggaggtgggcttgagaagtatactatggtatgatttgaagtttaaattaaaatgttaccgaaaggtttcaccacgtcaagtattgaagctactggggatctctgagatcactgaggtccatcaggaggaaaggcaatgtcactgtcaatttacgtgaaggaatggatcaatggggaaatgcctctaaacgtatatgctctctgtcactaagaaaattactgatatctcactggcatttaaggggagacagaacatgaaatacactgagcaaggccaggtgtggtggctcacgcctgaaattccagcacttggggaggtcgaggtgggcagactgcttgagccaggagttcgagaccagcctggccaacatggtgaaaccccgtctgtacaaaaaaaaaagacagccgggtgtggtggcgggcacctgtaatctcagctattcgggagtctgaagtatgagaatcgcttgaacctgggaggcggaggttgcagtgagcagagatcgcgccactgcactccagcctgggcgacagagtgaggctctgtctcacccctaaaacgcaacaattatgataatgcttattaagatgtttatcccatatctcaactgaataggaggtaaggcagaaaccaaagttcaaggttgtatcattaagggagccccggagtgataatggtaattaatttaagacacgatccggacacaatactgccaaagtcgccataattttaggttaacaatgacttagagattataagatatgagtaaacaaatacagtcttaccttgtatcatcgttcaactagagtgggaaaaagcaaaaaacattattgatcacattacgtttgtttgacatatatggatgcagattatatgacaattaggtcatgtgttcacgcacatggtatgaaagactggagaattactttagactgtaaacagctaaactgtatttcctcatcctcttcggcccctcctcaacacaatgcagcggaaacttttgcttccttcaagccccgcaccttctgttaggctcttcgatacccttcaaatgctttggttgatatctctgctccctagacagaagactcgaggcgaggcaaggggctctaactgtggtcagctgctgcgtcgtaatacccggacatcctcattatactccagtgtctttctgacctgccttgcagttttggtcaaccgggcgaaaagcgcagatctaaagagaagccccaggctacaggagaaagggcaaggctcccggggcctgtacagaccgccgggggctcgcaggagactaaacaagtgtcaggcggccagaagaaacggggctccccgcgacagagctatgtaaagggtgtccaaggacctaaatcgaggatgcctgtggcctccgcagccctgggagctgccggcacccaccccggggacacactgggactgctcagcagggttccatccaggctaacagacctactcacctcccctatgcacagccccattacttcctccttctctgtgctcagagcgtggttgagacaaacgaggaaagcgtcagactcgagatgaaccgcctgcaccgcctgcaccacctgcaccgccatcttggcccgacccttctcacgtccgcctcgggcccacttggtcctgaccaaccgggtgctgcggcgcagcctccccagcgcccagcgctgtgcgctccgcccaggcctggccttcggcgcgcgggttcctagggggcggggcttagggagcgggcggggctgtgggggcggggctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgtgagtaaccttttgcagaaacagtgttatactgtatctgaaaaagtatcactcttaagcttggctgctgctactttctacaaaggcttttaggtagctatttgttggatacagggaaggggaaatggagaacttcagtttttattcaagttcggatgtatcacattaggtatccagaatgcaagtttcctcgggtctccttgtctcgatgatatcagacagtaaaaatatatgtaaaagtaatttttatttcgaggtatgtcaaacgtgccaaggataaaagtacagatcttccaactcacaagtctaggaatcacacgtggattttgaaagcgattctaaatcaaagcacaatatatgccgtgccgcctccacagcccgtccgtgttcgtgtctttgatttggttttctactttgtgtagttttgaagccaggcaggtatggcagtactggaaagggaacattcccaaggtgctacttgaagtgttgatgctttgctcttttctcccaagtcagttccaacccaagtctccccacacatagggtccccatccagtgcaacgatctgtaatgtgcacgccagcagcctccgtttttacctaacgatctgtaaggatcacatggcacatctttctataattaatttgatcatgatgaaggttggaaaattttcgtgtgcagttacattggacctgtctaaattttctcttgtttcaattttatatcatatgttattttcagttactgtttgtggctagtatgccccgtcctcatggagcaggaacggctgttcttattattatgacattaacatttggtgatgggatatagtgcctttaggcactttcaagaagaaaaataccttttgtttgttatcggcggtagtcaatctcatattccagaatgaggttcactaacttttctaatgctcatggctgccttttacagctccaggcatttaactggagtagaacaaaattattaacatttatggcaagcttattatatgctagatactaagcatttatatgcctggtacatgtaaactgccccatttggagtcaagctcaacaacttccccactgtgtgaccttgagcaagttacctaacttctctgtgcctttcttttcctcacctttaagtggggatgataataattctgcccacctcatagcgccctatgaagattgtgaaaattaaatgagtcaatatatgtaaacatataggaaatgctaaataaagactatcatgattaatatgttctttaattctcattttacacctcaggaaactgaggtggagagacgttaacttgtccaaggtcacaaagctagtaagtgacagactcaggactcatacacaggcctgggcctgtgttcttggtaatttcactcattgtaattggacgagtttattaattgacttctaataaaataagtgtattcaactgatcaatgtttaaaaactgttcatcaacctggcaattaaagcaaactatacttttttaaaaaagacacaaaagaatttattctgtaaaggaaaaatgatagttttacttagattactacctaaggaagcccttctatcttatatgtcatccatttaaaacctaatttacaaaatgccttactaagaaattgtctgtcttggccagtgtgctctctggccccgaaatcaaggtgaccctcatggggacaatctcttctagtggatgataaagttatgcagttatctaaacatttttggaattcatttgtatttgtagctggcagtattccttgagttgagttgcacaagtttatattccatgtattgtattgcaccttgtacctaagtctatgttgaggttttaaaagattcgtcttagttcgagaagtcctgaattttgtaaacaagtatcatgtgcaaataaaatgttctctagtcaaataaatttgggaaatgttaacataaagtttctttactgcataacttgccagaacagttactacactaatgtgctttatgactctccaagattcccaaacttatttgaccaaggaaaatgttgggagcaagttttctaagaatcacatttttccactcataaaacctgtgattgtataggctttgatctgaatccctctccctcagcctttgcatttctctgctgaggactttgttcatgctcatatggtgacttctctgtcccttgatcactgcagttgtctttctctgggcctgcatgccctctgaatgctagcacacacaattccaggatactgtgctgagaggtggttcccaagctcatcccgctgatgcccagcatgttgacctttgggtcacagcagcacatcacactgcctttcttctgagaatattttgtagtgactcataggcctctttgtagtgactcagtaactcagaccatcatctccaaactctttgccctctattccactggcattatttccttttaatgtcaatataaccaatgcaattttgttttccattcaaaacaaatttaaatgtcaacatgttggttgttgctaggacctatctatgaaattgagatggtcctgaaacccttaacacatggtttccacttttttaaaacagttattggccacacttaagtcttctgtgcttgaaatccgaatttaatatattttattttgacattagtatttaccaggtttttatttgtatttctcttttccaaagctctgggaaggaagagaggcaaaacaactgtatctgcaaatgggaaaaaaggggggctttggaaaaaaattatatatagccagaggcttatgcctagagaatcaatctctacccacgtatacatagccaatcatgacaaccactgtggcgttcctttgtttcccttccctacccaccatacatatacacctgttcactgaaacattgcttgaccagtacctgagacttggggtgcccagaactgtatcattcctgctattgagcagaatacaatactgtgctttagggaagacaggacttgtgaaataagcaaagcaaatgtgtaaggtgactttgtttaaatataaatgctacagtagtcaaaagaggcaagaattttctaaagttttcatagaggaggcaggcacctggactctgctataatagcactaagataggcagagaggcccagggaggcattttaggcaagtggaaaacaagagcaagggtatggagctagaaatgagcctggtatttggggaaagttggtctcaactgcagtggtagttgtagtgcctgctggaattggtgacatataggatgtagcaactgaataagaggaagaaatccaagataattcataagttttgagtctgcaggatcaggaatggtggtgttgccattgagagaaatcaggatttggttaaagagaaagtttagacgagtttgaaatgagagagcacatatgtatgaaaactaagacaggagcttacaccaggctcagagtcagatgcactcagggtataatgggtgaagcatctggttgctctcgacagtctcactttgaggactctaacaaccaccctcccacgctgcatttcttttcccacctaatgagaatagcaggtctttgttttgaggggcagctccccagtgccgtatctatactctggccaaaggtagaaatacagtacaactgcgctataatgctctgagtaaggtctagaagattgactcatgcaaaatgcacatcaagttattgtgaggtcctgaaatgatatctggggcttgggcagaggatcgttatagagtttgccctaccactcaaatgctttgggaggtatgcttcctttacacctctcaaatgtgcttctggtcttctggcttaggaagtcaaaatttaaacctagtcctctatggaaaaatgggctcctgtaacatcctgcagaattattaaaataaaacaaggacctagatggataactttcatttgcactcactcagctccaaatcagcatgatccccaaagtctcttgcagctcagaaattccatgaagctagcttacttttcctaacaagaaaatccccttctagaaatgcccatccgctatttgtaaactttcttagtaaactgataaatagatcatttgcccttaaaacaaacttttaatttcaactctgaaagacatgcatatatgtccttcagaatcttaccttttaaaatggaaactgcttggaagtggcttttacctggggaatatgacatgcatgtgtctgttatactgccttcctgccaaaataagtgtgtctttaggcacgctctttgcatattctattgctaactacattttgccagacactgcttgtgaatgcagtatgtgtgagaccactgcccagcttcctgtagtgctagtcctacatttccacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagttcattcaaacccaaaaagtcacacctgtgtcctgtgcgcgggtgctgcaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggtaactgtttacattttgcttatttctttgattttgctttcaagtaacttggtttctattccagtctcaatattctgaagtctttggttttatttttgatcattcctttccattaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtacacatgttgcttaattattttccattgtactgggactctcgtaacagagtactccataaacttttctttttctgacaggtcaggggagtacaggagctgttgcttaagcttttgcctgatgactaacctggtatgtatttctatttctcctctgtcctccccctctttgttttggctctattcagttgtggtgattttaatgatttttttttccaggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcaaaagaaaattccacgtagaggggctttaaagtctttatggaaaaaagaaaaataaaaatcatttttcttgttttagttttctggatatgccgcagaaggatccgtgccagaagcaagcctgtgagatacagaaatgtttacaaggtagtatattgtaaaatgctttaaaaatatttttccactgtgaactaactataagagaccaattattcttttatctgtattaactcttttttaagaatgtaacgtatatgtaattatcctgaagattctcttcattgtatcatcaaagatgcagaaaataaaaagtaatgtgatcaaagctaggggttttcactccaggtgattagcatcacctggagatctttaaacacttacctagaacaattcagacttcctagggctagggctaggaaaaaaagggttttttgttgttgttgtttgtttttactaaaaggctagttttaaattggttggttatacttcactgcagctgacaattcactttttaaaagcaatctggaagaggtgcggttgaaataacaattggaattcaggctgccaaagtcatcaactaactcttaaaggcagaagtgaatctcgactaaagcatatttgaggtgatttgtccatttgtccagctgctaagtttgaccaaatgttagaggattttagttttctaatcagtgaatgactgttgccagaagagcaaatagaaaaagctataaggctatctgaatttgaaaaaattttaataagttttcctcactagtaaagtaatagatggagatggaaggtcatgaaaatatagaaaggtatgaaggaaaaatgttcagagttcccccaaagattcaccaccaaagaaatcctttgtttgtgtatctccttggacttttagctttcattcttggacttttcattttttgatgttagcaatattttataaaatcttttagattaaaatctggatgtataataatgccattttagtcaaacttcttccctccaactttaaggaaaaggaaaaagttttttgcatttaattccttctcccaaataaaaccttaccttgtttgaaataacccatagctaagggaaaaaaataagttaaaaagagctggtgacacccccttggcagtgtgggaggattaagaactggaaagactaaaagatgacaagcaccgttataaggactttatacgtattaagcctttcatccatgaggtagatgctactatgacccccatttcataaaggggaaaacagacacacaagttatgtaatttgactagggtcacatagctagtaagaggtatggtgggaatttgaacaccccccgccaaccccgcccttggtctagctccaaatctggactgttacccaccttgctatactgcctttctaatcagaattgtctttcctatcctgagctaactaccatgtactccattttagtactgggggactcattaactgcagctgacctagagtctttaggtcaggtcctccttaacttagtgtttatgtatagtagggatctgcaaatgttttatgaaaaaggccaaacaagtaatattttaggctttggaggccaaaggcctttgttgtatatattgtgtatgtgttgtgtgtttacaaccctttaaaaattaaaatccatttttagctcccagctgtaaaaaccggctgaatttgaccctaaggctgcagtttgccaattcctgatgcacagccttagtaggggaggtccaacaatcagcttaaactgtatgcaaaataatgtgtggtgtatgtgcattttcctaattcatcaaattagtgaccagtaataaaaatgatgttaaaaaccaatgtcctagaaaaaggtgcatacatgctattaaccttaaaggaaattatatattaaaatagctttcaaccactttgtaaatcatactttccctaacgaacctgtcgacaggtctctaaattagaaagaattcagtggactttggtatatcttctttcttccagttccataggtactgaaagtgaaaaggggtgggaagcactgatctaaacctccctgtaccttagtcctatgagatcatgactagagtctgcctgtatgtttttcagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaatttgggttttgtactaaatgtattttaagactattagatatagggtattaatgaattctcttgaagttcaagccactagtgccattcatcaaatttaagtcatatgaggtatgttaggtgaaaggactcacttccagcatcacaattttgacgcccttttttttttttttttttttttttttttgagatggagtctcactctgtcatccaggctacagtgcaatggtgcgatctcggcccaccgcaacctctgcctgccgggttcaagcaattctgcctcagcctcccaagtagctgggattataggcatgcaccaccacgcctggctaatttttgtgttcttagtagacggggtttcaccatgttggtcaggctggtcttgaactcctgacctcgtgatctgcccgcctcggcctcccaaagtgctgggattacaggcgtgagccaattttgataccttttatagattacatgctaaactaattcaaagtttcctttaaactaactcattaccttttgtacttccaaaaatgcagagcaaaaagtgtctttccagatgccagtaagagcatttctttctgcttttgcatccccactgcagcgactaaccaggtaggaaaggcatagaaatgattcttgtaatgcttaatgatccttaatttatcatgaaggaactgaagaaaaaattttcattggaagtcaggtaggcagcaagataattcaaacttagttggtttatctattctttatatcctgataataaaaacctgttacagaggatccagacaacattaatacaaagctgctgaatgaagcctgttgacagctgtcagtcactttatgaagtaggaggaggcagcatgcaacaggccatttgctttcctcaaatggatgcttgaaccaccaaaggctgtcctctaaaaaagaaaaagatgactaaaagcaggaacaatttctgctaggtccctgatgttaaaataccatgattatttgagaccaactgttttctttaaagcagcattactcaaagtgtttctaggaattgctgtaaccggaagaaaaaaaaaaggcttctctggtcaggtaagtttggggaatgctaggttgcatacaagtacacaggttaatttcctgtcagacttcagagctttcaaaaaacctaagtgaacctgttttgcagacagcatctctgtgtgtgaatgctctccagagcgacttaaagaaatgctgccttagagacgtttggtccacaaaccagagtgacagagctaaatccccatgaaatttaaatgacgtcttgtgttaataataacacaataaaacatcatacaactttaatgttacaccatctacaaatctaaattacatttaaaattatcagttgacagttgtactaggatttacattaggaatcactacatgatcaaatagattgtttttctgtgttttattgccaagttatttttactgagttaactactccagtttcagactcttttaaatgtttttatgctaaagtatatgtattagtccattgttgcattgctataaaaagtgcctgagactcggtaatttataaataaaagaggtttagttggctcacagttccatgggctgtacaggaagcatggcactggtatctgatgggcttctggggacgcctcaggaaacttacagccatggcagaaagcaaaaggggagtgagcactccacatggccaaagcaggagcaagagagagtgaggggtgaagtgccagatctcatgagaactcactatcatgagtgaagtaccaagaggggatggcccccacgatccaatcacctctcaccaggatccacctccattagggaatacggttcaacatgacattcggtggctccaaactgtatcagtatacgactttctttcagttttgaaaggttcaaatcagttccttcttttaaaggattgtgtcagtttaagtcaacaaatccatttgaagacattaatttaactcttct

SEQ ID NO: 13998 - DNA, 95318 bp, Human; identical to SEQ ID NO: 11784

SEQ ID NO: 13999 - DNA, 11186 bp, Human
caaggctgcagtaagccaagatctcacctctacaatccagcctgggtgacagaatgagaccctgtctcaaattaaaaaaaaaatttaacatgaaaagaaaaaccaaccttaaatacactatctttacagaatgtgtttactgtagtatttcgtttcacttcactgagaaaacagctaaagagtcaggcttctaaaacacatattgagtctttgaaaggtagcttcatgaagtagaaaaagcagagttttgaaacccaggtatgtggtcctgagcaagctatgaggcagaagaatagcggctggaagcagggaacctagggcccatccatgctgactgggtatcagaggctactcccatttcaacccctcctttttctgcgtggcagttgaaaaatgaaagtacctcttattggtcccctcccgcaaccaatcagactggttgtgggccaatgggcaacctctagagggtatttaaagcccagaaaattctataaccaatgctcttgagccgcttgcaccaggcggtgcccaccctgtagagtgtactttcatttaaaataaatctctgctttcgctgccctgctttgtttgtgcgttttgtccaattctttgttgaaaacgccaagaactcggacagctaccctcaactggtaacagttacctgctgggcctacttcctcatctcttaaacggggctgtcaccccgaatcagacagtaaggtaagatttccacgattgttgaaaaagcctgacacatagtaggaactcaaagtctatacaaagacttaaagttcataaaacaatagacaaacggagaaatccactgaagtttagggtgaataaatctaataactgtttggtaaaaactacactgacaatcattgtctggtcagtgttcaacatttacgtgaaacactgagcttttacaaggccaagccccgttttacgttaaattctcgcaaccaccctgaggatggttccgtttttaaagccgcgttcctgccgaggaaacaatggccctcggggttaagacactgcccaacaccggccgcgcctgatagacgcaggttccgaatgcaggccccctccaaagtcttgcccactgctccacaatgcctcaacacccaacatttcatcctcaactccaaatccatctcttcagggccgcaaaaaagcgttacttcccaaagggcgtgttctccaagaactgcatttagcatttcagatcagagtgacccgaactcaataggattacgacaaaaactagtgagattcagataacaccgttacatcgaaagttttaatccgtgacagaggaaatattgcttacgcccttaggtaatttcaaatgcacgtatgaaggccgtgcgggtttctgcaggcgaagcaaaagaaaggtggggccggcagggtcgtggggcgggggtggggcatgacaccgtatcccagacgcaactcgacctcgtttgcaagaaattctgtatccaactctcttcagtgcgtttcgccgcccctagtctagtctggctagcccccaattcctttaaaaggggttaaaacgggtgttgcagaagagagaacactcaggtagaaagggcctgcggcagaggcgcccccaaatcatggaacctgttggaagagtgaggaaggaactctgggaccccgaacattctcacgggtgtaaaaagacaaagtaaatccccattagccaagttggggagaagtcacatccgttacacagcctctcccagaccgccctctaggaaggacaccacatttaaaaacaccggcctgcctccagtccttggctgcctcacagcgatgctcagagccggtttcccaaggtccgcgcgccgcctgcaaggcgcaaacccaagccgctgctggttgctaggagatactgggccagccatctcctccaatcagcacgcacctctttgcgtccaatcacagaggcaggaagggccgtggtgggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatggtaaggagaaagagaacggcgggagaagcggggagaaagagaaggagggagaccagcctcgcggggcctgctggttccttcgcgcgtttcccattcatccgcgtgaggcgccgcgcaccctgtcgccagctcctttcactctgcttttaggtttctgaggcgcgtgctcctcccgatgcctttcttttcctaggagtgcccgtgccttcttctctttgtttgaatccgggcctggggtattcttagttggggctatagggtcggggtaaaagtcaaagagaatttgcacttcccacttaaccacactccagaattcactttcattccgtgaaagtaatgatacggccatgctctagattaactcacttgggtggggaagacagacattagtcaaaaaataacaagtatgtaattgcaaataataagtgctaagaacaatgcagacaggaggctgtgagggtgcgcgttagacattagaggcttagtcagagatggcctccctaggaggtggaatttaactcgaagcctaagtgtcatgaaatacgaccctttaaagagcaggaggaggagtgtaccgagcacagggaataggagcataagacctgcggccggaaagaaagcttggtcatttggagaaattgacagaaaggtatagccacttgcgcgaatagtggttaagagatggtatcggaggagcaggcgttgggcaggacctcttaggctgtattgggaggttttgattgtactccaaatcaatttaaaatgattcggttggaagccattggatcattttaagcagaaatatgacaatctgatgtgcactttaaaaaatcatagttactgtggtggataacaaattggagaatgaaaactggagacccattaggttattggagtaatcgccatatcaagatcactccgaatatgctcatgttagagggggttagtagccaagtttcttagttctcttctttgtttgactggtgagtgagcagaagagggcaaaaaccgaaatcactggagatgttaatggtttgctgaataaatagacattaagtaattgctgtaagtaagaggcggtgctactgacaaagtcagataggacctagccctagcttccccagttaaatactgtcaagcgtgatctgccctctgcttccttctgtagttttatatttggggctttgactgacaatgctgaattgtatgtccccaaaaccaccttgttgcatcactcttccctccttttacataagtagctagccttgcctggaacagcattttttcccgctctggaaataaactcttatcctttaaaactgaggtattacttatttcaggcaacctttcctttttcccctggattgctttggtacccttgtgcctagtatatctccttttactacagtgcagcatgcaatataattatttgtatgtgaggagttcccctccccatctccaacttcttgacagggactcatttatttatttatttataagagacaaggtcttgctctgttgcccaggctggagtgcagtggcctaatcatagctcactgcagcctcgagctcctgggttcaagcagtcctcccacctcatcctccctagtagctgggactacaggtgtgcaccaccacacctgactatttttggtagagatgggggtctcactatgttgcctgggctggtcttgaactcgtgacctcaagtgatcccccggccttggccttccagattactggaattacagatacgagccaccctacctggcccgcttttttttttttttttttttagtgcctttatctttgtttctttagagctcagaacagtgagtgatgtaggtagtcagtgtatcttaagtgaatagtcagtgttttgttttgatgggttaaaggtgaaattggctaactggatatttaaatttccctggtactctcaacaaataaaagtgaaaattatgtactaaaataataaggagtcaaaagttttcttcatttgcataccacaaaatattggtgattcggtagaagagagttggtggtgggaggaaaaataattaattagatccttttttgttctttgtgcagagtttacccctcaatcccaaacctttcctcaatggactaacaggaaagccagtgatggtgaaacttaagtggggaatggagtacaagggctatctggtatctgtagatggctacatgaacatgcaggtaagctaaagagctgtaaaggtcataacattgcatttattttgcttcaccttatttctcaaaggtttagtctgactaataagaatacatacaattaaattgacaaatatacggcaaaattcaaaaataaagtcaaagccaggagggatactgtgatatactaggtacaagacatggacttaaaccagaattcagctacagattttattcctagtagttaaagtaggaagagctcagacacttgattcataataataccataagggaaacacactactttgctggagaaaacaaaacatttctcatcatttagccctgaaagaaagttttcaagtgaaattattgagtcttttaatgaatgctaaaggcacaacaccaaagctattgaggaaattcattccttcaggggaaagacagatctgccaaaggaattgaactgactgtatgtctgtcaaacgagtttctgtaaatgattcagccatgtgttttggtgggtttttttgtaattaattatctttttattgtggtaaaatatacattacaattttgccactctaaccatttttaagtgtataattcagtggcattaagtaccttcacattgttctgcagccatcaccgttgtccatttctggaacttgtttaccatccaaaagtgaaattttttgcccattaaacaataattttccattaaacaataattttacaattaaacattaaacaataattttccattccttcctccacctaactaacccctggtaaccactagtctacatgtctatgaatttgaccgtgcataatacctcatgtaagtggaattgtgtattatccttttgtgtctggcttgtttgacttaacgtagtgtattattcaaggttcatccatgttgtagcatgtgtcagaatttcctttttatgactgaataatattccattatatggatataccacattctaatccatttgcctcttggtggacactgggttgcttccctctttggactgtagtaaataatgctgctgtgaacatgggtatacgaatgtctgttccagtcactgctttcagctctttggggtatatacccagaagtggaattactggattactggtaattctatgtttaattttttaaggaggccaagcgtggtggctcatgcctgtaatcccagcactttgggaggctgaggcagcagattgcttgagcccaggagtttgagaccagcctgggcaacatagtgaaactgcatctctacaaaaaaaatacaaaaactagctaggcatgatggtgtgggcagctatattcccagctactcaggaagctgagttgggaggattacctgagcctggggaggttgaagctgcagtgagctgtgatcactgcactctagcctggatgacagagaaatttttttttttcttttgagtaactgtcacactattttccacagcagctacgtggttttacatacccaccagcaatgcacaacggttccagtttctccacatcctcaccaacacttgttattttctatgggtgtttataaaatagttattctaatgggtgtgaagtggtatcttattgtggttttgatttgcatttggctaatgatgttgagcaccttttcatgtgtttattggccatttgtttatctttggagaaatgcctgttcatgtcttttgcacatttaaaaaattagtttgggattttttgttgtttttttaatggtagtagtttccaggcaggtttttaaaggctatcaagacaggtggtcaatccaatcatgaatccaaggattccatacttgtaagcagagtactaaaaggagtacttaagtaggcagagagctatgattttccttaacttaggcaattaccacctgagcacatgacattaaggcccccaaagcatagtttgagtgtggaaaattccttaaacaggagtcatttaccaagaccatagaaaaatctgggaagtatatgaattgtgatgaaaatattctggaagtagtggtgatagttgcacaggtttttgaatatactgaaaaccactgaattgtacactttaaaagggtgaattttatgctatggaaattaacatctcaataataaaagaattaccacttaatatttgttttagaattaatatagcttgctagtgaccctgctagagttgcaaaatgtctgagtaaccaaccactttgagtagtcaaccatattgataccagtgtttgaatttgttcactcagcaaatatttattgaattccattatgtgcctggcactgtgaatatagcattgaacaaaacaaagtccctgccctcaacagtttatggtttagtggtgggaggtggtaatataatgtgataataggcatgatagatgccatccatgaagaaaagggggaagacagtatgtgcaatattatatagagtagcctctctgaggaggcgaattctggaagataccagaattagtgtacaactcagttgagtatctggggaaaagcatcccagtttgagggaacagcaagtacaaaggccctgtggcagaagcatgcttggtgtgttcaaggcacagcaaaaaggccagagcagattgagttaagggacgaatgacagaaagttaggttaaaatggcggccatagagagcctgttaagtgatggtgaagaacatgatagaaagtatttggaacattattgtgtaatttagaaatgttaaatgttgtaattactttttacaaaaaattagttgctcttaatacattatttcttatagctgttacatacaaactgtctcaacaacctcgtatatttcagacaaaactatatcatctggataatggagattactttttgttgtctataagagagggagtaacatccagtagtagtgttcattaccatgtttttcatgccttatgaaacatcctattttaatccttattgttaagccctatttttcttttccttttccacgtgcctaattgtgaaggaaacctccctctctcccatcactccttagttccttctctgagtcccaagtggcattgattgtgatttttcttttaattacaagtagagcttgttacctatatgtagaaggaaagctaaacattttgatataaaattagaaataattcaccaaaataactgtaggtaaagtaagaagagctcagacattcgattcataataataccataagggaaacacactactttgctgtagttcaccaaaatagctgtaaaggtcactgttaactatttaactttctcttaagaacttgtttttccctgtttattagtacataattaaaaattcttattcaggcccagatgtgatagcttatgcctgtaatcccagcactttgggaggccaaggcaggaggatcacttgaaggcagaaattcaagaccagcttgggcaatatagcaagatctcatctctacagaaaaaattgtttcgaagtagccaggctttgtggcacatgcctttagtcctagctgctcaggagattgaggcaggaggagcccaggtgttcaaggttttggtcagctatgattgtgccactgcattccagcctgggcaacagagggagaccctgtttcttaaaagacaggaaaagaagaaaattcttactcaattatttgctttggttgttgactaatataaaagtatttggcatgttagccatagctttcgtatacctatttggacacctcaatatgagttagagactgccttcttccacacactgttttaatatctaatagaaagaaatattacataacctgggagattcagaaacttatgttgaaacaagctttgaatattaatttcgttgaaggtttatatgaaaccaaaagtactacaatagtaatagaaagctcatcttctgtttattaattatagataaatttgagttgttggtatagaaaggtctcagttaatgagttctctcaccaatattagctgtattgtaatattttcctcctgtgtgattatactaatatatttctttttattgaaagcttgcaaatacagaagaatacatagatggagctttgtctggacatctgggtgaagttttaataaggtaacaaacagcagtagtatatgtaaggagttactggtgagcattaggaatacctgttctaaatatattagtgcctcaattttggaattacttttttttaaaaaatcactattataatactttacagttagacttcagaagtctttgaaattgttaaacttgtcaaaggtaagttttcaaatgttttggaactggccaaaagatttttctagtgttgatgtttaattttctagctcttagctataatcttttgcagtggcaaccttttgcagtggcctttgttgcgggaacttagttttgaattttagttgggtctggctgttttgttatattgattttctgtactagcttcaaagctccaaattctggtaattatttcctttggaaaatcataaagatgtcattttataacaaccatatggtggaaaataagtgccatgtgcttttcaacaaatctatgtgaaacttttttttaaaatgaatatatttaaaaaatttttttaaagacaagaatattataaatatagtattcagtattttcataataaaaatatagtaattcatatcatacatggtttctggttggaacaacaaaatcgactttttctatttacaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcaccgaactaatgctttaaaagccactgaatttcatttaagttgcttttcttttgtaagcccaatattcttttttttcccataaaggataattatttatatgctttagatatttttatgaaggtgaatttcagaccttttcttgtaaaattatctattagctgagaccttttaaatgcaactttttcttttaaagttatttttgagctacttttaacgtataaaattaaacattttcttggtattaataatatactgtcttattttacttagtagtcaataaattacatgttaattctgtgtcaatataagctaaatgcacatattgtagctaaaattgaagcatcttctaaaaattaaaatgattgtacagacagggcacaacagaaattgggaactgacattcaggctgaaggcatacggtttgttcactgaagagaaaaaagttctctgaacaaaatgtaatgtcaaataaaaaccagtctcaccattatgttctgagacataacctcgaggttgagttttaagcccctcaaaacccttcaggtattttagggttgtacattgttaaaatgtatagtccatagtaataacagtatgctatgaacttccctacagatgggttgagaaaatacatcatttacattctcatgttgtaagagaatggccattattacacttcagtgttcatttaccatagttttatcagtaaactatctttgtgtatccccaagtgggacaactcaaagtatagaagaaagtgtttagctatatggaataatacttatgatatgaatacttaaagacttaaaatttacaaaatacacctaagacattctggtaataaaatgtcttactgcttttattcaagtaaaaaaatattcttcctcttgtgattttgtttttgtttcattgactaaaggtagctgctgtttgttaccagatggaggttttgaatgaaagacaagtcgtcttcccaactgaaacaaaagaaaaacaaaatacttaatattttttgagcatagccattttctattgaaatttgtgaaataccaatattaacttgatttttacaaggaataatatggtttgtaacattaactaatcacagttaaaagggacttataacctaacggatgtctaacatgctaggcaaagttgagtagcaaactggacaccaataactatgcagaaggaacagcagttaggttttattgggaagtgggaaaacttaggtaaagtcatcaaatagtatatggttcaaatgtggtcagcctagaaaagcaccatgttgaaggccaccattttatttctcagtaagtgccatagccagtttttcgtccatggttggaagagatggctttctcctgttgagcacctgactagcatttagaaatcttgttaaataaaaagtccagaaaaccatgtaccatcttgaatactggttggcttctggaggtgttcccaacagaagaggctttgggaaaccccgagttcatacctattcattctctctgggtcatatatactcaaatatattactacttatttttctctttacttttgggattccctcctccgctttttattttgttttgcttttatagctgaatttgtgtacattaaatgtataagtggggaaactaccataattctatgagatttgatgggacattgccactgtgttcaaaaggcactattgacattgtaggacaattcttatgtgagattgtcccctgcattgcaggcctgagagaacctgaataacaatagcacttttccccatcattgtaacaacaaaaatatccttgggggactagaatttttgaattccttctgcaatatcggaatttttaactgtcaaagatctttggtaacatttgttattaatagtgtctgagaaaattagcaatgatgaagtgtcctaactgggtc

SEQ ID NO: 14000 - DNA, 154626 bp, Human
  misc_feature (1)...(154626): n = A,T,C or G
gcaataataaaatcctttaacaaccactcacacaaaaatatcctaattttttcatggtgccaaaagggaacattgtgatttactgatcttcttttaacttgccaatttgtaattagctgccttatgtttaaaatcagactatttttcctagtgaagcaacaattgggtaagttttattttactcaaaagtacaataaaaatgtattttacagccatttcttcccttgcttacattaggtttacggttagaaaaacactcttaattccatttgccataatgagattatttaccattaccaatagcaaacgaatgaaagatacattttctaaagcaatggaacactaatattttagtactctagttgtccctgctgaatcggcattttaaaatgttcgtaacctgtcagcttcatgaaacctaacgatcattggtttaaaacatttttgtaaacttgaaagtgtagcttgtgataaacaacaaaaaaagaaagaaaagaaaaatagggttaagtattttacgtatcagatgaattaacatgaactgcagggcaagacttctgtaggtggagctcatccgataactgtgctaaggaacctcctgccgagttccttgctagctgctcgctcgcagcgtggtcctcggccccgacgcgcgctttcgagcttgttccgcagcgggcgctgaagagaggcggccgcgtccggacgctctgatgcggttgcgtacgttttcagcgcttcccgctctccaccggttggactgaggcttttaaactgcagtctgctcccgagtccggcttcctactcggtctggtgccccctggtgctcgtcccctccacatcttgagtagttgcgaagagcacaggggtccaggcagacaaggatgctttcaagaaaaacattccatggcggcaagccgcatggatccacatttcccgggcccagagcctttgtagacattgcatgtggacattcaggagctctagagaaagagggggtgttgtttcacgaagccaccagcagaagaaaggtggaaaataagtttcaaccaactacaaaggcagaagtcagcccagccccccaagtgtggtcaaagacccatagatccgtagaccttatcttttcttgaatccaccgctcccccaaccccccttttattatttttcagacaaagcaaagatagagttcactaggatccccgatttcagtaaggcagcccttttttgagagccagaatatccgtctcggccgggagctgagaatgtggccttaattgatgaggggaggaggatggaaggtaatcctccgtgtctcctcctccaatccgtttaatcaatattaatttcatgcacaatcttcacaaagtttcttttcccctcctccgactcagagctcaggctccggttatcctgctttgcccttcccttccaccctcacagccctgcagtcactcaacactactgaggctctctccattaaagatgaacaacagatcatttttcattgcatggcaaccctaagagctctctagcttagcagagcatgatgggagtctttccatccccccccccccaccccccgcccgctcgttcctcttctttttttttttttttccttcctttccttcttccacaattaatccctaaataatgattttcctaagctcgcgcggacttcgggatggggttgagcgacccgtgatgacgctcccatcagcctttcagaagggacggtttccaaagaaaactacaactcccacgaggcattaggctacagcaaccgcaaggcatcacggaagtcgtaggcacttttcttctaggtcccgttcatccccgccaacccgtaaactataagtcccagggtgcctcggggctagcacgcctgcgcaaaagccccggagcgagttggggggtggggctgctccgggcggcggggggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggtaaagccccacctactttatttgacagtcctttggatcccaaatttggctcggcgaagccagttgatcgagttcacccttcacttggcattctctgttggactccgagtgggacggggaggccaacttttgaaaggggctgaaattaggagaatgtggagcatgtgcctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcagtctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaaaaagactcttctctgccccttttggatgtttgatgttgttctacctaatgatgcttaagccttacagtagcagcattgctctgacgttcattaaactaatgtctttcagcccattcactatacagcgaatagtataggagcccatgcaaaattgtgtaagtgctttgagagtcgtaatgtcatcatcattgttttaatcttataaaatatctttaagctgaactttcccaagagtccgaaggagtcgcagcacttccttttttaacctctagtggtgtaaataatggtgtgtcattccggttgactagtacattctaggtttaaacagctgagtttgggctacttgttgcttgacttactgaagcagcttgcttaaatattgccctgattgggcataggtgaacataggttattagtaggagcaggtttatgctgaaggaagtcagccacattatgcatgcataaaaattgccattattgatatagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaaaggtgacagatctttaaaaaaaaaaaacctcgtcaaacgaaaactgttcattttggtcagtcatattcaaaaaacttagtctgggccaggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaacaaaaaaacttatgtccgattccttttggtttacaggcagaaatttacaggtagacacatttctttcttgtactatcgatgcttattgatactgatgctggaattttattcttccattatagttttatatttgaataggtgctttttaacaattttgttttccttaaccggttaccttacttttttaagactggacccaattacttgttgagcactttatgaattaattttgttagttttaattatttcacttctgagacttcttagcatgtgatgtgtgttttccttttatcacctggaattttctgatactttattatcttggaactgataatacagtgaaaaaaacttaatttgtctaatgtcacgataaaaactttgtccaagcttctcaggttttcttagaactcgtaactttttggatttttaattctctatctaggcatgggcattaccaaactaaagaaaatcttacatcgcatattatttttgagtcatttcaggatttggctgcagaactagatgaatcctagcttattaagtggtacctggtttagaaacttccatgttatttgtctgtgcttctgtaattttttgttttgattttgaaaagattatcttacctgaaaaatcctttatagcagtagttaggcagtatttttggttttttgaccaggacacttgcactacatgcctaataaaatattcagtgggtcagtgtttgaacttttatctttggagccaaattaaaggacaagccaagggattactaaagcactggaaagatagaaactttttcgctaaatgtatccttttaatatacatatatttctgaagcaagacaggagaatattgagttaagttgttgagttaaaaatcttagtgtattgaaactgggagaaatcttaggttattctgcccagctatttatttgacaaataaggaacctgaaatcatagagcaggtaaataacttgattaggtagatgaagaacaaaagctagttaggatctaataatttgggagatgacaaagcatttgtagtccagtagatggctaataagtcatttcaaatgaagcaatattgtgttggtgtggaagtggctgttggatttctggagaaacccggtccttatacccatggcaaatttcaggcttctgttttgggtgttgatttttatcacttcaaattgagatataaataggcttttgtggatgggtcaatatggtatacaaatcaagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaattttaaaaataaaaataataactttatccaaaaagttcaactttaaccataaagttcatccttttaaagtatatagagtgttgtttttagaactgaagttacacatttaaatatgtatactctattaataaagaaaaaatagttattttttgggaaactgtacaaaggatgttatcacatacatgcagaattaataaaggttaacaatatgtcatagttactcaaaatatttggtgaccttacagtttcagaagaagggaaaatttgcagtgggtttaatgagtggatgagaggaagtttagaaagtagagacaataagtgtaggctggggtgagggttgaaaaattacatattggatacaatgttcactatttgggtgataaggcgataaggttaggtaactagaaaccctaacctcaccattatgcagtatatccatgtaacaaacttgcacatgtacccctgaatccataataaaatatatgtatgtaaataaaaattaaaaaataaaaccatgaacaaaataagtgtaggctgtttattctggtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacaggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattattatttttgagatggagtcttgctctgtcgcccaggctggagtgcagtggcatgatctcagttcactgcagcctccgcctcccaggttcaagtgattctcctgcctcagcctcccaagcagctgggattacaggtgtctgccaccccacctggctaatttttgtgtttttagtagagacagggtttcaacatgttggccaggctgatcttgaactcctgacctcaagcggtctgcccacctgggcctcccaaagtgttgggattacaggcgtgagccaccgtgcccggccctagatgttctttagattaaaatagttcattgtggtcaaacaggttcatgctctcttacaccaggggtaatccatacttggacacacaagagcttatgtcaaaatatggcagatttcttaaaatattcctgttgtggcagactttctgggttgataggtttttttttttttttttttttttttggagacagagtcttgctctgtcgctcacgctggagcgcagtggtgcagtcttggctcactgcaacctacgcctcccggattcaagcaattctcctgcctcagcctgctgagtagctgggattacaggcgcgcgccaccatgcctggctaatttttgtatttttagtagagacggggtttcaccatattggtcgggctggtctcaaactcctgaccccgtgatccaccctccttggcctcccaaagtgctgggataacaggcatgacccaccacgcctggccgggttgataggggttttcagccttacctacacatgcaaatctcctttccctctgtaatccccaaatttagactttaattctcctgtctttcaaggggagttgccttactctgtgtgggttcagggtgagggaaacttttcagccagtttatgtcattgaagtacattgaagtttatcagggaatttctaataatagtaaacttaaaatggaaggccttggagttgtagttgtttaccagaagagtttttggctttttctgcatacttctacacacctcttacctcccttcctaattgatagagacagatttttatcaggtcacacatggaatctgctactccctttgaattcaggtctgtttgcttcaacgacgtaactgagaaggaccactctagatggctcctttctacctagacatgctcttttctacctagacaaaaaaagccaccagccattaataaatggtaaactatcaacttaaatatttgttctgcctacccaggcaccctactacatagaggggctagtttaggttttagtttggtgacaaattgtttgtgttgcattgtatcaggttttttttgttcgtttgtttttgaggcagagtctctctctgtccaggcccaggctgtagtgcagtagagagatatattggctcactgcaacctccatctcccgggttcaggcaattatcgttcctcaacctcccaagtagctggggttacaggcgcttgcaaccatgaccagctaatttttatatttttagtagagacgggatttcatcatgttggccaggctggcctagaactcctgacttcaagtgatctgcccgcctcggcctcccaaagtgctgggattacaggcgtgagctaccatgcccggcctgcttgtatcggtttctttatgtctccacagatttttttgttttcatggacataagtggggagcatagagatattttgctagtgatcatcctctggctaaagcatagtttgatttctgtgataagaatcttgaccatattctatccctcttagaagggcagaagtgaaactgccatattacccataaataccactattataggctttcacaaatctgtatttactgagtgtgtacttggtgtgaatacctcattaatgttttaaacatctgccattcttattctcttaatgagtaaagttaacttcttcaacaaccagtacttagctaaatattacacaatataatttttccctttcttcatgtaatggatgaagtttttttgttttttttttgagacggagtcttgctctgtcaccaaactggagtgcagtggtgcaatctcagctcactgcaacctccgcttcccaggttcaagcgattcttctgcctcagcctcccgagtagctgggattacaggcacgcaccaccacacccggctaattttttgtattttagtagagatggggtttcaccatgttgaccaggctggtctcaaactcctgacctcatgatccacccgcctcagcctcccaaactgctgggattgtaggcgtgagccactgtgcccagcctggatgtagtatttaaagaaaaaacaaaaaactctttactgtgaaatactttcaaacataacagttgtcccagatttggctagaagctaccttccgtttccttttttttttgacagattctcactctgttacccaggctggagtgcagtggcaccatctctgctcactgcaacctccgcctcctgggttcaagtgattctcatgcctcagcctcccaaattgctgggattacaggcgcatgccaccacgaccggctagtttttgtatttttagtagagacaggttttgccatgttggccaggctggtctcaaactcctgactgacctcaagtgatcttcccgtctcagcctcccaaagtgctgggattacaggtgtgggccacaatgcctggccccttctgcatccttgttattaacatgtccctatcatttttttatgacatccttactttctgtagaagatgttctcagttcattttattatttccccaccccagtcctgcagcagcaatttctcctggagccctggttctttttattgtagaaaggtattcagaaaaatctgggtgccaggtgtgctcggctactgggcctgttttcggtgaagaattagtgtcttagttcatttgcgctactataacataatatataaagaacagaagtttatttcctcgcagttctgtaggcctagaagtccaggcaagacagaggcatctgttgaggtctttcttgccacgtgctcacatggcagagggcttcagggcaagagagtgtgaacccactctcaaaagccttttttatagctgcattaattcattcatggaggcagagccccacttcccaaaacactgttacattgcataagtttcttttttttttttttgagacggagtttcactcttgttgcccaggctggagtgcaatggcgtgatctcagcccaccacaacctccgcctcccaggttcaagcgattctcctgcctcagcctccctgagtagctgggattacaggcatgcgccaccatgtctggctaattttttatttttagtagagacatggtttctctatgttggtcaggctggtctcaaactcctgacctcaggtgatccacctgcctcggcctcccaaagtgctgggattataggcgtgagccactgcgcccggccaggaattaagtttctgatacatgaatttggtggggaggaagcatttagaccatagcagttaggaaatatttataagtaagcatgtgtgttttggattttgaaaatttagtatgaaaaagaaaagcatttgttttcaaaaaattggattacatattgaaatgatgatgtttagatatatttgttaaatatattaatctgtttctttttacatttttaatgtgactactagaaaattaaatttcatttagctcacattatgtttctgttaaccatcgctaatttagactattctattaaaatgctgtgaaagttgatgctacagcaaatttactacttccttttaaaaaatatcttaataccttcctttttgtggtttcttgcattagcatcctctacaggccataattctttgctgttgctgaacacagaaatttggggttttaaactcttagtggtttgtgatgcttttcataccagattgttaagaaaattggaatcctcatcctttaaaatattatcttttgttatttgccagcatgtccggtaatcagaaatggcatttctttatggctttgttctttgagaactttaattgttgttaagagaatattagaagtgtttactataaatatcttgaaatatttgggaaatattttggtttatttcagataaactgctagtgtatgtttggaatacgttaaatgcataaacttactgctttatattttctttttttttggagacggagtcttcgctttgtctcgcccaggctggagtgcagtggtgtgatctcagctcactgcaacctctgcctcctgggttcaagcgactctcctgcctctgcctcctgattagctgggactacaggtgcatgccaccacgcccagctaattttttgtatttttagtagagatggggtttcaccgtgttagccaggatggtctccatctcctgacctcgtgatccgcccgcctctgcctcccaaagtgctgggatgacaggtgtgagctactatgcccggcgctttatattctttagtaatttctggccattgtggctccttaagcttgttaattaatttagtgtccatattcatatcttaatgatactgagaaattggttaaattggtttttggtgtctgtctcttgcttatgaaagataaactgtagttcagctatttattagcattgagtttttctagaatagttaaatttttttgtttgtttttgagacagggtcttattctgccccctgggttcaagcgattctcctgacccagcctcctgagtagctgggattacaggggtatgccaccacgtccagctaatttttgtatttttagtagagacacggtttcaccatattggcccggttgatctcgaactcctgacctcaggtgatctgcccgcctcggcctcccaaagtgttgggattacaggcatgagcctctgcacccagccttaactgctttattttaataaagttgtaatatatttgagatggcaagaccattctcttcagactgttaatggtaattttttaaaattattttttatttttagactgggttgcacactgtcacctaggctggtcttgaacttctagcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttattgtaaccatccttaattcatacacaaaaaagatgctttaaaaaattagtaaaacactctcgttataaaaattaggaaattagaggaggaaaaaggaaataaaaaatcacctgcagtcagtatctttatccagagataagcattgttactgtgtatgacacactggtttctgtgtgtttgaactctgtttttatagttatcgttatattgtatggttgtacagtttgcctgttttaccacatagcaaaagcattttcccatttaagatcttgaggtttttagattaaaaagcagcaaaatatttgtacacagtaatcataattggggtgtgtgtgtgtgtgtgtgtatgtatgtatgtgtgtgtgtatgtataggggtgtgtgtatgtgtatgtatgtatgtatgccaccatacagcagcgtaattatgtgtatacatacgtatgcacacacggttatgttgctgtatggtggcatcatttgcctgatttaccttatagaaaaaccatttcccacattaaaattttgaagttatatataaaaaacacttgaattcttgagtatatattatttttttaattctcagtaagagaaaattagaatgtttgtcccacagatgcaaacatttagttagaactaaatctagtaaattgatcattgatacatttgattgctctgaacagaagtttagaagtcatggttgatatattacaaagctaaattatttttttcacttccagtctttgttcagagatttgcaagaaagtccattcactgcttcgcatataatttggggtattatcagtagtttgtttttagaacagtggtactgtgtggttcagaaatttgtaaaagccaagtgttagggtgtttaataacagtacattgtaagttctttgaggagctgggcacggtggctcacacctgtaatccagcactttgggaggccaaggcgggcagatcacctgaggtcaggagttcgagaccagcctgaccaacatggagaaaccccatctctactaaaaatacaaaattagccgggtgtggtgacgcatgcctgttatcccagctacttgggaggctgaggcaggagaatcgcttgaacccgggaggcggaggttgcggtgagctgagattgcgccattgcattccagcctgggcaataagagcaaaactccatctcaaaaaaaaaaaagttctttaaagaagtttagtttcgtatattgactaagctatagggggaaaagccttactgtgccttttccacttcctacccactcaagataacctaagttggcttcctttatttaaagtgttaaatctactctagagcataccaaagatattttgaaaatataggaaattcttaatgcatttaaaaggaactacttcccaatcagtttttttcccatcatagaagtaatgtatactcagagatatcttaaaaaacaaggaaaaataaaaaccaaaataaccccactgaagtttcatcactaaaagacaatgtcgatatagcatttagaatgtttgcctgttcctccctctcatgatggattttaatatttattcaccaaatgtttattgtactcctatgtgcttgaggctgtctcaggtagcaaatagagaaaaaaattctgcccttgtgaaacttatgtttcagtgggatcataggtgtatgtttgcaattttatatcctgaaaattttataattcagtataacataagaattagtataaatatttttaatagctgcttgacagttccttatgtgcatatgccataatttccttcatttccccacagtgttaagtatgttatttttgctattgtaaatatagtgggcgagggtcttactccacaaggttgtaaccatgaaataatatttctgttttatgaaaaccaaatttaatctgtgttgtatccttacctaattgagatggccattatttccctgcacaaatccccctccctctaatccttggtgagcttcttacattccagaactttatcaggaaagggctttcctccagtctttcacctacaccgcttgtcattgacatgcccatttatgtaagtctggaaggtttctttaaggcctcgttacagagaatattgggtaataggatctttgcacaattttccgaaggaaagtttttaccattattgtctctcccttctccctgcagctcccaaggagggtgagtgtattgatcttttctggatgaatcctctaatcccttcctttcctccagcatctacctctcaaactccattctcatcccctccctcttgagtataatccaaccagactccttcctttgggcctggactttctcagacagaagccagctgaggagactgtcttctaattgctggttctaaaataacagtcttgaggctagaggcccacaagggcttggaataggagaagggaatttgcctacttagccttgtgaacaaaacactgatcagtacctcagatttcactgtttagaactattttcttaggattaaatttcagaaatggaattactggttctaagggcatgataagggcatgaacatttaaatactttctattcattgtaagattgttttccagaagagttatatagattttcagtgtcccaagtgagagttcttattttattaaccccatttatcaatactgttaaatatttcataaactatagtttatgtctgcagaacttcccccatatgctttgataataataactaattgtatttcctcttttgtcttttgttatatttttgccttcaggtgcttttctcccctaaccagttttcataagttccttatatcagaatgaatccttttatattttctgcaaatatttttcaatgccgagaatttaatgtcaatagtatatcactgtttataccatcaaattggttagtcatcttaattctgtttttctttttttcatttaagtatagtgaatctttgaacttgataggtgaatttctggttttttatcttcttgatattggtgtttaaaatggatttatcttcatggatatatttatgttatagtattaaaatctgaaattgaacttagtatacaaaaaatagatttttaaaatgtttatactagctccttatcaatgtttaaaattttgcttttgcagttacaataatggttattcccttatttctgtatttactagtagagagtaaattaagacattactgaatacaatgagataaatggcttatcaagtaatagtctttcttgtaacacaaatgagttcttagatcagttgtctttaaatttgtcttgttatggcaagttgtgttttcagtggcaactttttttagggcctaacgtaaagtttgatcagaagtttgacgtgtaatcccagcactttgggaggccaaagccagagaggatcacttaaggccaagaatttgagaccagcctgagcaacatagcaagacctcatctctgcaaaaaaaaattaacatattagctgagtgaggtggtacatgcctggagtcctagctatagttcaaggctgcagtgagctatggtcgtgccactctactctagcctgggcaatagagcaacaccttgtctcaaaaaaaagtttgagctatgtatgtttgaagggcttgtgttctcaaattggtgagaaaagggtggcgatttgatactatttatgaaccagacactgtgttttatatatattctcttttattcttgtgtcatatattcttatgtcacctgaatgaggtatcagtcccattttacagggtgaagagactgaaatgaagtaatttgccaagcttgtgttcaacaaacgtagaagtggcagtggagcctagatcattcttgtttgtttgtttttcatttttgttttaaaagctgagcatgcttctcttcaaactttatgattaccttgtagtgcacgttaaaactaatagctcaggttgtctgtgaccccaaagacaataaagacaggatctcattctgtggcccagactggagtgaagtggcaggatcatggcttactgcagctttgaactcctgggctcaagcagtccttcccctttagcctcccgagtagctgggactacaggcatgtaccaccatgcctggctaatttttaaaagtttttgtagagatggggtcaagctatgttgctcaggctggtctccaactcttggccacaagtgatcctttgcctcagcctcccaacgtgctgggattacaggtgtgagacactgtggcctttttcagttttcaagctgctgtttgttgttacattttaaaaatgtgaagttaaagtcagatctctgtgtgtgtttgtgtgtttgtgtgtgtgtgtgtgtgtgtgtgtgtgtgtgtttcttgagatggagtctcgctttatccccaggctgagtgcagtggcgcaatcttggctcactgcaacctccacctcccaggttcaagcgattcttctgcttcagcctcccgagtagctgggactacaggtgtgtgccaccgtgcctggctaattttttgtatttttaggagagacagggtttcaccatgttggccaggatggtcttgctctcttgacctcgtgatctgcccgccttggcctcccaaagcgctgggattacaggtgtgagctaccgcgcctggcccagatcttaatgtgttcttgctctgcgtggtgtttgtacctgggctggtgctttgggagagaagttgcattgtatggttgtccaaggacttccaagaagacagtaaaagaaaattaagatttattataaattagaatgtgaactatagagaattgacccatagtgctatgtttgagtcataataactgactagtgtttacaaagacttattcacacagagtagctattcattcagaagtgttgaagataaaaagactgtactaaatgacctcttggtccctttattgttactattctgtgatttattgagaattatgtgtatatttaaactcattccatgatgtgcagtgttaactttttagttacttttcttattggataaaattagtcagcatctgtgctttttttcatttggagggattttttttgtttttttttttgtttttttttttgagatggagtctcgctctgtcaccaggctggagtgcagtggtgcgatcttggcccactgcagcctccgcctcctgggttcaaggaattctgcctcagcctcctcagtagctgggactacaggtgcacgccaccacgcccagctaatttttgtatttttagtagagacagggtttcaccatgttggccaggatggtctcattctcctgaggtagtgatgtgcctgcctcggcctcccaaagtgctgggattacaggtgtgagccaccgcgcccagcctggaatttttaagtagctaaagaattagatttgtttttatgtgaaagatatgattttgtcatagagttaggcacttgtgttactttggaccaaacgtagtctgctagaattttgagatagagctagatatgatctaccatggaacataattcagctatgtaatttcttaagtactagtatattatgaactgggaagcatttgaagagaaacagtgaaagcaaagctcctggtatttttcatgaaatgacaagtggtaaatagtatctattaaaattcactgtagttgctcagtgaaacacatcaatagctacatggtagctatttaagaaaaataacttaccacagactcaggaaactttacagtgtttgacttccaacagtttacagtatttatcatctgtgtttgtttgctgttcagatatggtagattcgtcatattaaacacaagcttcatgcggtaaatgtgactctaaaacataatccaaaactttggcagtggatgccttgttactttagaaagactttaaacctcactttgtatttagtgctctagctatcaaatctataagtagtagctgagtcctggttacttaaatgatttaaatgatgatattctcacctaaaagggctcatttaccaacctaagcaatttcacctttttgcttataattagggttaaattgtgcttaaactgtttacttgacctgtgggaaaccagaagaaggctactcccttatactactgaatgtttagaattttaatacctgtgattgtggtttgatgttttagttttaaaaggcattgaaaatcttgaaatttatgtaaaattctctttttaaattttttattattaatttttttttcgtcttttcctttttctttctttttttctgagacggagtctcaccctgtcacccaggctagagtgcagtggcgccatcttggctcactgcaacctccacctcccgggttcaagcagttctcctgcctcagccttccgagtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacatgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctacttttctccaaaacagttgaataatgtactcattttcataaaattttagaaaaattagtgagtaaatttttggcagttattttatttgacatgtgagtggtatttgctttcagatttcgaattccctgttgggaaagtaatatggttatgttgctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctccgcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcatgagccaccgcgcctggctcctttcccttaattttctgaaagaaaaattcacatacagccgtgtgaattgactggactgtgaaattaaaataatggatttttttggtctttatactgcaagtttgagaaataaagaacaaagcattttctctgtggatgcgaagaactctgtacttgactcagcttcctttttctcttgcctgcattttttgtttacttcactggcttgattagtcataataaggctcagtacctctgccattcccaatgttaagcaattttttaaaatttggaattttgtggataatcattaacagagttgcttaatgggtaatgttgttttctttatggaaataatttgaggcaccttttctggggttcttggcaagaaatatgagtttattatggatatttaggaaagaggatgtagaaataaacctttgtttgtagtatgaagctgtgataatctgccccatctttgtctaattccgttttaacttctgtccttaacatgtttctcttcttaatcagttgtcagtgaagatttatttatcaggagatgggaatggagtattttggatatacttcaagttttgaatgataaccgttaaaatacatacaatgttttaatagtgagatacactgatcacaaaaatatggtctgatttaactttattttgtggtacttttcttctaagtttagacagatgatagaaattcacaaaaatttcagtcatagttatggccacagttaggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaaattctgaattaatacttacatgctgaagtatctttgtggagcttattttgagcgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttgggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctacttgggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgcgattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctcattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaatgtatgctgttgtaaaaattgaagttctatgtttatttgaaaatagtatttattaagggaaaaaatctgtatttgttaattgtattgcttaaattccatgtatttttgttgccttagactacttgattagctgatatttgataaacgtgtcagccctacaaaataattgtggatttgtcaatttccgtttgtatttctaacagtttttatgttatatattcatagctttatatttaggctgggttaagcatgaatgttatatacgtaaataattgtactttttatcaatataaaatatgcagcattttctcaaataattctctttgcttaacacattccctttttatattgtcattcttttttcacatttgttttatttgttcctctatcttcccttttttttttttttttgagacagaatttcactcttgttgcccaggctggagtgcagtggcacaatcttggctcactgcaacttctgcctcatgggtttaagtgattctcctgcctcagtttcctgagtaactgagattataggctcctgccaccaggcctggctaatttttgcattttagtagcgacagggtttcatcatgttggtcaggctggtgtcgaactccttacctcaggtgatccacccaccttggcctcccaaagtgctgggattaccagtgtgagccactgtgcctggccctttatcttcttttttatgtcattttaattttgatgtgtttcttataaataaacagtgtttagacttttttttaaagcctgttccacaggttttttgtaatagagaactttaacgtacatttatagtaataattggtatgtttggagttggtcttcttcctgccttctatgtgttttaattggtatgtttggagttggtcttcttcctgccttctatgtgttttatttctgccttgcctttcttagatagatttattttctttgcattttacacctagtagtctatcttttatgtaattttcattatttaagtgacttaaatgaaattatgtatttttcattgttaatttttaaaacacctacatattagactataaatctactttataaaaataaaattatttctctacttttataggtggtattgtggaatggcaaagcacagactctagaacaaggcagcttctgtttacaccttggcttggctttgccacttttttattgtaatcctcttgtgcatccatttcttttttggttaaagtagagatggggtctcactgttgctgatctgaaactctgggctcaagtgatcctcctgcctcagcctcccaaagtgctaggatttcaggcgtgagccaccaagcccacgtaggtacctacttcacagaggtgttgttgagtttaaatatgttaatatatgtaaagcaccagaacagggtctggaagtcaataaatgttagctattattaggtgtcagttattaacaaaagcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttggatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacataaagtcagctgattgtaggtttaaccatatctacaaaaatacctttatagcaacacctagttagtatttgatagaataattgaatactgtagcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatacttatactctgctaacatgagatcaacttatgcactaatggaccatatttctaaaagtttgtgagttgtttgttgacttaagtgagaaaggcctgtaatgccagtaccggaaatgattgttcccagaataaccagcaaaagctgatacccagacagtatatctgaaatatgttacatatgaaaaatatatttaaaaatgaaagtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcggggggaaaaaaaaaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttagcccataattttcagagaaagtagttgtttgttgatggcaccaaacagggctcctgatttatgataaagaatcataaatttggtaaaagttacagtctgaagtacaaaaccccaatgattttccattctagtgcttcagtgagaagcttaacagtgtactatgtataggtagataagaataaagtaaaagacagaattctttgctgttaaaatgaaagaataacttttacttagcatagtatggtagtatactaataaatggtacacactgctagtcataaaatttagattttgtccccagttctacctgtatacctgtattattagtcctttgttctctgttcagtgtcctagtagaaactgtgtggttatactccttttttttttttttttttttgagacagagtctcgctctgtcactcagactggaatgcagtgattcaatactcactgcagcctcaaactcctgggctcaagcagtcctcccactgagtagctgagactacaggtgtatgccaccaaacgccaggctaagttttttaaagaacttctgaaagcatagagttttcaggatgtttttataatatttcatagatggtaaggcagtgtcagattgattcagttatgtcatcaaatgtctctctgccattctcagcatgtatttcaggctaatgccccttatggccctattttcagccatcacatgcatcctggatagcattcagcagcagaagcagcaatttctttaacaatgcttcatatcttactggtcagagttgtgggtcacatggctttgtctagatcaaatactgaaaatggaacttccatgattgggttaggccagttatgactgtcttgacaggagatggggcttgcttttcctctagtacaagatagatacttaaaccaaataaaggattatggttagcaaggaggagggggtttgggaatgacccagtagtagactgccaacagtgcctgctacttaactcactcttgcgagatggggaagtaagatagtcttgagggttggggctatagtagaatagaaggaaatgactttttggagaaagtgatttctttttatcttttcatgtttttattttttattacattttgttttttacttagggatggggtcttgctatgttgaccaagctgatctcaaactcctggcctcaagccatcctgtcatctcggcctcccaaaatggtgggattacaggcatgagtcaccgtgccacatctggagaaagtggtctgtaaactaagttttgtggacaaatggagattattagggagaaagacttttccttatccttctgagcccttggttgtctatgggtactgttgcttgttttcatttttaaggatagtaaacatacttaacatttcccaaggaatctgtcttgacctgtgtatgtgtgtgtaaaagctgcattgtggactttttgaaaaagaacatataataaccagttcagttgaatgcaacgtgctctgtgagattaagggctcacaagaaactgctaatcacagttttaaaaagacaatcttttgatgtctcatatcttagtgttactatgagtttatagcctgttattttgtttagtgtttactctgtcttgcctttcttttttccttccttcctttccttttctttcttttcttttggaagggaacttaagtacatcttctggttctttctgcctgatctcttcctcttaattttagaaatgaagatgtagaagtccaaagaggatttacttgatgatttgactagaaaagctaggtttaaccaggtcttctatggaaatgaattatagctgtagtgaaaaaataagggaaatgtgctatgtttggattctagagacagttctctagaatagaaaatcttctaaacccaagacagcttgatatttgaaaaagggggtataaaacctttttttaaggattggcagatcgtagtaaatattgtggatgtcatagtaccacaatatataataattaagtaacatacttagaatagaaatctagaaatgtcagtaacagaattttactatttctctcaccacacacacacacacacacacacacacacacatacacaaaattatgaacacataataaaggacttccttataactaagaaaaagataatacatgaatagagaggcctatctggaaattttcatgtatatgcacaacatttcagtgataacagagtggctgttataaataatgatcgtaaagtgcggttataaattatatcatgtatgtgaaaattattttttgtacagtatggttctttatctaaaacgtagatctttgcttttctataataacattctcttctaggtttcagcttatacttgacgcaagaggttctttgagagagcttcttttttaaaaaaaaaaaactacatttcctattacattttatatctagcctgccaccctaagatggaaatccattttagttcatcaggtatttattaatggtttcactttgtgaaagatattgaagagggcagataaaattgtcatttacagcttacttagcatagtacattgtgcttaaaatatatgacattaatataaatgatgccctttcttgataattttttttatctctaatcttaaattgggggatgatgtttctttttagcctttttatttttatacatatggttgtccaagagtcatgtattaacccaggtttagaacacatcataatgtcactgcctccacttcccagactccaatagggaatagcagctttattctacccaggtcctatcagagggtgcacaacagatgaggggaattgcaggatttcccagtacaccaaactgttggtcagccttcctgcctttattccccatgtagacctaaatacagaaactttttaattatcttggttatacctaaacattgctactcccctacgctagccccgcaaaagtgagagagcttgtcaaggcaaagttttttgaaggaagaagccacatgaaatgagagagggaaataatgtatactgtgagcttaggaagagcaaaggtataaaggtgatagagagattggcacagaactacagtagtatatgtattagttctgattaataaatgtttcaatttttatgatactgttattctttttttttttttttttttttgaggcggagtctcactgtgtcacccaggctggagcgcagtggtgcaatctcggctcactgcaacctccacttcccagcctcaagtgattctccctgcctcagcctcctgagtagctgggactacaggcacccgccaccacgcccagctaatttttttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatattgttttgcttaagattaaagccatataaaaaatttacagcagaacctggaagttctttcttgaccctaacctcctttactcctttgcccagaggcaaccatatatttgtatgtatttccaattcttcatgcttttacacaaatatgtactcacattaaaaaaaatatatataaacatattattctatgactttttttttctttaattcatagagttcttaatcaggtctagtgaactcaggacaagagacacaacttggatataaatacctttaagcctctgttttcttcatgtgtaaaatgagggtaatgttttagtgttattacaaggtttaaatgagactacatgtggacaccttagcctggtaactaagtcacggtagctgctattattaataaacaaggctaacatgcttctatatgatcctcctgtacctaagaaataaacttatagcaatagagcacaatcagccagccatttaattttagagaataacatcttcatgtggcctagtaaaaatgactgttaccaaataataggctttttatgatgaatgaatgagtcagatgttttctctgtagtttttagaatcattgagataccaaattcttagctgttttatggaagaactttataaagtagagtttactgaagttgggtgactagaaaagcctataaagttaaaaaggagaaaacgtgttggttctcctaattaatgtaaattaaaacaaggagactgcccacaagagctaaatagtaaatttcggtcaaaaataatgatagtatttcttttttcaattggtagtaaaacattggaaataattattccaaatgaaaagacaggttgataacagttttcaaaaggatcaggataatagagattcatattgggtgacggtatggttttagaactgtcttccctattcttcctaaatgaagtgggccatttcttctcactatatgtatattcttgtctggccctgagacagaacactggattagaagcactataggttgactaaatatggcagttcttaaatctatatgatgatagtttgcattattttattgttaacttaccatttgcatttttataaacagctttattgagataattcacatactatacaattcacttggttaaaatatacaattcagtggtttttaaagtatattcagaattgtgcaaccatcacagtactaagttttagaacattttaatcacttcctccaaaaaaaaagaaaaccccatttcccctcaactcttccagttgtgtggataaccactaacctactatgtctctagatttgcctattctggacattttatataagtggaaccatataatatgtgatctcttgtgactggcttttttcactcagtgtaatgtttttaatgttcatccatgttatagcatggatcagcacttcatttttatggttgagtaattaatatttgattgtatggagataccattgtgtttattcatcagttgattgacatttgtgttgtttcccgttttgggttattatgaataatgctgctataaacgttcatttataaggttttatattaacatatacttgaatttctcttgagcagatagtaaagagtgaaattgctgggttatatggtaattctgttgaaccttttaaggaactgcaaacctgtttttcaaggtgactaccattttacattctctacagcagcgaatgagggttccaatttctttacatcttcatctgcgctaataaggttaagcataatgttagctgtggggttttcctagatgccctttatccaactgaagatgttcctttttcctagttggttgaatgttttttttttttttttaaatgaaagggtgttggacttcggtgctttttctgtgtctatggagataatcgtatgggctttgtactgtatggggtgtactacactaatttttggatgctaaaccttggattcctgggataaatcccatgtggccatgggaaataatcctttttagttgctggatttggtttgcttgtattttggtgaggatttttgtgtttgtattaataaggaatattcttcttttaaaatatttatgtattcatttattagagacagtcttgctctgtcatcttggctggagtgcagaggcacaatcatggctcactgtaacctcaaactcctgagctcaagcagttctcccacctctgtctcccaagtagctaagactatgggtgcgtatcatcgtgcctggctaatttttttaaaaaattgtgtagagatgtggtcttgctgtgttgcccaagctggtcttgttctaacctcaagtgatcctcctgccttggcctcctgaagagctaggattacagtcatgagctaccatgcctggccaagatactgtcctttagtttccttgtgatgtttctatctggcattggtgttaggttaatactggcctcatagaattcctcttatattttttggaagaatttgtgaataattgatgtcaattatttaagtgttttatagaactcatcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctggaggtaattgaatcatgggggccgtttcctccatactgttctcatgatagtgaataagtctcagagatctgatggtttgataaggggaaactgttttgcttggttggttctcattctctgtctgccaccattgatgtaagacatgacttgctcctccttgccttctgccacgattctgaggcctccccagccacatagaactgtgagtacagttaaacccagtcttggatatgtctttatcagcagcatgaaatgactaatacagtttctatagttcgtgtctttctaggaatttctttccattttatctagatcatctactctcttgctatacagtttcttgaagtttgcccattataatactgatactgttgcttactgttttctctttgttcctttaaagaaaaaaatttttatgctttgggggtcatttaacatttctctttttatccattggcttaacaagtatcttcttttctccttcttctttttgagacagagtcacactctgtcacccaggccagagtgcactggtgcaaatctcagctgactgcaacctctgcctcccgggttcaagtgaccttcccaccgcagcctcttgagtagccctccaccatgcccagctaatttttgtatgcgtttgtagagacagggtttcaccatgttgtccaggctggtcttgaattcctgagctcaggtgatctgcccttcctggcctcccaaagtgttgggattacagacgtgagccaccactcctgaccatgtatcttatttttaattttttttagtggttgctcttgtgcttataatatacattttaaattaatctgccttcaaataatattctacccttcaagattagtataaggaccttgtaacagtatattcttaattcctttattccatctgttgtgctacttgtcatgtatttttctgaagtataggaaccagagaaattataaggcagaggagtaggaaacacatactttcctgtattacgcaataaggagcttgataattggaaagggaaagggaaatgaatatatgagaaattcagaaagaatataatcagaattcttaatgaaatttgaaacctcaggtgatccacccaccttggcctcccaaagtgctgggattacaggcatgagccactgcgcccagctgaaatctcaaattgaagttgaatgatcaatttgggataacttaaatttctttgtggctatagacagatctatttcaagaagtctccctacctaaccatttttcctgcccctaaaaaacaaaaccagaaagttctgagaatcatcctagacttctcttcctcctttatatcttcattttccatttctaatcagccaccttgtcatcttgattctccctcatctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgtttatccaatcttctctcctaccatctcttctaaaattatataaacaattcccagactttattttaagttactatacatatgctgattttcatttccacacccacgttcttctttttgcattcctattaaattcatattcatgaaaataaataaatgtttctttaaagaatcctctcagaaattaatctcttttttgtctccttgttgtacttatacgctcttctcataatgattgtgtcattcttactgtgattactgtgttctttaaggctgtagctataattgttggatggatattgtgttcaataaagattggcagaatttagctagagtttagtaacatttttatgattaccttctatataagagaaacatcagattagtggttttgaatcagtattgtaatgtaaaatttctttataccaataaatttaagttttataaaaaggtagattttgggggaatgttagattttcaaatgatcgtaataatacagcagcaatcctaatgatagtatgcaaattatcggcgttcagttggtgtcaatttcaactttaggtattctacctatgccatacttttatttattattgcatcaaatgcagacaggttctactctctactttgtaagatgaccataatactctcactctcttaaaatcactatctggccaggcggctgtggctcacacctgtaatcccagcactttcggaggccgaggcaggtggatcactggaggtcaagagttcgagacgagcctggccaacaccgtgaaacccccatctttactgaaaatacaaaaaaattagccgggcatggtggcgggcgcctgtaatctcagctactcaggaggctgagacaggataatcgcttgaacccgggaagtggaggttgcagtgagccgagatcgcaccactgcactccagcctgggtgacagagtgagactctgtctcaaaaaaaaaaaaaaaaaatcactgtctaacctctattctatgtattttacattgtgaagatgagtaatattaatatctgccttctgtcttttaaaaatgtctaaaagtgaaaatcaattgtgtctggctgacatttctctaaggtaactagttatggatagagctcctttttatacttccttgttctgcttcctggttttcctgtcatttcaaattgccttggtttttttcttattgcattttctttttttttttgtttttgagacggagtctggctctgtcgcccaggctggagtgcagtggcccgatctcggctcactgcaacctccgcctcccgggttcacgccattctcccacctcagcctcctgaatagctgggactacaggcaccctccaccacgcccggctaattttttatattttttagtagagacggagtttcactgtgttagccaggatggtctcgatctcctgacctcgtgatctgcccgcctcggcctcccaaagtgctgggatgacaggcgtgagccaccaaagccagccttactattgcattttcaaagttttcattttcccatccagtatatcgagtcttctgccttcctagggaattcttcagacttttctatcctgctgatctgaacgtactgctttctgagtatgctgcacaactgtcttttttttcctttaattgtgttcctctttttaataaattatttaaaaatctatgaatacatatttaagtgtcttgctagtaagaaaatatgcatgtataataaactttgcctccacatatgaacatacttttcctttttaaaaaaatctggttttgtttaggattctgtttatttcattttcctccttgacactcgtggtatttctccccatctcctagatatttttttggttttggaaacttctcttaatttttactttttctctaccatctattgtacggggatgttaaatagacccttgtaaatatgtttttctgttttgggaagtgttctaattcttggataattttcactccttcatttttccctattctcttttttgggggggcatatatttatatgttggaattcttgtaacaaccttccccccgtccccaactacttgcctgatattttaggttgacattattttgcaagctttcattgaatttttgttttggtgagcatgtcttttttgagacagagtcttgctctgttgcccaggctggagtgcagtggcgcaatttcagcttacagcagcctcaacctcctgggctcaagcaatcctcccacctcacctcctgagtagctgagacctcaggtgtgcaccaccatgtctgtctaatttttgtattttttttttttttgtagagatggggttttaccctgtttcccaggctgcccatgaactcctgagctcaagcaatctggctgccttggcctcccaaagtgctgggattacaggcatgagccaccgcacccggcctgcatgtctgtcattttaagagtttcttctgattttctcacccctaatcattttctcttcttgctttatattacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttatttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaagttaattaggcacagtggtgcgcacccatagtcccagctacttgggaggctgagacggtaggattgcttgagcctgggaggttaaggctgcaatggtctaggactggactactgcactccagtctgggcaacagagtaagaccctctgtcaaaaaaaaaatttttttaaactgaatatttatttggactgaaagaagaaatgacaacaaattataaagttaaaagaagtcatatcaaaaaatcacaaaatccagaaaaaaacatttattaagtaccagacacatcctacttttgcttttccttcattttttggcttcatcttctttgatcacctttttatttggcagtgagtttataatactttatatatagaaaataaaaagatcatatagctttcctctagcattcaggtttttttgctatatgggtgttaataatttttattttaattgcctgctataattattttttattttggtaaaatatataacttaaaatttaccattttaaaaagtatattctatttcctgaattttttgtttctctgaggcaatttcccctttttgatgggaagagtgttttatctttgtgagttctcaagtgtgatgatctgtgggcctgctgatatttaagaatgaggcttaccattaggcaaactctgtatttagagtttgtctgtatttagagctcatagtaagcctcattacttgttaatggtcagacttcattctcaagtgaatggtcagggaacccccaaaataacagatggtaactggttttgttctgggatgttaatttgcactctaatggccctactagttgttttgatatctttagagtagaaccttaatttcctgcctacccaagggtaagcattgggtgatcattttgctgtgcgcacagaaggtgagaggcattgatttgtctgtcctacagattcttcgtttttaaaaatctcatgtctcatttctgctttactggatctcattggtttttggaggaaaggtattggttcctttctcaggtaccctccaactatattttaggctgttacttcttgggccagaatttcgccatttgtatctgctgatggctcctctctcatcctctttattgtttgcatttaatattttatttctgtaactttcttgagttatgttaatggaatctggagggaaagtgggtaacagtaaagtaagctgtttatactgtcattctgaattgtaagcccctgcagacttcttgaatgatattaatgaatgttgagtcacctttcaatatggagggacaagcctgttctttggtgtcacgtgtatcgctctttggttgtttgcttagcagcgttgaaaattgaggaggcagaggtgtatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccaccatgcctgaccatttttttttttttttaagagacaaggtcttgctctgttgcccaggctggtcttgatctcctggcctcaagtggtcctcctgcctcggcctcccaaagtgctgggattataggtgtcaaccattgtgcccagcaaaccattcctattttcccactaaaattatcataaaatcaggaatgaatgaaagctccaatcattactacaaatgaaaattgacagatataaagacagaactctgggagtaagtggtactaatgatgaggcagattgaatcagagaaatacttatacatttcaatttgtacaatgtgtatttactttgttttttgagtgatgaccaccaggaggaaaaatccttgtctgtccccattgtttgttcaaaagtcagacctggagcccctgctaaccagaaaattgagcagtcatcaacttcccctcacagtttttctgcatgtaagaatattagtaaaattagggtgatggggaagagggctgtggaaatgggaaactgataatgtacatgtagtataattgggcattattatccaaaatatggtacatatacttctagaaatagtagatattttaggttgtacgtgaatgaacgttttaaagccccaaaatttcttttaataactaacagcaatactaattagttacgaggatgctaaaataggtagtaagtacctgttttatgatgttaaaaatatcaagtaaatattatagctggttattagttttggcataacattaatgacagaaacttgagaaacatttcctctagataaaaaagcttgctagaaactggcaacagtactgctttttacacgtatcacagttgtaaatatgagaagggagtttgacttccacttgtgtgtcagacagcggggtcataaacagtaggtttggaggatctatccttgttcagtatagaagttctattatgattgatatggaaatgactttgacttattgttgaagccctgatactaaacaaatctgatttcgtttgaatctttttttccctctagaagtaaaaaaggacaattaaaaaaaaaatcctttacttaattttcagtttcttctttgaataacaaagtttggaagtatagggggttggaactgatctcttgtcacagagtttaaaggttaagactggggaattttatttgtttctaaatgaaaatgttatgatttacataaatgaaactacagtgtgaagatggacagtaaatgagatagatatttttgaagcagcaactgattttctttttgtcagactctgcagccagcctgaggccacaaataaatgtagtcagaactagtttcataaagttagatggatatgttcaataaataagagacattttccatagtattcatattttgaacatgatgaacaagatttagccaaaaaatatgtgcatattcttatgactcagggacatcacacaaaaaagaaaaaagaataaaattgaagaaattaatgtgtgtattcttttttccctggattgataagcagcttctaaaagtatgctaattcaaaggttagttttatgtattgtaaactgtagttagataaataatggttactttgaaaatccacagtaaatgctgctgatttgacaaggaaatgtgtttagttgtactctaaggatggccttctttgttggggtacaaaattagttcatttttaaagatcataaacaaaatagcagaattgagcaatgtaagtacagaaataacatttatataaaaatcaaagtgcaaaacagtatagtatatcattcatgaataagtaatatgttgtaaaactataaaaatatacaatagcgtgataaataccatattccagatagtggctctggggatgtggagagaagaatagtggtattatttcatagaaaataatctaaaagaaatatggcggctgggcacagtggctcacgcctgtaatcccagcactttgggaggctgaggcgggtggatcacctgaggtcaggagttcgagactagcctggccaacatagtgaaaccctgtctactcccagctactcaggagactgaggcaggagaatcgcttgaacccaggaagcagatgttgcagtgagccgagattgtgccactgcactccagcctgtgtgacagagtgagactccatctcaaaaaataaaaataataaaaaaagaaatatggcaaaacattaagaagtgacaaatatcagagggacatatatatattccacatttctgtatgcttgaaaacatttatgtaaatttttctaatgtgtacagtgactttttaaaagtaatatgctaaaaccaatccattgagtgaaatgacaattggattaaattataacaacaatattaatgcagacaactctattttctagttacacttatcaagagattagtattgaattatttacttgctttgcaaataagaaaatgtaaaattttaaacttttctcttatttaaagacctaagatgaccaatagacactttttctcatgtacctcaagtccttaccaagtataagaagcagaacagtatctgtatcttcgaagctctcagtgtacttctccctagtaacatctccctgcctcccctgtcctgaattttacatttcattttattgtcttaagtgccaagggcaaggtttgtcaaaatcaagtaatgttcagcctttttggtagtgaaatatacataacataaatttaccattgtaaccatttacaagtaacttagaagtatacagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctaccaaagtgttgggattacaggcgtgagccaccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatatatataattaatattttataaatattatatatatataatataaaatataattaatattttaatattaaataatattcctttatatttatatattttgttttctgttcatttgttgatggacacttgggtcattgtaccctttgactattgtaaaaaatgctgctgttaacattggtgttcatgtatctgttggagtgcctgctttcagtttcttggggcatatacttagaagtgaagttgctgaattgtatggtaattctgtgttcaactttttgaggaactatcgtgctcttttccacattgtctataccattttacaatcacagcagtgcacgaggatttcactttgtccacatccttgccaacacttttttgcttccctactggccctttttttggggaggggcgggtaatagccatcctgattggtgtgaagtggtatcttactgctagacatgttttaaaggaaaaaaggacagttctttaatgtgacttaaattgttaaaacattgtatgtgtaaatggaaaaaatacatatacactccttgtgacttaatgatcttacacagctataacagcaaaaccaatttttagtgtaagtgctaattaaaacctactaaaattaatgtttttgacagtgcaaaccaaattgtggctgtcttcctttataaataacttagtcttatgtgagagtatctatttcagttacaaattataactgcagaaactttaactggtaaaagaattcagagtatatagttaggaaagtttgctgacattaggacgtgccaaactacctatagtcaaaattaattaacaaaattaatgattaatgtgtcaaacttataaattgtcatttaggttatcatttggttggtaatatgattcaaaaaacaaactgcctaatgaaatcttgtggtcacctacatgagccacaatatacatatatttatttttaattaattgtctaagttagaacccaaaattcttttttctgaaatttaaagaagaaaaaaaaattcttttcgccacctctgataatatcgatagtccaaaattaagaaaatgctaacttctcctgatgacttcttcaacagcctatttcagcctgtgaaacatattcaggaatacatatgggagaataaatcaatgtgaatggggtagctgccataaaaataatgttcttaatttgtgtaattattttcagttttcaaagcacacttacaatatgtcgagccctcagaataattcttagctattcaggaaagatggtgttttcattttacaggcaaggaaactaaaactcatggcagttactttagaaataggagtgcaaaagaagaaataagcatggcatgtgagaataacaagagtccttatctgtagtgggttgtttttggaaagtattgagaaataagctggatccaagggactttggaatttggatttgatgtaatggagcattttccaaacttgctggtcataagaaatcccttccttggagactggggccagggtcctagaatcctttcgtaacaagtgcccctgaagattcttgtacttcagcaaagttggttaattatgcatttactatttttgagcaaggagcttggtgtcataaaaatagtgtctgggggaatatctttatctaaagggtaggttgaagggtaaagagagtcatcaggcaatgtttattttgatatgacgtagttgtggcttttattagtttgtgaccatggaaatgagatatggggaatcatggaattatagagattgcctgggaagacaaagggaaatagggaatgagtgatttgtggagagactttataggcttggacatatattgagtctttgctcataaaatgtcgtagatatttggaaatctaatttgaattccagaattagtaaaacattacacttaagtcagaccttgccaggcataaagatattgtatatttttatgtacatgctcaatatcgtatattctcaatataaaactcagttgcaggttgcatttgttgtagaaattctgctttcaggttttgtttttcctgactcttcaaatcttctcgctgggcttctgggctagatctccctataaatttgaaatagttattccttattccccaagtaagtatggaaaagagggaaagagggatagaaaggttaagattgagctgataagaagacccttgtggcggggtggggggttggtgtggggagtgggtgggaaggtagtacacagtatttaaagttaacaagagctgggtgtggtggttaatgcctgtaatcccagcactttgggaggccaaggcagagaatcacttgaggccaggaattctagaccagcctgggcaacagagtgagaccctgtctctgtttttttttttttttttccggagattaatgagtcctccctcttttgcttttatttctttaagtgaaagccacatcaggcacactgaaaacctaactctttgtttttatgtactgggcttattttttttcttgatttctttcctgaacaaaatgaaacaattctttgagatgcttgtctttgtgatgtgcacaaccacttttgctttcctgtggtggcagattcttacaggatgacccactaagtttcagtgctaataactccatttgagcttttcagttctgttttgttggtttcccctttggcaaaccctcattaccctattcaaaaaactttgggaactgtttcttccccatttgctgcagagtaacatttgtctctgaagtgtaagatttccttccagtagggagcaataattcttttttttttttttttttttttttttgagacggaatctggctctgtggcccaggctggagtgcagtggcgcaatctcggctcactgcaagctccgcctcccgggttcacgccattctccggcctcagcctcccgagtagctgggactacaggcgcgcgccactacgcctggctaattttttgtatttttagtagagacggggtttcaccgtgttagccaggatggtctcgatctcctgacctcgtgatccgcccgcctcggcctcccaaagtgctgggattccaggcgtgagccaccgcgcccggccgggagcaataattcttctattattattctcattcacatttatctttcctttttctccccttctcagccttcttgctttcttcaggaagacctcctgcaagacctcacctatagtagtttgagtttaaccctgttagctgctttcacattcaaatcaatttaatctactttaataaaaaactttaaaaatttatgtgaatgactaggtatggttctaagttttgctatgcaatagatactgtaagtcacttagtgaaagtagtttgcctttttttttcttttttcttttggagacggggttttgctatgttgtaggctggtctcaagctcctggcctcaagcagttcttctgccctagcctcccaaagtgtgagccgccatgcccagccctagtttgccattttctgttttatttattaatgtatttttatttgttgcctttgtccacatgttctaagccattttctaatagaactaaatgtgttttttttttctttttgtggttcagctattatatgtatctgctacttttagcattaacctaaagcttcctgtatatgccaagtcccaggtattttggaatcccatgtggcttttgtgccctccaaagagaggtggagagaacctcttagactccaacttttacatactcttggcccagatttggggattaagtgaagggtgcctaatgaatagaacctatgcattcgtatacatctggcttgagaaaactgtatctctctcttttttttttttttttttgagaaggagttccactcttgttgcctaggctggaatgcaatggcgagatctcgactcactgcaatctccgcttcccaggttcaagcgattctctggcctcagcctcccaagtacctcggattacaggcgcctgccaccacgcccggctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgatgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggcccggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagccgagattgtgtcactgcactccagcctgtgcgacagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaaaaatttcaagtttaatgaatgaaaactagtctcactgctccattagcacaattggtttggaaggtttgcttctgggcaaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaagaaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaatatccagctccataatggtgaagagaaggttctaaaaagcaacagtggctaatccattctaagtctcacttgatgttttaatgctactttttgatacggtcttttaaaattttatcattgtattcatgataatttgattgacagttggtaatatttaaacaatatatggttcctcttattttaccttcagctgtaatttagtataaagttcctatttcttttcaataattattatataataacaaacgtggatcttctgagaagaaaattattttagaagttttgcaaaatatttagggtttgtttgttgtcattgaaacatgagctttgaaccaaatcttcatttgtctcttagttctgtttttcatgtgaatttgagggagataataaaattttgtgagtcagttcgtctcacaacatttttctgaggattaaatgaagtgaagcagccaactagtaaatggcaaatacttggcaaaaattatttttaaaaccccaggtgttccttctgatctgtgtcttatgttagttttgatctactttattattgtcttaaagtcttttgggtgctaaaattatgtacttctctaagatattttatgaaatgttcctagattaaaaaaaaaacaatattcagttatagatggaacaagtagacaaactattgaaagaagccccaaattatttgtttaggtttcccccatttcctgctttgttgatgataatctgttgtcatgcatctgtatttctaacttcaaacattaagcaggggttctcagatcccttaaaataaataatacttttcagaaaggataaaaacacttagctatataaagtagcctgtatttatagtatagatgtcttctgggcaaattagagataaaatattctaaatatttctatggaatttttagattgtcattcagtgtattctcaaggaaaattaaatacggatttttgatggcaaagaagtcccccgtttttttccctctatgctttgctataaataagtagttggcagcttttttacaataagcttttacaaaccatttttaaaaatcaaaagctgggacctttgcaagttgatcattctgtatgggttgtgttggacttaactgagactcagaggcccaatttcaattctcatttttcttttaagtcacaggaattttttatccttggggaaatgctaactgcttattaaggacacacacacacacttttaaaggggtattgaggggaaaagacatttatggaattcattcaacaaatggctgttgaacaagtcactatgctaggttgtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcgacagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtatttaagttattgcttaaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcattccagccttggtcacagagtgacttcctgtcttttaaacaaataaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacaccatcgatcatgatttagtaatgtttaagtgtctaagattaactgtctgatttggtgttttatcattttaaaccacattctgttttggtttttgattttaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtaagttcatcagtattacaaaagctgaccaagaagtatgagagaatttgattttttaaatttcaggtctaccagtttcactttggttgttcagcctaagaagggaacagtccttccaactgttactgtattagcatatttccttgcccacaaagtcctctagtatataaagtgatttgataattatttcttggtaagtattgaaatgagaagttatggccgagtgtggtggctcatgcctgtaatcccagcactttgggaggccggggcaggcggatcacctgaggttggatcacctgaggtcaggagttcgagaccagcctggccaacatggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattccagcctaggtgagactctgtctccaaaaaaaaaaaaaaagagtggctaaggaatcagaaatcaaatgtcaaggtagccctctagtggttaaaatgagattaaggtttattgagaaactacctatttttttcatttgtattgtgctttgctatatccctgcaacttttatatcagatgcagattatattgtgacagttatcacttaaaaaatacttttagttccatttcccataacatcagaaattaatccccaaatagctagatctatcattcctttcacagaaataggtttaatgcagaaatttcccgttacttattgtaaagagcttttggtaagtgttggagtatgcctttgtaatcccaggtttcttagagcagcagtccccaacctttttggcatcagggattggtttcatggaagacagtttttccatgaactggtgcgggggtggggctggggaagtttggaatgattcaagcacattacatttattgtgcactctatttctattattattacattaaaatatataatgaaatagttatacaactcaccataatgtagaatcagtgggagccctgagcttgttttcctgcaactcaactgtcccatctgggggtgatgggagacagggcagatcatcaggcattagattctcataacgaacgctcaacctagatcccttgcatgcacagttcacagtagggttcatggccctgtgagaaatctaatgctgctgacaggagccagagctcaggtggtaatgcgagcagtgagggagcggctgtaaatacagatgaagctttgcttgctcgcctgccactcacctcctgctgtgtggccaggttcctaaaaggccatggactgatattgatctgtggctcagtggttggggacccctggtatcttagaggatctgtttttactcagagaagaacctgtagtaagttaccttgtataaattttttatttggtgaaattggatatttttaaattatcactgtggcatatattctttattaattgttaaagttaatactgctgagctgattaattccagatcattggaatacagtgttacagcacctggatatagtcacttgcatgttttctgaaatgcttacggttagcatgttgaaacatgaacagatcatttctgtcctgcaaattctaatttctttatccaacttccactcttgtttatggcaatacctttatcctagttagtcaggcttcttgatactctcttttcttccattagaatgtgctaactagcactatatacctagtactatgaacaagtgctagatatcacattctactggaagtgtctaatactgaataataagtgtttgaatgaattaaggagaattatgtggtaataattatgtgtacatcttgagattctttccactggtttggatacttacttggttgtcaacagtttgtctggcatgcctaagattactctaaaatacaatggtttacttgttttaaaaactatattgaggagctttgggtaacatagtggggtaataagcccctgtggaatggctgtcccacaccaacaaactgaaatgtggaatataataaaagttttttccaatacgtgtctaagctttaaggaaagaaaggttaacctccagataataagcagagataactcaaagccaaaacaggaacttatactctgggattttagaccacatattggttgaggagttgatgctagttttaatgtccatgcaaggacagaaagccttagaactaggtagagaggggagctagaacttagcctgtgtcaaaaaactgaactatccgtgaaaagagagacctcagtgctctagccagtgaaagctgcaaggaattttacctgtgtgcagaagactgtggataagaggggagacctatgaaaaatagaaattcacatcaaatgctaccagtgttcttaattattctgtaaactaatcttttctttttctttttttggagacagggtctcactcggttgcccaggacagagtgcagcagcacaatcatagctcactgcagcctcaaactcctgggctcagggaatccttccacctcagcctccccactacctgggactatagttgctcaccaccatacctgtctaataaaaaaacaatttttttttttttagtagagacagtgtctattttgttgcccaggctgctctcaaactcctgagctcatcctgatttggcctcatcccgatttgacctcccaaactgctgggattacaagcatgagccacggtgcccagcctgtttggtattcttccatctcatatgtagatggcgctataacataaatttgtaccatctacttggtacaggaatcccaaaccgaagaacatacatgataattgatcaggaacggaaagaaaactcccggggacattttcacagttccttggtcagtgtccagaggcaaaactgtttccaaagaagatgacctcacaattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaagagaaaagaaggaattgaaggaaaaagacaccaaagaaaaaaaagacaggcataatttaaaagcttctgaagaacttctagaaataagaacattaaaattcaaacataaatggtctaacggttaaacagcagactgaattgaattgacaggaatattaactacgaagaaatgagcaacagaacgcacaaaaaagacagaaaatatttaaagaggatgacatagtagtgagaagacccagatagatttaattatctaaaaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcggattgggaaggaatgggaattaattccaaaatgcatgctttttggacctttcgagtttctacctttgttctctatgtatatttacattgaaacagataaaacacccatagctgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaaaattagctgggcatgatggcgggcgcctgtacccatcagctcccagctacccgggaggctgaggcaagagaatcgcttgaccccggaagtggaggttgcagtgagccgagattgtgccactgcactctagcctgggtgacagagtgagactccatctcaaaaaaagaaaaagaaaaaaaatttggattaaaagttgagataaatttagatgtatttttttaaatagacatgaaattcaaatatcatacaattaacattttagaaagtacaattcagtggcacttagtacattcacaatgttttgtaagtaccacatctatcaagttactcaacattttaatcacctcagaacactctgtgcccattaagcagttactctgcatttcccttcctccagccaggcagcgtattttttctttaattgcacattatctaagttctttttctttttacaattaaaaagaaattttcagtttctgagcttcagaggcttatgccaacaggagggtttattaagtagaaagagcattagacttgcagtagaagttgtgactgctcccaccgctgcctctgaccaactgtgattttgggcaaatagctaaccttatttgggcttcagttccccatgtgtatgtaaaacaagtggttggactgcctgatctctgggaccagccattcgtggatgggatttttttattgtaaaaaacataacaaaatttaccatcttaaccatttttaagtgtatagttcagtagtgttaatacaaacacatttctgtgcaatttctagaatgcttttcatgtcacaaactctatgcccgtggaacaatttcccatttctcccaaccctcagctcctgacaactaccaactttttaccatctctatggatttatctaatcaggatatgtcctataaatagactcaaagtatgttatggatccttgtgtttggcgtctttcacttagcatggtgttttcgaggatcatcgtgattgcacgcatcagtacttcatccccttttatgactgaataacattccattgcatggaaatatcacagtttgtttatttatccattgatgaacatttgggctgtatccaccttttggctattatgagtactgctgctatgaatatttgtgcagaagtatttttttgagtacctgttttcatttcttttggctgtatactaggaatggaattgctgagtcatgtggaaatctttgtttaactttttgaggaggcatcctaccgggagtgacatgatacctcattatggattacatttgcatttccctaatgattaataatgtggaacatcttttcatatgcttattggctatttgtgtatctttggagaaatgtttattcaagttctttgctcattttttattggattgcttgtttttttgttgatttattagagttctttatatattttagaaattagacccttgtccagatccatgatatgcagatattttctcctataggttgccttttttgctccttgataatgttctatgatgtacagattgagtatagtatctcttatccgaaatgcttgggaccagaagggctttgaattttttcagatattggaactttgaattatacttaccagttaagcctcccaaatctgaactccaaaatgttcaaatgagcatttttgttgtgtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtgtatgccgtgaggtagggtctgatttcattcttttacatgttgatgtccagttatcccagcatcatttgttgaagagacttttacctattgaatggtcttggtactcttctcaaaaattatttaatcatatgtataggtttatttctggactctcaattctatttcattggcctacatgtctgttcttatgccagtaccgcattgctctgattactatagtaatttttgtaaattttgaaaattagaagtgacttctccaattttgttcttctttttcactattgtttttgacagttggggtcttcttgaaattccatgtgaatttgaggattagatttccatttctacaagaaaaggctgttggaattttgacagaaattgtgttgaatctgtagatcattttgtatagtatcaccatctttaactatattgtcttctaatccgtgaacacagggtgtctgtccatttatttatgtcttttttaatttctttcagcaatgttttgtagtttcattatacaagtctttcacatccttggttaaatttattcctagatcctttatatgctattgcaaatgaaattgttttcttaatttccttttcagattgttaattgctggtatatataaatacaactgatttttgtgtgtcagtcttgtacttttgtaactttactgaattcttgtattagctcatctgtgtgtgtgttcattctttggggtttttttttttttttttttttttaaacagatggggtttcactctgtcaccgaggctggagtgcagtggtgcagtcatagctcactacagacttgaactctaggcttaaaggatcctcccacctcagcctcctgagtagctgggactccaggtgtgtaccaccatgcctggctaatttttaaatttttcataaagatagggtctcaatatattgcttatggtagtcacaaattcctggcctcaagtgatctcccttgcctctggctcccaaagtgctgagattacaggtgtgtgccaccacacctagccattctttgggatttttatatattggatcaagtcatatgtgaatagatagttctttcagatttgaatgcctttatttctttttcttgtctaactgttttggctagagcttgaattatgattagcattgattatccttgtcatattactgattttaaggagaaagcttttggtctttcaccattgagtatatgttagctgtgagtttttcataaatgttctttatcatgttgaggaagttctctgctattcctatcctagtttcttgagtttttttttttggaaaggtgttagattttgtcaaatgctcttctgcatcaagttagataatcatgaaaccacttcgttctattagtgtgatatattatactgattaattttcttatgttgaatcacccttgcatttcatagataaatagtgtataatccttttactatgcagttgggtttggcttgccaatattttgttgagagtttttacatctacattaataacggtgttagtctatagttttcttttggtatcttcagtatcagggcaatactggcctcacagaatgatttagaaagtgtttcctccacttttgctttttggaagagtaggatttgtgttaattctcctgtaaatgtttggtagaactcatcaatgaagccatccagtcctagacttttctttggagatttcttgaaggaatgttccatgtacagttgagaatatatattcacttgttgttgggcagtgtgttctaaatatgtctgttaccttttggtggtttataatattgttcaagtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactattagcatagaatatcatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctcagctcactgcaacccccgcctcccgggttcaagcgattctcctgcctcagcctcctgagtagctgggattataggtactcaccaccacgcccagctaatttttgtatttttagtagagacagggtttcaccatgttggtcaggctggtctcaaactcctgaccttgtggtcctgcccacctcagcctcccaaagtgctgggattacaggcgtaagccaccgcccgcagccgtaatatatcacattcctagagacagtcttgtactgttttttgctccttatctccttcattactacctttttaaatgtatttatttttcttttgtagtataccattttcattcctttctcatttccttttgtgtatatatttagatattttttcagtggttaccttgaggatcacaattaacatcataaacctccaacagtctaccctgaattgataccaacttagctttaatacagcatacaaatctctgatcctatacagcctcactcctccttcccattttatgttttcattgtctcaaattttatgtttatacattgtgtacccattagcatagttttataatcattattttacatgcatttgtcttttaaatcatgtaggaaataaaaggaattataaaccaaaaatacattaatactggttttaatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccctctatggtttttgctgaaaaatcagctcataatcttattgaggatcccatggtcataagtcacttctcccttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttctttatctaggactcccattgtgtatattttgctcaacttgatggtgtcccacagatctcttagactctgctcatttctgctcctcagactgtacagtttcacttcctattttcaagtttattgcctttttcttctgtgtgttcgcatatgctgttgaaatctgttagtgaatcttcacagtatttttcagcacctcaatttctacttggttcctttttaaagtttctgtctctgttgatattctctacttcaatagaatattctttgtactcttaatatttagcagccattgttctcagcatttagtctgcaaagttttggcataggtactataattatccctatttaaccatgagttgattgtttttagtaaatatcttagtactgaagaactgattaagagctctgcttatgagagtggagcttttcagcaactgggctttgtcttcaatgtggttgggcaaaaatcagtcacaatggaagaccctgaagtgcttgatatatcagagacatctttttttttttttttttttggagatggagtctcgctctgtgttgcccagggtggagtgcagtggcgtgatctcggctaactgcaacctctgcctcccgggttcaagcgattctccaacctcagcctcccgagtagctggggctataggcacatgccaccatgcccagctagtttttatgtttttagtagacaccatgtttcgccatattggtcaggctggtcttgaactcctgacctcaggtgatccatccacctcagcctcccaaagtgctgggagtgagccagcgtcagccactgcacctggcagagacatcttttttttttttttttttgtcctatctgcactgatggtgcctaattgtcacttttctttctcaagatgtggttggttatggtgattttaattaatattcatatttttataaccacttttcattctcaccaaacttagcttctctgagtttagaaatgttccatttgtaatatggagcagattggattccttcttgtccttatactttccttataaacattgctataataatcatgtttgtacacaattcccaaagaataggttcttaaaatgaaatgtgaatcataatatatgtgtaattttcacttgaatagcaattgagacaaagatatgattccctcctgctagctgggataatcttgaaggtctttactaaaatgatagatataatttaagtagatcttaaaggataaacaggttttctgtaattagggaggtgctatgggaatagttaaaaaaaagagagagagaagtaatataaagttcatagtaggataagatacccttttgtttaaaaataggatgtttataaggaggactaacgacaaataaaatttccaatattttattataaaattctaaaaattatatagaaaaggcaaaagaaacatacagtgagcacacactcagcaccaagattctgttgttactaactttttgcatcacttgccttaccatattattaatatgtccatttattcatcctccatccatcttattcattccataataaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaaccataaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataagtaatttcatatcttatacaagtacatagataagtcattattaaatgggagtaattatagtacctattcaacaaaattggaatactaaatgcaggaaacagtgacagccaaatgttaacagtatagaaaattttagctcaacaaatagagaatatcagtaaagacatagaaattacaaaaattaaacaaattcaggaactgaaaaacaataattaatagaatatgtaagcatatcatatatatcacagtattatagattttcctttaaccaatcatgtgtgtattttaaagatactgaaaggaaaatgtagtcttttctatttaacatttttagtgctctttttttcctgaatatttccagataaaataggcattggaactcaatccccagatgtatcttttctacagtgggtagcaccagaggtctctgttcagttcttttagcatacttgggctgcttggaatctttcctacattcatgtatttcagaggtcaactagagatttgggcagagtggatacacagaatttagggctctcctttggtgcctgctttctgagatttcctcctttcctttctagatctgtgctgtccagtagaactttctgccattatggaaatgttgtataacgtacaccatccagaatggtagccatttgcctcatgtggctgttcagcacgtgaaatgtggctagtgcaactgagaaatgaaattttttattttagttaatctacatttgagtagtcacatttggctagtggcaactttattggacagaccatccttgcagaaaggtctgttagacagcactgttcttgatgctgtggtcattccaaactcagtcgccatttctgtctggggtttagcagacctgcagaatcagaacaggccctttccttaggtaaaaatgtattataaagaaggaaactcaagtagtgctttccctttttcccttccaactatgactgattttgattgctctccagagccttcaagtaatagttgttttgtatatttttgactagagtttataaatacatctgtgtctgatagaactactccactatttaacagaagcagaactctacctcttaatcatttaaatggtgacctaatgttaaggaattcatatttggtgctttgttaccataattctcttaccaatcactaattaaatatttttggctctgaaatatttagctgatatagccaacttgatctcccatttctttaagaaaaaactagttacctaatactatcattgtttagatgaaaaagcatttggaagacttatttttctgggtctcttaatagaatttttattttaaactatcatagccctgcttactaaaagtattattaacctttagtgttactgaatcttagtatgctaaatttgatattcccatctccagtcatgttagaatttaatggaattcttcaaagcaacaaactcctatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctgacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtgatccacctgccttggcctcctaaagtgttgggattacaggcgtgagccaccccgcccagccagccatcttttcattacacactgttgatacttaacattatacactatttatttaatacatacagtatgtcacttcatgaaagaaatggaatttatatttagttttactttctaaaattaaaagataaaaattaaatttttaaacatataaaatgtctgttggatatatatgtatattcaagaatattggccaagcacaatggctcatgcctgtaatcccagcactttgggaggctgaggtgggagggtcacttgaggtcaggagtttgagaccagtctggctaagatggagaaaccccatctctattaaaaatacaaaaaaaaaaaaattagccgggtgtggtggcgggtgcctgtagtcccagctactcaggaggctgaggcaggagaatcacttgaacccgggaggtggaggttgcagtgagctgagattgcgccactgcactctagcctgggcaacagagcaagactccatctccaaaataaaaaaaataaaaagaataacctcctaacattttgtgaaaataaatatgacaattcattctgaaaagttggttttatcaacttttttcttagtctcactcttcagaatttatgatctatctaaaagagtgtttctcaacctcaatactactgagatttggggttggacaattctttgttgcaaggggctgtcttgtacgttgtaagactctggggcagcattcccagcctctacccactagataccagtagcacgctccctctgtacctgccttctagttgttataaccaaaagtgtgtccagacattgctatatatggcccctagaagacaaaattgccccctgttgagaatcacttatctaaagaacaaggctgtccctttcagactttatatgttagaaactcaaagctggaaaaataatttaatgcctattttgataagctttcactctatgaagaggatatcacaatttaaaaacttgaggtcttcataaacattctatttactccctccaaaaggtgacaataacaaaagaaacccattaatttttaagtgaacttggatactgagtattactaggaaaaacacagaacaccagttatttgtacatctttcaaaaacagtgttctccttggaatattatgtaactagggttaggaatgctttcacattttcttataatacattcacaagaagaatgggaaaagtgtcatttaaagctgaatttctttttttgccttcttcacaggaaacatttctttgattgtctttggcatcctgaaatctctggcccaatagagtttttattttctttgttgattaaatgatagtgtgcatgcctgtttcttggaaatgcctaataatttgaggtatgcagacctaattttctggaagcattacaaaacctagtcttgtgggatcacacactgtgctcataaatcagtctgtatttgggttctatatttgtgtgtgtgtgtttgtctttttgcctgtaggatgtccctcactacatttcttgtgtctgtagtaggcttatttgtgtactgcaggtgggatggtaagtatgtgaagaaaagggctctggtgagtggcctttggagacaattacgttttatttcattttttaaaaaatgtattgaatatcgggtttttcactgcaaggccttcttaaaaagtgaaactaattagattgagtgttaatgccaagagtgtagctgtaaatattaaccctacagctaccatacattagtgggcacacaagtattttgatctttttaaacccatcatcttatcttacagatgtaccattatatttgctttgttccttgcatagtgtctttccttttccttctatttgttttcaatatgaattatattagtttattatcttagccaaggttttattttggcatattgtataaagaaattcaatttacacagtaaatcaataaatagatccttgaccttattccagtttcatataaaggccttgcagtggaagatcttttatgagatatttgatggaacagactgactgagaagatttccttcctcttttctccccctttccttttttctccccattccaatttcttctctctcacaggtcaacccctctgcttctcaccccggtgagtaacgtctgaagcttctgctcgcattgagtctgaatcgttcttttaatttaaggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtgtaagtcttcccctaactgattgttgaacttggggcatatctaacaaagaatcccaaggtggatgacatcaaaccatgtaaaagaggacaatagtggaaggcatactgagtgaactgttggggttgggggggtggtgttgaggtatgtgtaaggctattgctcatgatacagtgaaagataaagatcaaagaaccactagtttatcctgtacccaccttgcattcatttaaatctttattatgtttaaaaacacaccctcattacctactttttaaccccctattaattcagctaaactcctgttgtctcccaccacataggtcagagttaaaagtaatgtttttaattcaagatgctttgtcaaattaatttgttcactgacttttctctgaatgacttgagttgatttattaaatcttatatattagtacctaccatatttaaggcataaataaataccttattgtagtttaaattactcatggtagttcatgtctgctgacagagatattttctacagctgtctaattgaaacctgaaaggtagttgttatgattcattttactttatcactacatgcttcattatgctactctaaaatacattttcttacataaccatattatgcctgaaaaaattaacaatcatttctgcatcatccaataccctgaacctgttcagatattctctccattgtttcaaaaatgtccgttgacagtgttcaaaataggctccatcaaggtccacaaaatatattttattgttgtagttcttaatctagaactattgcttttactttctttttctgcatgcatgtcagagatttattgagaaaattagattatttcgaggaatgttccacattctgaattttcctcgtggtgtcatttaactagtttattcttctatatttctgtaaggagaagtttaccttaaaatggttggggtaggttaacaatgtaaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccgggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttttaatgaattaatatttttaaactttctcaggtttaccatctgccacggtaaatattaatagatgtaacacacatagtcaaaatccctctgaggtccccaataatgttaattttaagagtataaaggggtcctgagacaaaagtttgagaaccactgttcaaaagtcttgataaaatttaggctaaacattttttgcaaggatacttaatatgtggtgctgtatatgttatattgcaccgagaagctcatagtatctcattatttcatttttagtgatgtaatttaattgaattttgatatagaagatgtaattatcaattgcttatttagattttgatagctgaacagaatggaaatgtttatttttaattttttatttatttatttattttttgagacggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccttgtgatctgcccacctctgcctcccaaagtgctggaattacaggcatgagccagaaatgtttattattaaaaactgataggaaacattttgctttaggtagaccaaattttacctcttcataaaggcttgggagaaatctttggagtcaaagattaattataattatttattgctgtgaatattccttcaatatccttgttgtatatttgtatgtgattctgttgttgatggatatggagctactttggacaattagtttaatttcatatgaagtttgaggtttcatacccagtaaaaatgacagctattgtttatggagaaagtgtgtaactctcaagttacttctggctttgtaattgggatggtattttgtcagttattattattaggtgtatgtctacaagtgtctggcctgaggccttactgttaaatttattaacctcttcttaatactcacccagattctaatacacaatataattgtaatccctgaagcactgactctcaatttgggctgaatgggggcaggagaaatttttttatgccttcagatgattctgataagtaccctaatcattattctacatttatgcccttagaaagctcatctgctttgcctttcagagttctgtatcatcattcccagttcatgtctcttattattcccctttcttcccctgatgcgttgtaatttacattctctctttttttttttcctttgagcatagggtcgactgtttattgggtaatttcctcctttattttgtttaaaattgtagaaaacttaagaggtatatttgatttcttgttttttactcgctgcttccactacttccagtttataaggttcttgcttcagaatacctcttcgatgcaagccttcttcattcccattgccacaactctgatttcacatcttccttactgcacaccttgcattatattccagaagtaatttacattgtgaatttatttttttatttcacttaaacttgttgagctttcttgctatcctttcttggtataaggaacttaagataccagtttgctgatatcagagcaagtacaaattcttaatctttgctattcttcatcttcatccaagcactctattttagttaaatcagttctcttcattatctcgcacatatgccacatcctttcctgtattcctatccatttgtaaatgttatataatactgtacctccactataagcttttctgctatccagtcaatccatatacttaacggtcttcctccatgacattttatctgattggtttcactgtataatgatctttgccttttctgagctgattcttctcaattgatatgaatgataaaattttgtttattagtggttattctacttataaattcataaattcaattaatgtacttgcttattatttttattgctttatattccttaaaatattttaatctagtacatctgtataatttcatccttatctgtagcactatcctaaatacaaaataaatctcagtgccagtaaatgcaacattttctgaatccctgctatgtcccatgcccagagcttgatactaagtaaaggtgaataatcatattccctgtcttcagaaaactacctctaatatagaagattaatatgtaaacaaagaattataattacattatggtgagtattgtaatggagacaagcactaaggagagtggaggaacaatggataaccctgctatggattagggaagatttcacaaaaagagctgttgtatgaactgtcaaaaagagaaggtagaagaatggtgagaggccattctaagaagcaggaataggatttacatgaatgctgagatgccaaacaccgtagtacaatggaaggaaaggcaaattgatcaaatagagtgaagctgttgtcttggacaaatcaatttttgatccaaggacaaatcaattgctacttagtttctcctgctcccaaatcctgtctcatctcagagcagagagtttccggttggtaattaagaggcaaacttctgactgctgatatgtgtttttactgctattatattgttgtattttaatggtgaaagagactttatctgtttataggcttttggaaggagcaagaggaagagagagagaagtagaaatcatggtgggtggtggtggatagggtagagtaatatccaggattcaatgggcttgtgacatggtataatggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgtctatgaaatatgagttgtcatcttcttgggggtgtgtgtagaatgaaagatggcctttaaggatgataaaggcttaaaataacatctatgaaactttgaactgattaggaaataataattgtgaagcagcaccaggcatccagaatcttcctttttagtattgataaacactattatgtaaacaatgaatatattgtttgtacgcgtgtctatgtgtatgcaagtggaaaagggcaaatttttacctattacatacttctttcttgtgaataaccaataataggctgggcctgtaggctcacgcctgtaatcccagcactttgggaagccgaggtaggcagattgcttgagctcaggagttcaagactagcctgggcaacatgatgaaacattatctctacaaaaaatacaaaaattagttggccgtggtggtgcatagttggctgtggtgatgcatgcctgtagtcccagccactgggaggctgaggtagaaggatcgcctgagccggggaggtggaggttgcagtgagcctagattgtgccattgcactcgagcctggacaatagagtgaaagcctgtcttaaaaaaacaacaaaaaaacccacaatagcttagattgctaaagtagtcctcagttttctatattctgaattctgtgtatcagggtttgaagaatagaatagaagttattgacataaatgagttaggtttcataggagaaaagttaattttacttggtgtattttctactgaataagtttcatctgtgtatttgtgaatatttattaattataaactgtgaccaagcactatactaggtattggggatataccaagtcaaaaagttgtgcctcacctggagtttacattcagttttgttaaaaaaaaaaaaatgttgatagaagtcagtaagttggctgggcgtgatagctcacgcctgtaatcccagaactttgggaggccaagactgggggatcacttgaggtcaggagtttgagaccagcctggccaacatggtgaaaccccagtctctactaaaaatacaaaaattagctgggcatgatggcatgtgcctgtagttgcagctacttgggaggctgaggtaggagaatcacttgaacccaggagacagaaattgcagtgagctgagatagcgccattgcactccagcctgggtgacagcaagacttggtctaaaaaaaaaaaaaaattgataactctattagagtgataaggtttgtgtctagaatagatgggagataaagggtgagaagctgaactaggtttattgttacagcacagcaaattcaatcatttctttttgcccgaaatgtatgactaggtactaatacaatctgacttttttattaaaacatgtaatgaagtaattagggaggaaatataagccagtagattcaaaactgaggggaaaaataacaaaagttgtagtggatcaaagtagatttgtagatcaacatgctatatgagtgatattgctaaacagtaacaggtgtttctgttatgtgactcctgagccttaatttcctcatatgattatggtagtcataactgccaggcctactaaggttgcgaaaaacaaatctgttgaaattatataagaaagtacatttgaaaaagttgagaaatatatttgttgtatttgacatataactagattgactctgaaatgtcttctatctcaatagattcttgatgtttcagaagggtttgacttaggctttctgctacaaaagattgggaggatagtagcactaactggctttcttaagtgtaatgaggctcatatttgcacagaagttacaaaatctgtgattgtgatatattcaaggaattttatttttaaaaatgcctccaacttttcaataaaaaagtaaatagatggcaaattattctgtgtagagatgaatatctagatattaaaacttaaaagtatgattctgattacataatcaagtcataggctttcagtagtccttaaagtctgctttctatccttcagtgaatttttgaagtttgtttatagaatattttgtgcttatcatattaaatattagaagacctttggggacttgattgattctctgcatggcataacgtgccaagtcagagtattaatcagaaatattttttttttgtatgtgcatactaaaaatgtacatttaggtttttttctatcagtgttactgaatatattatatacctacccatctaaagtgtataattcactggttttagcatcttcacagtgttaaaagaaaaacttcagccaaattaaatttaaaggcgtttaattgagcaatgaacgattcgtgaattgagcagtccccagaatcacagcagattcagagagactccagggatgcctcatggtcagaacagatttatagataagaaaaagggatgtgacatacagaaaccagatgtgaggtacagaaacaactggattggttacagcttgctgtttgccttatttgaacactcagcaatgtatgagtggttgaaatacagccgtgagggctgggcgcagtggctcacgcctgtaattccagcactttgggaggctgaggcaggcagattacctgaggccaggagtttgagaccagcctggccgacatggtgaaaccccgtctctactaaaaatacaaaaattagccatgcgcggtggcgggcgcctgtaatcccagctactagggaggctgaggcaggagagtcacttgaacccgggaggcagaggttgcagtgagccgagatcacgccattgcactcctgcctgggtgacagagtgagaccctgtctaaaaaaaaaaaaaaaaaaaagaaaagaaaagaaaaaagatagaaatttggctgttgggattggccaagactcagcagttgttacgggcatactcctaagttaggttttcagtcttgtctacctgttaagttaggttgcaattagtccacacagactcaaattagaagtacaaagtccttctcgggccatatttagtttgctttaacaacaggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtagtaatattccagtgtgtgtgtgtgtgtgtgtgtgtgtgtatgtataaacacaattgtttagccatttatcgattggtagacatttggactgttcctaccattggctgttgtgaatagagctgctatgaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatctcttcatattcttgccaatccttgttgttattattattattattattttgagacagaatctcactctgtcacccagactggagtgcagtggcacaatctcggctcactgcagtttccatctcctgggctcaagtgattctcccgcctcagcctcctgagtatctgggaccatggacacacaccaccatgctggctaatttttttgtattttttgtagagacgaggttttgtcatgttgcccaggctggtctagaactcctcagatcaagcggtctgcctgctttggccttccaaagtgctgggattacaggtgtgagccactgtgccagcctgtgtcttctgttcttaaaaggacagcagtcattgggttaaggacccacactgctcctggatgacttcatcttaactaattacttaactaattttttttccaaaaaaattcatattgtaaggtactagagattggaaccacaacatatctttttgagggacacagttcaaccccataacaattcatgggttcattcagcaaatattcaagtctcttctatgttccagactgttttctagatcctagatattgaatattattgttatgtcaaacacagtccctgtctctaaagaacttaccaagggaaggggaacaaacaaataaagcaaacagttacaatacaatagaaaacacttattttagggataggtacttaatgaaagcatgtaagagtggtacctaatcaagtttggacaggttagggatatggtgttaaagaattagggaaagactaagatagtgttatatatgaagatgcatgattttgagtatcttgtcaagtttggaagtaggaaaaggacaaggcaagggataagggacaaaaggaaagcttagactttaatgtagagcactgaggggactgttttaaaagtgggtagctatcatgtatgtcaacacctacagacttaaattttagaaagattatttctgactgcagagtggagaatggatttctgaggaaagactaaatgttgaaaactcagttaaaaaggtattgaagtaatctaagggaaatgactaatagtctgaaataaggagttgtaagagagaaggccaaagtggatggattagagagattttgtttgtgaattagatttgagctaacctcatttgtttttttccacttaacatttatgaaaataaatgctcatgtacatatatatacttaagatcaaacaatatcaaacctgattgtgaggttaaatatataactttagatttggggactataaaatttataatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaattttttttttttttttttttttaagtagagatggagtttcaccatgttggccatgctgctctcgaactcctgacctcaagtgatccgcccacctcggcccccaaagtgctgggattacaggtgtgagccaccacacctggcccattctgtcgtattctaaatggagtagcaaactatgcttcttggccaaattcagcctggtgcccatttttgtacagcccatgacataagtatggtttttggttttgtttttaattttttgagagaaagtctcactctgtcaccgaggcttgagtgcagtggtacaatcatagctctctgtagccttgaacttctgggctcaagtgatcctcttgcctcagccttctgaatcgctaggactacagacatgtgccaccatgtccagcttttttttttttttgtagaggtggggtctcactatgttgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatacagcctacaatatttactattaggcccttaacaggaaaatttacttactcctgtgttaaacatatgtcaccagaactttgtaaaacatgttcccctgtagagtcctgtaagaaattactgatctacgaaagtagtggtgatgttcttctataagaatgcgttagcctctgtatttgtaaagacatgagaatcttggtgcaaacaagtagctacttaacaggtcagaaaatgtgtaggcagtcttttctctctgttaagagtagaactaaaactttaacatttttatttgccaaatgcaaactcaaaagctcagttgagaagaaaatcttcttaaatgaaagatgtctttgatagtaagtttaacagaacctggaaagactggtgtcactgtttctgtattctcagtatagtgtttaacctgttttcagttgttcagcagcttttgttttttattaaactgagacaaaaatcatatatcataaaattaaccattttaaccatttttaagtatactgttcactggtttttagtatatccacaatgttaatgcagttatcactactaattccagaaccttcccatcatccccaaaatgaagccccataccagttagcagtcatttcccattctcctctccaacccatcccctagcgaccactaatctgctttctgtctctggatttgattttcctattctaggtatttcatgtaaatggaattatacaataagtggcattttgtgtctggcttctttcacttagcaaaatgtttgcaaggtacatccatgtggtagcatgtatcagtactttttaatagttaaataatattctattgcatatatatactacattttgttctattcagcaggttttatttccctttagttctttagtttcttcctctttttctcaatgttaaactgcttgactctatagctgcctcttaatctggagagagattgagaacaatgttttagtccatttgggctgctatatcaaaaatgccataaactaggtggcatataaacaacaaccatttatttctcacagttctgaaggctggaaagcccaagatcaggtgccatcagatttggtatctagtgaggttctgttcctcatagaccggactttctcgtgtcattttcacatggtgaaagagtcaaaaagctccctccggactcatattataagggcagtaatccatttcacggttctgccctcatgacctgatctgctctcatgacctgatcacctcccaaagaccttcacctcttaatactgtctcattggacgttagatttcaacataaaaattttagggggacacaaacattcagactatagcatacatgaaggaggaaatatagagtgtcttaaaaggtattgtcctagagctaggtttattatatcgttgtttgtattcattgtgcacagcacaccgtaggcactcattaatattttgaagaataaatgattcaaagtaatgtcaaatatagtcaaaatcagacattatgtatatttgggagagttgtatttactctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaattgtaatttcccttggtgtagtccctaaaatgtttcaagacagtttttctaatgttaggagtccttttttgtcaagacccatcattgtcaatttgtaaaacttgttcctttgaatttcttgagggaaggggcttatatgcattattggaagagggagatgctcagcaactgttttcttgatcttcaggaggttacataagaaggaagagaaactgtaattgaacataagaacttggcaacattgtataatattgcagaggccttggtggtaaaggtttgagattctgtcatctgagaatttttgagaagggaccaagacagctaacagactcaagtgattttatttatttatttatttatttatttttggagacggagtctctcactgtcgcccaggttggaatgtagtggcatgatcccagctcactgcaacctctgcctcctggattcaagcaattctcctgcctcagcctcccaggtagctgggattacaggcacccgccaccatgcccaactaatttttgtatttttagttaaaacgggggttttaccgtgttagtcaggctgttctggaactcctgaggtcaagtgatccacccaccttggcctcccaaagtgctgggattacaggtgtgagcgaccacgcctggcccaggcttgagtgattagttcagcatggtatcagtaatcctttacactctttaaagttattgaggaccccaaagagcttttatttacttgtgttctatctactttaccgtattataaattaaaatagaatttgcaaaagcatttaaaaatgataaataacataagccctgtatatgttggtatcaataacatttttatgacaaataactattttccaaaacaaaatttaaaaacttattgagaagaggggcatttccacatttttgcaaatctaatgtctagtctaaaagaagattgctaaattctcatatctgcttttctgttcagtctgttacaatatgctgtttgggttgaagtatatgaagaaaatctggcctcatgcagatatgtagttgcaaaaggaaatactttatagaccacaagaaaggatattgaggaccctgaagggtctttataccacacctttgagaaccacagttttagcaaaccaaccatgcaaagtgcagtcctcagaccaacagaatcagcatctcagggtgcttgtatttagtgtaaaattttggccccattccaggcctgttaaaatctgcattttacatagtccaagggtgattcatatgtacattaaagtttgagaagtatgagctgggtcagtaatcccttaaggtctttttcagttccatgtacctttatttggttaattaaataaaaagtaggctatatagtataataccaaaatgttatttaaataaactattgttcagtcattcatgtaaacttttaagtagcattataagtaaccaatttgacttaaaaattatattattatagcatttatatgcaattttgcattttttctgcctttttggttgttgctttttaaaaattttctttattttattttatttttttttgagacggggtcttgctctgtcgcccaggctggagtgcagtggtgcgatcttggctccctgcaacctacgcctcctgggttcaagtgattctcccgcttcaacctcccaagtaactgggagggacaataggcatgggccaccacagccggctaacatgtattttctggtagagatgggggtttcaccatgttggccaggctggtctcaaactcctgacctctagcaatccaccagccccggcctcccaaagttctgggattacaggcgtgaacgaccacgccaggcctggttgttgctttttaaaaaggaaaaccggtaaatcaagctgtagaaaatgtggaataaaaaacttgaagagtaagtccattggaactgtgctagaatccttagtttctaaggatgccgcaggtggcatgcatttgtgctttatttttcctctaagctatgaaaatttagttgtgtatgctctacagtccttaattctgcactgtccattaccatacttcttgcctaggaaatactgtctagattttaccaatctccattcccatcttctggcttctagtaaagaataaaaagggctgtggtctttgttactttcctaaaagttttcttatgttttgggtgctgagataaatgtggagggtttaaataagttcttagataatataatttatataattatataagcaatcatgatgattctgtgttgaaataggccttgaaatattgtaccttctcttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacatatttagtagtgaaataaggtgtctctttttatgttaaccagtgacattcagcaaattgcattaatttaaatgtgcttcctaagtgtcacataaaatcaagctttaaatgggagaacaagctaacatttatttgtaatcttgtcgatcaccttgcaaagtgctttacatatactgttttaatcttttatatcatgataagtagataatgtcttcatttcacaggtaagaaaatagactcagagtttaagcattttgcctaaggacatgcaggagaaataatagtagtcagaaaccaaggttctgttaacatgatactaatacaaacattaacattattttcctttacctcttttttgttttgtttttaacctgttttctagaccgcaaggaaaactgagggtaaaaagtttaggagatgtgagtaacaaaagtctggtactgcagttttgagctctgagtaaaggttcattccccctatttaacagagaaaaacttattaattgtatgctatacttgtagtcttgacccagttgtcatgaaagtctatgccactgataatgagaagatccaagtaaaagtaggaatatatttagcacaactttggtgtgcttttaaaataataaaaaccgtagcaggcaatgatatcaactttttatatgaaggatagtgcgtttgaactggagcagtacacaagctttcatgtattcagagagtaacgagccttggggaatcgtgagtaagttaatttctttgatagagctagcttgatttggtagggagttcaaagaggcttgttttccaatgggatcatagggtatgttcaaattcctgtaaactaatggttcataactgtaagaatctggctgaatccagccctataacaaccaagttagaaataatggggatttttaattactttgtttgtgtaatttgactttgtcactgattccattagcttttggattgcaaggtttgaacattttgtctgggaaaaaacagaactaaagccattagggtaaaattccttttagtttttatataacagattgcaattcaccctacctttttactgaaacaagtgagactgattcctgattagatggtgtttaaaaagttgaaggaaactttgtatttatttctttagcagctagaatttgttgtgctatcagtgaaaatctattggaattagctgaactggttccttaataaattttgtttctatgtctatccagcaaatttaggttataattgtaaaagaaaagttccagtactagggggctatatcttaggaacattttgcatgattttcagaagcatttcattattctgctgtgatttaattaagattaaaggtggtagcattcccagtgttttaggtactaaataataattattaaatcattatttcagaattcctcaaaaaagctgaccttacttacctaccctgaatattgatctgtaattcacaaggcggtagactacagaataaaaacaaaggatatagaaagattgttttccatatttaaatacagcagtactgagttttctgatatactgtaaataacctaaatgctaaaggattcatatagatactttgtaattgctactttctctaatggattgtatgtatatatgatttgaggtataccctgaaagaagcataagactcagttgactgaaaaaagggggcagaataggaaaagtattcttgttggtagaagtgttcactaaagtattcagtgaacaagtaaccagtttgactgaacttactttggggagattgggtaaagatgtgggtggaagttaaattatgattttcacaccacttttaaaagcacaataacatggaccagaaataacattaaactagatgctggaaaatctggattctagtttttgttttaccattgattcggcccgtacttaactggagtataaattatatttatcttctaggtggtgaaggtggtgcagtgtatctagcagattgcctgatagctgttagactagatgagacactccatagtcaactagttgaattaatggattaattctcttttttttttttttttttttttttgagatatagtctcactctgtcgttaggctggagtgcagtggcatgatcttggctcactgcaacctccgcctcccaggtttaagtgataactcctgactcagcctcccgagtagctgggactacaggcatgtgccaacatgcccagctaatgtttgtgtttttagtagagacggggtttcaccatgttggctaggatggtctttcttgacctcctcgtgatctgcccgcttcggccctccaaagtgttgggattacaggcgtgagccaccgcgcctggctggctaatggattaattctaactttgacatagaattaacatttctgttatttgaacaaggaaggactcttaatctggtttattctagatctgtgatcctgtggtcatttagtaggtgtggagaactattaaccgtttttgagcagtgtgattatgagttaaatgataccagatgattggaaatggttaaatgtcagatgcttaaatggagtcagatggtaggagctagccacaatgtaaaacacaaattggagatgaagagaatggaaatatgaggcccatcttaaactggtctaggcttaaagagatgaggtattagaaatcagaactttgatggttacttttgtaatacaaaaacaatgacttgtgaggcagcaaagaagccagtaaaaacttttttttttttttttttttgcttggtcagagatctttggctgttggagaagagtaagaatactagtcacaaaaccatttcccagttgtttttaactttatctttgtgttaagagcccatagagaataatagtagtacttaaatattgtgggggaagaagcatccaatgatgactaaggtttcttctctggactatggaaataatgacacgattgaaagaaataggggaaatccagagaaaggcactgactttgagagaaagaggaataagtttagatatgtaaactgttatctgtgaatggtacttttgttgtaatatattgaaaactcttattttgatttatagaaaaggttgctctttatagaatctagatatttgtgcctacatcgtacctttgtctcctcaagccccccaaagccccctcagtttggtttatttgttgcctaatagagttttaaaactacccacatctttatatctgatggacctttgaggcaggacacgtggcacttgttttctagctctttcatttagccaagcatggtcctacacaggcttgctcatacagttaagttagaggtaggctgcacttttgcagcacacattgctgcatttctgagcaatacctgacatcctagactacttagtagtaacaaattgtgttgagccagagattagtggtagttgctttgagatagcttgttagaattagtagcatttctaacctttagatgtattacttccaaacagcttccaagccattatcttatgtactgttggtaattgaagccttagcattcactgtcttgatcaggattcaagcttacaaaattacaagggagagaggactttaatctgttacccattacaacaaagcaatgagcaatgctgtttctacaatctttgttaatgccctgaagaaaaactttcccttaatcactaaaattaaagtagtttttatttgggtctatgagatcttcctggcaaatggaatgtcttaattttgagacttttataggagggagaagaagaggcaaaaaatttgtaccacttgtgtacataaatactgttgatttttttttattataccttaagttttagggtacatgtgcacaacatgcaggttagttacatatgtatacatgtgccatgttggtgtgctgcacccattaactcatcatttaacattaggtatatctcctaatgctatccctcccccctacccccaccccacaacaggccccggtgtgtgatgttcctcttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggattagttccaagtctttgctattgtgaatactgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccctccaacagtgtaaaagtgttcctatttctccacatcctgtccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttttttgccattgcttttggtgttttagacatgaagtccttacccatgcctatgtcctgaatggtactgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagggaatcctttccctatttcttgtttttgtcaggtttgtcaaagatcagatggttgtagatatgtggtgttacttctgagggctctgttctgttccattggtctatatctctgttttggtaccagtaccatgctgttttggttactagccttgtagtaatactgttgatttttaaaaaatgttctgtgaaagagtagtaaagtagtctaccttaatatcactgccttttaaattaggtgaacagaggaactattatctccactttaaaaacgaatttaagggatatggtccaggtcatgcaaacatagtatgtgatggattgaactgagaacccagccccagtattgtgattccctgtccagtgttcgtttggctacatattctgagtttacactttgttcattgaactcaatcccttttttcttttaaagtacactttcaaaatgattggaggaagggagtgtttttggtaaatgggtttctagtgtacatagagttaagcatccaagaaaggttttgataggtccaggagatagaaactgtgcgcaaagtaggtggagcattgagcaagtaaaaatcccattttgcttgtctaggatctattactgttggcagagaagcagaaggaatattaacagaatagttttcctgctgttgggcatgcagttttgtccatctagaataaatctgttgttggctgagtagagcaaattcctgtctgagagttggggaagcatggctagtgttaaacaagaaactgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacacagtatatagaattcaaatgagaagtcagcctataaaatgtgcatatgtttttgtggggtttttttagttcaaataatacaacataaaatttgataaacatttgtcttatatcggactctcaatgtgctattatagagttacagttgttcatttttttgtaccccatttaaaattgtgcagaagtggcctttgtgttttgtaatgagtgtacaatagatattcaagaaatacttatatttaatgaagaaaaataagctactgtcccatgtcaaaaaacatatgacactactgcctaaagataactcttgtgaattagaaaagtaagagaaaaatatctgtagagccagtgagttgttggctctggaggagtggaatgagagggctgtatgtccttaacaaactctagttttgttctgtgtaagatagtaacccaatttatctagcttagttcttttttcttcttttatcatgaaaacatcttgttatcattactttgttctgtctggtgcttaaaatcgtgtttaagaataatctagttcacctttcaaaaattatcagttataaaaattacattgagttctcatgtcttaagaacgagaaacctatgagtacattttaaaaactgtaactttgtatttattttaaacagctttctattacatgtcccagatgacttttctgtgggtcacttttaggatcagtgaggtttcataatcattccatgtacacatttacttttaatatacaatacctgtatatgcttgcttcttaaatgattcagaatacctcagctaggtattttaataatcctggcttattgatggttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgcgcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatgatcctctggcccagcctcctgagtaggtggacctacaggcgtatgtgccgccacaccccactagttttttgtctctttggagagacagggtcttgctttgtgcccatgctggtctcaaacagctgggctcaaacgatcctcctgcctcagcctcccaaagtgctgggactacaggtttgagccaccacacctggccctagacttttaaaatgctatcaaaataatcagaagggccaattgtgttagctcatgccagtaatcccagcactttgggaggccaaggtaggaggatcggttgaacccagcagttcaagattagcctggggaacatagcaagactttgtttctccaaaaagacaaaaaattagctgggcatggtggcacacacctgtagtcccagctacttgggaggctgaggcaggaggagtttgaggctgcagtaagccacaatcccaccactgcactccagcctgggcaacagagcaagaacttatcattatcttttttttttttttttttttttgagacagaggtttgctcagtcacccaggctggagtgcagtggcactatctgggctcactgcaacctctgcctcctgggttcaagcgattctcctgcctcagcctcccaagtagctgggattacaggcacccgccatcatgcccagctaatttttgtagagacggggtttcaccatgttggccaggctgtcttgcactcctgacctcaggtgatccacctgcctcggcctcccaaagtgctgggattataggtgtgagccaccatgcctggccaagaacttatctttacaaaaagaaagtttatgcagtttttatatgtttattgtagaaaactaaaaccaaatgtaaaccagaatacagttgttcctccctgtctggggagttggttccaggaccccacactcctgtggataccaaaatttgaagatgctcaagttccagaaatataaaatgacccatagtatttacatgtaaaaattatttacaatagctaatacaccgtgagtgctatgtaagcagttgttatactgtattgtttagataataatgacagggaaaagcctgtatgtgttcagtactgtgatacagttttctcttttgaattttcaatatacagttcgttgaatccacagacgtggaaaccatgaataaggagggccaactgtgctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacaattccttgctgtgaaaagttagccctgggagtagaattctccaaaatgggtcttcggaataatacaatgagtaattgagcattatccagctttggatataactcttgtacttaaaagactttagagcttatcattttatgtatttcatttatttcatttagatccatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatccgtgtggtgacttagatgaggtcagaatagatgagatctttttctctttcaccccacctcttagacagtagcattttgttcttacatcttatgtatattttccacacattgctgttttgtttttgtttttgtttttgttttttttaaagatggagtcttgctctgtcaccaggctggagtgcagtggcttgatctcagctcactgcaacctctgcctcccgggttcaagagattctcctgcctcagcctcccgagtagctgggactacaggcatgcgccaccacgcccatctaatttttgtatttttagtagagacggggtttcaccatgttggccaggatggtctcgatctcttgacctcgtgatctgcccacctcagcctccccaaagtgctgggattacaggtgtgagccacggcgcccaacctgaaaatttatttttaaagaatttattggctgggtatggtggctcacgcctgtaatcccggcactttgggaggccgaggagggcggatcacctgaggtcaggtgttcgagaccagcctggccaacatggagaaacccccatcccatctgtactaaaaatacaaaaattagctgggcatggtggcgtatacctgtattcccggctactcaggaggctgaggcaggagaatcacgtgaacccaggaggcagaggttgtagtgagccaaggtcacaccactgcactccatactgggcaacagagcaagactccatctcgagggaaaaaaaaaataagaaagaatttatttatactttataaagattttaaactattactgtgatgactactatgtagtatcacatgtgatagtggtaatgagttttcttctgagattaattgcagagcttgtctttcgtatgggtccaatatattacttttcattgtgttttatttgtgcaagacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcgttgtcacatatggaagtaagtgaccccgctgtcactgttccatgttttcttgtgaagagctaagttgtcactacccaactgtgacactgcatggaccaactcctgcaggcaagtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacacattctacggtgtatttaatatttgtgattggtttctctatttgtgcctgtaacatttttaaaggtagggttttgttcattgtggttattcagatttgatatactggaacactgtaaaaatatggtttggtagagtttcagtaaaccagaaccaccataaacatagctacattccatgagaactgcttacttaaaacatcagcatgatttataaaactcaaaaaagagtttaatatctaacacaggaaatcttttcttagtcctttaccattgaattctaagtggtgaaataaaactttggctctttaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctgattcatcacccgtcaggcatggcgaaggtccagtgtctgtttctgaaaaacagtctatctttgccacccccttccatcctccaaaaaagaaaaaggagaccagctagtacaaatacaaattgcaaattgagcataatctaccacttgaagaatgagagctatcagatgtatcaaccgaattaaaaaattccatcttttcacctctccagtctcgttctttttataacatcgttatttagaagagcttaacttcatggtttttaagcctttattaagtaaaaatttagtttgagttttcatttttatatatgctgggtacttaaatctctttaagaactttttactataaacaaaggaatgtttgtttcaactcttttttttttttttggacacagtcttgtcacgtcgcctaggctggagtacagtggcatagtctcagcttactgcaacctctgccttccaggttcaagcaattctcctgtctcagcctcctgagtagctgggactacagacgcacatcaccgcacctggctaatttttgtatttttagtagagacagggtttcaccatattggtcaggcgggttgcagactcctgacctgaggtgaaccacccaccttggcctcccaaagtactgggattacaggtgtgagccactgggcccagcctgtttcaactcttgttggagcagtttattagatgattggcatattgaaaccattttatcttaagattgtttcacaatcagacttctgcttgcccagtacacaaattattgaacaaggaattaagagaacttactggtgtaaataaagcttgctgtggtagaaagtaccaaactagaaacaaaaatatttattttctagtttctatttcagcatttacagcttttataactgtgagcaagattctcaacctttctgggcctccatttcctaataatcaggagatgatatcaaattgggtgttggtcagacaagatcataaatatgaagatttgtgttacttataaaatgctatataaatgatcatgtggtattttgaagctttaatagagccaattgtgttagcccaccattactagtatactattactaataagatcattggatttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctctgtttggaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaagcagttgatgaagtgccgtgtgtggcatatcccattgacataaaattgtgatggccctaaaagttatctttgattagtgggattttcgtgtgtgtgtgttttttttttttttaaacttctttgtattgcttttataatgggtgttagattttatagtcctttttaaaagtaaattttttttttttttgatggagagagagacagggtcttgctctgtcaccaggctggagtgcagtggcctgataatcatagcttactgcagccttaaactcctgaactcaagcaatccttctgccttagcctgccgagaagctgggaccatagggacgtgccaccacacctgactaatttttgtatttttagtatagacagggtttcaccatgttggccaggcttgtctcgaactccttatgtcaagtgatcatcccacctcagcctcccaaagtgctgggagtacaggtgtgagccacttcgcccggccaaaagttatttttgagaaaatatgtagatatatatatacatagggatagatagatgagatagataggtagaactagtagaatgcattccgaagtcattttgaaaagtctgtaagattgagtgactcccagtttgtataagcatcattcattaagaatgacaagttatgtttctacatattggtacattagcctttgatcagttatctggatgaactctataaacagacataggaccatgaattgtttttactttgaagagagttttcctgatcaaatactagtaggaagcctttgatgtattattatttgaagtatgtctaaaagatcactcttccataaggaaacccttccccaaatttatgcttgccatagtgcccaaaatagctgattattatggaaagataactcagaatatctctactcggatttatcagaaccattcaaaagtggtagttgcctctgagaggagatcaggtatgagttacttatgtttaattgttagctgtttgtattgtctgagcttttttgcttttttggaggggaggagcagtgttaaatcttcatattcgtaccacagttgttttagcagattaagtagttgccttgtaaaagaaagttaaatcaacacaggttaatgttagtggttacgtgtgagggggagatacagtgaatagaacagagtaccttacttggtttaggaactgaggttttagttgccctattgtttcgttgtttgttataaggagtgaaggtatacctacccttcgagtttctgcaaaaatggtggtacccacccctcaagtatctacaaagatggtagggaaatgcataatgcagattttacagttcggttaaggccagtcctgagagaattctttcttcctcctcttctctactttttttacaatgccttttttttttttggcggggggtggtggtggggggtgttgttttctttcaatatactactgcttaatttacccttttattctgtaggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatgtacgtatcttgggaagtggacagataggctaatgattctcctaattggtttttttagcttcttgttattttgcactggctttttggttttgaattatgaatcctactattatacaaaatttgaaatggttgtcgtctagcttctctttattcttatatctgtgactaggagaatagaaggatggggtggtaaggaaatgtgattaggatacaaaataattttataagcttcaacatcttggaggtttcaatttgtagatttctacttttcacaatttatttaaataaaacagatttaataatgaagaatgaacaagcttggctactaaaattgaacccatcagtctggttgagctcttttagcaaagctgaatggtatatagactaaaaactaatgagaacactggttattaatttaattacttgtttaatactgagaacctcctggcctccataattaagactttgaaagctgtgtcaaatttaaggcttatagtgtttcatgctgtttcccttactcctcaggtggtaagattctgtgatagccatatggattcctcatttaaatatagaaatctactgaatatggctacaattcattttttatttagttcaaatctgtgcaaggaataactagttacccctaatataatgggtctaaatatgagaaaatgtgaacctccattttgtgatttgtctttctctctctcttttttttggcgattcatttttccttcagctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtggacattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaacttatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctcttctttaaatgaaaatctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgttttttttctggattattataactagattttgctaagactttttttttaaaattttctcttgtctatactcatcatgggggagcattaggtctctattttagaaagcaagtagaatgacatgaagatattatttgagccattaatctagctatatttattgatgctctaaaagcagacgttcttgctttttaatgacagtattctatggaggtattatgaagaattattaaatattgagaatttaaaaatttgtctaattctattcttgtctcatttcaggaatgtggcttacaataatatggacaaattataagtgaaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttttttgacagcgtctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctcccccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgctgcttttccaaataaagaatatagttaactttctgaacgagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccgagtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaattcatggttacggccgggctcagtggctcacgcctgtaatcctagcactttgggaggccgaagtgagcagatcacctgaggtcaggagttcgagaccagcctggccaacatggcgaaatgtgtctctactaaaaatacaaaaattagctgggcgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgttgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggatttttactatgcacataatttccagaagcattgttatttatttattaattataaatttagtgtaaccatttcatagggttacacagaactacccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaaatcttaagtattactttcttcctccaaacaagtttttaaaaaataggataaattttttttctataaaatataaaacatggaaaatagggaatgctgtttttgaggtaatattaataatacacagaattttcattagtgtcgaaggatctaaaaagacaaagtatatcatgggaataaaaaaagatagaaaaggaaacagtttaggaatttgccttaacaaatgaaaatgcctttttaaaatggcatcagtcaagcaagttgctgtgcattattatatgtccaaataaaatgctaattcataaaattaaggactgattctaatttttagcaactaacaatctagtgagtggtgggctttttttttttgttataagaatttgtgatatgttgcaagctaaggaacagtagacatcttaggccttgtattttcctcaacaaatttaattttagttatttatgtgtatgagcatatacacacttagcaaataaagacaatgtaatgaatgtaatagaattcaaaagtacagtcagtgtttactgtttcatatattcatttggtatattttatcaaatgtgtacatcttataaaatctacatagaagactatgcagttatatattgaagacatttggatatcctacataaagtactatgtgttgttcttcctactttcttcctatgttcttccctcatcaggagcataaacaactcccaaaatgtgcacaaattatcaattatttagtgctgtactaagacacaaaaagatccagaagcttgacagctatacatgggcatgcagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactgtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaagtattaccaaattagcattaccaaatacctttctttaattcttcagataaatttcagattgatagtattaatactttgttcctgattattgtatttctaataacaaattttattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcagtcctcctgcctcagctttccacgtagctgggactacaggtgcctgccaccacactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatgtgtcagattttacgctaagaagcatctaatgaaaacctaagaacaattacttcaagaacatttatttatttatttatttttatttattttgagacagccttgctctgttgcccaggctggagtgcagtggtgcaatcttggctcactgcaacttccatctcccaggttcaagctattctcacgcctcagccgcccgagtagctgggactacaggcgcgtgccactatgcccagctaatttttgtattacgttctacttatgcctggctaatttagtagagatggcgtttcaccatgttggccaggctggtcttgaactcctgacctcaagtgatccacccgctttggcctcccaaagtgctgggagccactgtgcccagccaaaatattttaacttttgttttggggggcttgttccagaaagttcaaggaattcaagagattagtgtcatcctgatacatccaacagtaaaactggtaattctaaaattaaatatttatagtgcatcactgatattagttaatagtaattatttgcaagggaataatgcatttttggcataattgaatacttattagctattctacataaaatttgtagccactatgtatgtaatgcaaacttcctaatgttagttccccatgtgggttttttaatcagcaaactctaaactggcttctgtttctattagtttttggttttgaaacaaagttttcggttcttaattacaaatggccctttttcagtccaacatatggtcatgtagtcattcgatactggtttaagatcaggagttgcttgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcctaacttgcttatctttggatgtagacgaacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatatatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatcccaccttagagaaccatatctcttgttttattttagtgaggaaagaaatatacttttgctaaaatttactttatttcatgcgtttcttgaacatagtaaatgaggaattgcttttttgtgtgtttttgtagggtctcgtatagtgatatactagatcttagcaaggtaccaaaaatagctgcctcctgctgaaaagctttgtgaccacaaacaaagttgtgaactttgtcagacacagtgccagctacttggaaggctgaggcaggaagatcacttgagcccaggagttcaaggctacagtgaactatgatattgccaccatactccagcctgggcaacagagcatgactcatctcaaaaaaaaaaaagcaccgaagttgtgaactacctaccctactatccataaagtctgtttgaactggtttcatgaggcaagcttgggcagagcatgatgctaaactgttaagctagaccacccctgcctggctgaagtgctgattattagtcagtgggactgcgcacagcagatcatcatgtacttctggcatatccagaggtgacacttctccccagatgctctaagatgtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttcagatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccacagctcaccatttgactactacccaattatgtccaaaaaaagggaagaaattaacatctctcccaagcaggaaagggaatatcaggaagactttaggaaaaaggaggcatttgaaatggactttgattataagttagactcagatgtagaaataaagaatattccaggccagaagataaaaaaattatactgtgagcaatgtgaaaggccctaagatagaaaaatagggtacaaaaacaaatgtgcctttagtttggtttaactagagcatagatatgtgaaggtataagttcaggaaagagttgatagagtctaaattttgatatgagcataattttgaattaaggaggatgtattgggggctgggagcatatgattaccatatgcccaaagataacatgggaattcttcctcaaatttatccgttagaaaagaggggaataaccatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataagggttacatgaataaaaacctataagagaaaggaaaaaaaaatctagttttattttaatgttatgtaaataggtgcttttcactgcacattttacctgaagatacaacttagatggaatgtgttatgttatgccagaaaactgcaggagcgttcataatttagcttcagtgaaggtaaagatgctggtgtctttacctatgtagagtttgggggagagggagcagtatttctgaattaatatatttaatatgcaatcttatttacgtgtgtaaattaatgagttagataattatagatatctcattcacattccttaaagtttaaatttgttcaagttggcaaataaaaaaggttttctggttttttagttcctttttctcaggtgggaaattaacaaatttgtcttatattcagagcacctttagaattggctacatgtggtttatcttagtttgcagaaaataaatttcatgtaattcagcagccatttctgcttctttaaaagttaaaataagaatacattatcagaggccggggcgcggtggctcacgcctgtaatcctagcactttgggaggccgaggtgcacggatcacaaggtcaggagatcaagaccatcctggctaacatggtgaaaacccgtctctactaaaaacacaaaaaattagccgggcgtggtggcaggcgcctgtagtcccagctgctcaggaggctgaggcaggagaatggcatgaacctgggaggcggaacttgcagtgagccaagatcgcgccactgcactccagcctgggcaacggagcgagactccgtgtcaaaaaaaaagaatacattatcagaaataattaaataggaataaaccaaacatgactgctgttgccattatattttagcattcttttggtgattttaattgacataaatataagaagagcaaaaatattatttgtagattatcacctaacaaaatctaagacacttatcaaggtggcaagatacataataaatgtacaaataaatagcttatctttataccagcagtaaccaattagtcgtatgggtataccagcacatacgtaaaaggctgttggttgcagcattattttaagtagcaaaaatgaaacaaccaaagtgtttatcattaggagactgatgccatttagaaattaaagtagtatgctatagaacactatgtataggaaaggcatgtttttgttttgtttattttaacaaaaaaagaaaactatgtgaaaatggccacttacgcatagaaaaaaatccatgaaggttatgcaccaaacgactaatagtggttacctctggagaataggattaggggtattttcattaactttataatatgatgtactagttaaaatttttattacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgcctcagcctcctgagtagctgggattatagatatgtgccaccacgcccggctaattttttgcaattttagtagcgatggggtttctccatgttggtcaggctggtcttgaactctggaccgcaggtgatctgcccacctcagcctcccaaagtgctgggattacaggcgtgagccaccgcgcccagcctcaagtttttatttgttagacagaaggggcagtactctaggggtcatagtcctgttttgtttggttttgtttgcttgatttattacagaatttagtattcgagtacagttatgttccatgcattaaattaggtgtataattacgcaccatgcattaaattatacttgagtccctagtacatagtagattcccaggtgtcattccctttgccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaatagggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacaggtaaacttttttttttttttttaaacaggtaaactcttaatttctgaaagggtgctaaaagggatttccatgtaacttgtcctttcatgtggatagacttctaccttttcttctaagggtaaccaacccttgaagtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttcttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttggacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatatttttatgtggcatattaacttaacactaatgtatgcagggttttgttggtttggtgtttttttttttgtttgttttttccttctttttggctaatacataaatcttgcttttggcagccttgctttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccaggtattgtgttagttagcaaaagagggcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggaggtaaatagaattactgcatgtttatatgtaaaacgtatatatgtaattggacaacaatgataaaggagaaagaaacaggctcccctggtttagaacttatttggagaccatgtcaaactaacttctgcatgactttttcttacagcagaatgaaatgccaatgtggggtccttgtttccactggctgttctgttgggaagtgagtgtgccttggagaagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaataagtagattattggggatagtgaatgataaatctattactaccgagatttgagttatcttttcgattcacagagtactcagggagtctctcaggttgctcctgcagagccagttgcagtagcacagacccaagctacccagccgaccactttggcttcctctgtagacaggtacgtaaaactagaattctccttccttgactggtaaataagacggtatgaaacgccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtcatcaaatccaaaccactcacttcataaaataaagataactatctgtgtgtgatagataattttttttttttttagacggagtctcgctctgtcgcccaggctggagtgcagtggcatgatctcttctcactgtgattgcagtgcctcctgggttcaagcgattctcctgcctcagcctcccaagtagctgggactacagacacgtgccaccacgcacggctagtttttgtatttttagtagagacagggtttcaccatattggtcaggctggtttcaaactcctgacctcaggtgactcacctgcctcagcctcccaaaccactgggattacaggcacccagccagataatttatatagtactcttctcatttcatgcccacagtctctttgacttaaatatcacatttttagaaaaatgaaaaggtagttcataaagctatgatagggccagcagttaatatcatttaaatatttcttaaggcttagatgaattgatgaatgtataggatcttataattagccaaatgatattcttacattccatatttctatgataaagcactacttatcttttagaaaaagaatagagagttttagtaagtagctcaaaggctaacgtcttctcaaagatttttcttgctaccagtttaagagacaaagtactagtgctccaaggaacagcgataacactatgcttccttagacataaagtcaagtgctaatctgcattgcttttctgaaattcagtaataaagctgaatatggtctttggagatgatgtaccttttttctttttaggtttcaaataaaggagaccgagtagtagaatgtcaattagagactcataataggaaaatggttacattcaaatttgacctagatggtgacaaccccgaggagatagcaacaattatggtacgtctgcatttggagttctaggtttttccttagtacttgatcttaatagccattgctctaggcaaatatgccatattttataatccatgtttttttaaagttatgcatttacttcaatgtgaataaaactatcacacccaacctgtgatttagtgatgtttttgtctaggctatgtctaactagatattgaagttcttaaaaagagaagagctaacttgagtacaaaataaataaaaatataggtaagtatgcagataggacagaagtcataaaagtgacataaagtttgagaaatgacactaattagactgacatcacatttcttttacaggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcaggtaggttcaccactcccatagtgaaactttgttgatttaaaatattttcatagttctaaatttgctatgcaaaatgtccagtgatatcacctgacacccatgaccgacaacaaacttttatgttctcttcacatgtggcagtttgctttgcctagtcattgagattgcatttgagaatgtatttaatcacttttgtttgttgtagaaattggaaggagagttcaaacaaccaattcctgcgtcttccatgccacagcaaataggtgaatttattttctttccttgtttttacctttgacttaagaagccattagccgagggtggtggcaggcttctgtagtcccagctactcaggaggccgaggcacgagaatcgcttgaacccaggaggcggaggttgcagtgagctgagatcgcgccactgcactccagcctgggtgagagaatgagaccgtgcctcaaaaaaagcagttgtatgtgccaataatgaagtctaacaatatttataataataatgctattaagttacgtttgtttgtttgtttttgaccaggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaactacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatggtctttgtttcagtgagaatgaagcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcagacctgcccattggttatttcttaaccagttactgttttcttttctcagaaaatcttgttttacatggcgaaagtctgatacatactgtaccaaataagtagctcaagaatatctggacactgccacttatgtacatatagcctttgttctgttctccctaggggacaactttttactgtattttactattcattttataggtatatcgtagtaacccctataataacaacattagttgtcacaccgtttttttaagacagataccagagagtaacctcagtgataaacatgtcttaactatatatattttattcttatgtttgtgcattcaaattagttgatttgctcttcagtacgcagtctttatatttagcgtctcacggacttgattttccctttgttgtctgtaggtgctgccagtgggtactgaacttccagcaggtactctacccagcgagcagctgccaccttttccaggaccttctctaacccaggtgcctcaagacttgacaaatttcttcctgtgccctactttctttgacaaagcttgctgaagttctccactacgtggtcttggcttttgcctatttgtctttgacttagtaacacctttcttttaaaatgttataaccaatgacccagttcctacttaagtaagaagcttcatagctcttttgtttgtaatgttgcttccggttatccaaaaacacttgatactaattttttttttatatcttatgaaggaagaaaacagcaaagcaaacattttgtcagacccatatagctccctttatcactcacacttctgtagaatagcgaaattgcgtatataatcaaaattaactttgagagtgccctagaaaggagaagcacaatatggcaactgagaaactttttccgcgagtccagagcaaccagtctcttcttgaatgttgatcatttctttcactagccacctaatgaaggaattagcttacttataggtaggtataggggtgatgtttcatgaaaactatgtgtgctgtctcttttaaaataaaagccaccgagctcagtgagatgctaacattatgagatcactcatggaggaactgagaccagcctcatgaacttgagattcccatctcacagtcagttctgctcacttgagtgcagtggtggacagaattacctgtaatatttattatttctctttcccaccgcagtccaccgccaacacatttgttgaatttccataagaaaagtactaattgtgaatctgttgtgaccaggaaaaatcttctgacatgagacaagccagtaaacttttaaactaaattaggaatttatttttgaatcatatataagaaataagaaaaacatggtaaattgcttacttgagaagctgagttggaatttatccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagaagaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggcaaaataatcaaagcagtacactaaatttgagtatagttttgtatgttccataaagacaaatgttatgttgtgccaatataaagcataaaacagtgtgtcctatctaaattggctatatatcgtgactctgaaggtgccacggaactgtatttactgtgattgttttcattcagtcccagcaacctctagaggatcttgatgctcaattgagaagaacacttagtccagagattatcacagtgacttctgcggttggtgtaagttttgaaaatcttgataaaatctcctcataaccctaatatattatatgcctgggacacaaactgtaacctaaaccattattaatacctttaacatgtattcagagttcctgcttattctagccaaaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcgggcggatcacaaggtcaggagatcgagaccgtcctggctaacacggtgaaaccccatctctagtaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctatgagaaaaattaagaaagcaatcaagaattaagagtagaaattcattcttttaaaatgtacctttttttttttttttttttgagacaggagtcttgcgctgttacccaggctgtagtgcagtggcacgatcttggctcactgcaaccatcacctcccaggttcaagtgattcttctacctcagcctcccgagtagctgggattacaggtgcccgccaccacacccggctaatttttgtgtttttattagaggcggggtttcgccatgttggccaggccggtctcgaactcctgacctcaaatgatctgcccaccttgacctcccaaaatgctgggattacaggtgtgagccaccatgcctggccctaaaaggtgcctttctttacatcagacttttagactttaaaagaaaaaggaaagaagataaaatgttctcagacataagtgtttcatcacatatactgtctttctgcccttttacaaagaccataggaaaggcaacgaggcaaaagtttgagtgactgaagctaaagatttgtggtgtctgtctgtgtgtgttttacagcctgtgtccatggcggctccaacagcaatcacagaagcaggaacacagcctcagaagggtggtgagaaacatccttcctccttttatattactaattccagccctacccgtagttgattcaggaggtttaccgtttcaaagacgcatttccacgtatttgataactgaggagcattggtagtaatatctaaagcttgaaagattagcaaattaataaatctgttccgttattatttgtcagaggaaaggttatacaggaggtaatgataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaagatttcagttaatcaatttaaacatttttattttcaaggcaattatattctcaattggctctcattttaaaagtgatttgcaaatcattagaatggtctagaaatggaaaaatgaaaggggaatgtagattatcaaaatatgtagagtatcaagtatgtacaatgaaaataataaagattactaccaataaaaagagaatgtagaatatgaaaaaggtagcttttcaaatcattggaagatggaatatttctttttttttgaagtggagtttgctcttgttgcccaggctggagtgcagtggcatcatctcgactcattgcaacctccacctcccaggttcaagcgattttcctgcctcagcctcccaagtatctgggattacaggcatgcaccaccacacctggataattttgtatttttagtagagacagggtttctccctgttggtcaggctggtcgcaaactcctgacctcaggtgatctgcccgcctcggcctcccagagtgctgggattacaggcgtgagccaccgcgcctggctgaaagatggaatatttttataagtggtttagaacaacttgaaagccatctggaaaaaagcaaaggtggatcactagcctagacataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggagtgtgggctgaggacccttttggggtgcctatgagggcaacactattttacagtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccacagttatgaatatcttattactattatttcagatcccacattataactaactttttttttttttgtggcttggaaatcttttttttttttaattttattattattatacttttaagttttagggtacatgtgcacaacgtgcaggtttgttacatatgtatacatgtgccatgttggtgtgctgcacccattaactcgtcatttagcattaggtatatctcctaatgccatccctcccccgtcccaaggggatttttttcaactatctagagcagggttcacaaactctttttctgtaaagggcgagatggtacaaattttaggctttctagaccatatagtctcttgcaacttactcagatctcacaagtagcaatggacaatacataaataaatgagtttgtgtttcaatagaatttatttacaaaaacaggcagtaggctgaatttggtccatggatcagtttggagttctcagataagtttaatagaggtgttaagttcaatgtctaatccagaagcaagtagtaatagatataaaattttcttcatggaagaaaagtgccaccgattgcaaatataaatgaaaaactggggaaatatatatatttgtgggagggggaggggtatgtgtagtcatatcacaaaaagaactcgttttgctaatacaaagagttcctaaaattcaacatgaaccaaaaaacaatcaaaagataacagaaaaggaaacttagacatgaaaatatttaatgtccgtaatgatagaaacacaaagtaaggctacaagtgatagcaattcccacctctcattggtaaattcaggggtctaatagccaccagtgacttggtacagcctctggggggatcagtttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcaggaggctgaggaggaaggatcacctgagcctgggaggttgagattgtggtgagctgtgatggcatcactgtactccagcctgggtgacagagtgagaccctgtctcagggaaaaaagaaaagaaattctgaataatttaaatgcccatcagtagaagcctgattaaatatgaaatatatatatggtatatacatagggtatgacactatgcaatcattaaaaagaatgaggcattgatatggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcgagaccatcctgactaagacggtgaaaccccgtctctactaaaaatacaaaaaattagtcgggtgtggtggtgggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcatttaacaatggatcttggctggacatggtgattcacacctgtaatcccagcactttgggaggctgaggcaggcatattacctgaggtcaggagttcaagaccagcctggacaacgtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcacttacttatatatctgaattaaagaatgagtaattgagtttttaaagcctgttaacctttgtttttatagtatatgttaatgttgtagttggtatctagtagtagagcaaacaataactcttttcccctgttggacagagcctcatggagggaggagataaggaagttctctttgcctctaacagctttcctcatgtgtagtttgattttgctgtatttctagctaaagggaaaagaagttaactggaaggagacacttatgttttcctcatccatgtatttgtttcagtttctcaagtcaaagaaggccctgtcctagcaactagttcaggagctggtgtttttaagatgggacgatttcaggtaagacagtcactttgtgttgccttgattccttcctttggaggagttgtctatataataaaattactgcctacctatttgggacacaattgccagtctagtgatttctgtcacatagtactttatagctctttttagcattttcctaataaaagtaatatatactaaataaaatatagaaatacttagaacagtagagacacggtagatagtcgtactatctatccacccacctcccaagattactttttggggtgtatttccttccactccttgttttctgtacaagtgtttatctaaaattaactaccatttctcctgttccaaatgttacagctttttttcccatccagtaattggtttacctaaccagtctctatcatcatttctcatttttccaacataataagttaagtaacagcaaacatctttgtgtataaaaatgttttccacgtttaaaataattgtcctaagattaattctttaaattaaaacacatgataccatatcactttattttaccaggttgtccaacatgtgagcattttctggctggggagagtaggtgatatttttctcatttgtaaacaggtcctgaacctttataggtgggctgagtttgtatttgtaaatacatggacaaaccagaacaaggatctggatcctcttttttagttaccagttagttgtgttgattcttgaggcataccaggcatttaacatttaccttgtagtttttcttattcacaggcaaccctaaaaattctacaatgccttgctaatttattttatttatttacttttattttatttttttatttttatctatttatttatttttgagacggagtctcactctgtcacccaggctggaatgcagtggcatgatctcagcccactgcagcctctgcctcccgggtttaagtgattctcctgcctcagcctcccaagtagctgggattacaggcacacgctaccatgcctggctaatttttgtatttttagtagagacagggtttcaccacgttggccaggctgatctgaaactcctgacctcaagtgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattctttttttccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtctgaatgaagaggattatggtattttgaattatgtttggttatctttcacagacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaaaaagccctggactaggtcagccacagctgtcctatcttttgtttctgtctccagctgtatgtgacctgctgaacatttgttgtttttgttaaatttcaaaggaatttggctctcctgatatttttgcttccttgactgctgtacttacatttattgtacctctttttgagtctatagaagtagacttagtgaatacaatggcttattccattgtaatccatattgctatctactggtaatctttatttatagttattcttaaggatagacatttagctttgcctgttaactcgtataactcacatttaaccaaactcttgggcagttggaagaaaatacattattctctgtttagtaaaacttgggtagattctttgttttaatggatgacttagtcataattgcaacttagatgaatgtaatcgtcatatagatatttgtgtgtatgtctaagtggtaacttcttgattaaggtttttatttcatttatattgggttaaagaacttgctagtcattggttaggcacggtggctcacgcctgtaatcccagaactttgggaggctgaggcaggcagatcacgaggtcaggagatcaagaccatcctgactaacacggtgaaaccctgtctctactaaaaataaaaaaattaggtgggcatggtggcaggcgcctatagtcccagctactcaggaggctgaggcaggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctaccttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagcaccgtgcccggccctggactatattttaattgggatagatagagagtttctaatcctttggtgaaattatggtagtgttaacacaattagttgaaaagtaaaagaaggttaaaatatgttaaaaagcagttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgttttgtttttgtttttgtttttgtttttttgaggcagagtcggcagtggctcaacctccaactcccaggttcaagcaattctcatgccccagcctcccaagtagctgggattacaagcatgtaatcccaaaccaaatgtataagaacacctggctaatttttgtatttttgtatttttagttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttcttttttttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcgaactcctgacctcaggtgatccgcccaccttggcctcccaaagtgctgggatattataggcgtgagccacaacacccagcctatctattgagtcttagtgtcattcctcacttctcccgttagtgaggactttgttcttctcatcagtttgtagcttttgacccatcattcatcactcagtggaacaaaccaaatgtataagaacagtgcctgatgagtgcatgggaagagctggacatgtttcctcatgccactttatcttttggcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagtgactagatttaaagcgaagcatatgacacgtttaactgccatttccctcacacatacccctgttatttttacctgcattagaaatggattggctccttccagcacccctattatttgtacctgtattagtaatgagttagctgtacttgagaggcagtctttactgactttccccacatgcactagtcccaggctgtttaacaaagaagcgggtggaaggcattacccaattcgatcgttttccaggcttgtgtgattttttttttgaggactcagatcaataatttttctggtcagactttcctggactgtgcatattagcactttgacagttgaataagcatttaatttgcatgtccacctagaaagttgcaaggggggtgtttttgaagtagaatgtgacatgtcaggcctatggtctacagcctgaagtgtctgagagggaagaaagagaaccaaagcttctgtttctgaaatataatgtgacaaataccactttaattaaattccataaattctcatcccacttttaaaggtaggtggtattacccctgttgttcaaatgaaagtggtcagaaatattgaatcttgtcacttccctttgggtgcaaaatgaaaggccctacatccttagaagtcacatcaggatacatcatgtaagcctggtgaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactatcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcctgctttctcttgctgggcgtttgtgtgctgtttggagattctaaatattttacactgatgtttctttatctttaacacattgcttctctctttgtgcttcagggaagatggtgaaaaaagtctgtccttgcaaccagctctgtagtaattatcttttctgttatttttggtccttgattgcaaagcctgttaaccatgagttctttcaactctgcagtctcatagctccctgattcctaacttccatctatctctgtatcctattctaataaatatttaacatgcttaattgagaaatcatctcctagtcggtgccctcagtgataaccccatgtgagcctagcttgtgacagacatggattggtaatggccatgggtatatatagggaggtcagggatgcctagttcctatgggagagcgatcctttggtcagcaaatatgtgccgggcagtgttattaccccaactggaaactcagcagtgacgaaagcatacaaaagtccatgccctcccacgttcacactgaagtgggagatgtgtgctagattgacgaggagaaaaacaccactttctagagtttgtcttcttagactgtggcttctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggagttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccaggtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaaaaaagccgggcgtggtggctcacgtctgtaatcccagcactttgggaggccaaggcgggcggatcacctgaggtcaggagttcttgagaccagcctggccaacacggcaaaaccctgtctctactaaaatacaaaaattaactgggcatggtggtgcacacctacaatcccagctactctggaggctgagacaggagaatcgcttgaacccaggaggcaggggttgcagttaggtaggatcgtaccactgcactccagcctgagtaatagagtgagactccatctcaaaaaaaaaaaaaaaggctaaagaatgtggcagtgtccaatggtttggaaacccaccttctccttatccttagccaagcatcttttcctactcctactttaaccgtgcccaatgcacaagaaaacctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttcccttcttgcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaacctcttgttggtcagctcaactttttcttcttcgtttttccttcgtcatcctcaactacacacacacagacacacacgcacatgacatccctccctctcatgaggattattttcacccttacttggtaaatataaagagccaataaatactacagaagactgttctgctgtatcttacaggattatactagaagtatatgttagcgccacacattttataccatggcccacaccagacttgacacgtggtggttttgttttcagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcattggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtcactgcttcaagattagccacagcccagcccaaaataatacgtctaaaaaaattattaaattggctgggcgcaatggctcatgcctataattctagtactttttactttgggaggccgaggtgggcagatcacttgaggtcagtttgagaccagcctggccaacatggagaaaccccgtctcctctactaaaaatacaaaaattagtcgggcgtcgtggtgggtgtctgtaatcccagctactcgggagcctgaggcaggagaattgcttgaatcctggcaggcggaggctgcaatgagtcaagatggcaccgctgcactccagcctgcgctacagagccagaccccccctctcaaaaaaaaagttgttaaactgcaaacttcattattttgggggaagaattatgaaacatctgagcactatgaaaagccaatttatggtcaaggtgggttacatctcacacctgaaatggggaagtagaaacagttgcgtttgagcatccctaattgaaatgctctgagatcagaaaatttctgagcactgacgtgatgccagaagtggaaaattccacacgtgacctcgtgtgacaagtcgcaaagcaccaggcatacaacagtttatgcagcgaccctaagagaaaaaaaaacccagccctcttcagctgcagtgtatcttcttatacaaaaactctgtttcatgcacaaaattatgtgtatgaggcatatacacgaaacacaggtgaattccacgttcagacttgggtcccatccccaaggtctcattatgtgtatacaaatattcaaaaaatgcaaaacaattctggtttcaagcatttcagataagcaatatatatatatattctattttgttaataaggtatacgatttgctttctcaaaaatgccttttctggccagacacagtggctcacaccagtaatccctgtattttgtaaggcagaggtgggagtatcacttgggcccaagaggttgtggagagagctgtgtttgcaccactgaactccagtcagggcaacacagccagaccccgtctcaaaaaaaaaaaaaaaaaaaaaacaaaaaacagccttttttcgtggtcttagatgattatttccttccttaggaaaaaatgtcagtcttgaaacaatgcaggattgtaatgtcataaatccataaattatttatattaaatgaagattgtagcctggattgatacaaagtagtgaaaagcactgctccaacctttttcctgtcgtgatccacagtgcttaatgtgggcaacattaaaggcatggaccgtaaaggaaagaaggcagacgttatgcaaaacaactgaatgtagacaattgctgaggcaggtgcttaggaccaagtctggcctatattgcttgagggcaaggagccattggtgattcctaaaatgtccatcttcattaacataatagttcagtaataaatagtgggaagcctcacaagccgaagaaaaggtattcatctgtccagagcctctccctactagagtgatggacaagcttttcaaaagtgctcagctctaactgcagtgggctctcagtcagatcctcttgataaggttcagaatgaagcaagataaatcgcaatgacgttcattctcc

SEQ ID NO: 14001 - DNA, 105055 bp, Human
tgaatcaacagtatatactaaggtgtctttaaacaaaaacatacataaaacattatgtattaagttatgtattgatccgttgattaaaatattgtgaccaaagccacacagtcacctaacactgtatctcttctaggaatgatggattaatatttgcaaattcagtgttcccagcaactttatggaacataattattgcaaaacgtgagaatcaattgtacatataacctatatcatacatattatataatcagtatcctattacaaatcggatgcttatatagataacattgatatttacatacttagatatttacatatctaaggtatctatatgagcagctacatagcaagtatctacatagcatgtatccacatatatatgctatatacataacatatacctatatctatgttatgtgtctgcttatatactttatatacataaatatgtgttatgcatatatgtatgaacaagaatacatctctaaaccttataaatattccactgttctatataaaagagtcaactgacgtaaaaagttgactcattttactggtctttaaaataggggcttaataactctgaaacttatgatttctcatatactttgacttcaaaacttcacttgtaggaatttatcctacagatatgaccacacagaaaatgacatataacatattaagaacattttctaatatgaaataattagatataagctaaatagttaacgatatagaactagttacatatattatgaacaacagaataccctgctaccataagcaaaatgaggacttttattaatataaagtatatacagaagataaaaaggtagagtgcagtaatactggtatgcttacatttatattaaaagagaaaatattatgtatttaattaaaaatgcatattaaggctgggcgcggtggttcacgcctgtaatcccagcactttgggaggccgaggcgggcggatcaggaggtcaggagatcgagaccatgctggctaacacggtgaaaccctgtctctactaaaaatacaaaaaaattagccgggcgttgtggcacgcacctgcgcctgtggtcccagctactcaggaggctgaggcaggagaatggcgtgaacctgggaggcagagcttacagtgagccgagatcacgctactgccctccagcccgggagacagagcaagactccgtctcaaaaaaaaaaaataaaaaagcataccagatttctggataaggggacaaaggttataagcagaatcttgccttttcttttcttttctttttttttttttttgcatttttcaactacatgcatgtattttctcttgaaaaataagtggataaaccctaaatacagtaagatcatgatgatggtaaggtcaagcatggccagagtctctctgagagatacttggaatatattttgctcttttaaacaaatccaaactttatctgctttttgagccttgttccataggcatctcctctatgaaactgactgaggctatcctaatcattattatttacattatttttcaacccattttgagtatccactatgtgcaagtcatcatttggcactttataaacttataaggataacgtaaacataaatttcctttcataaatcttgtaatctggatatgtagaaaatataaaaattttaatttctataatttaaaattgttgttcatacaatctagtgtgtggttttatattatttacttgtttcaaatttctctctatgaaaattatttttctaagcaaattataatctctttaggctaggagtttgtctctgtctttcctcctctgtgtccagcattgacctagtcctgtggtcaggaaatagcaggccctgaatgaatattagagaatgattgattgattgatattgagcttgtggcttttcctatttttaaattgtatattgttaaagtaaaataaattatactttttcttttttaacaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaaggtagaatgggttttatattttcaaactaaaataagttaatggaaaatttttatgtatagaaaggccactaattgtcaaaaagaacattatatctcatattacaatttttccattgaagcgtacattaaaatattaacaaaataatccctatattgatttaaatcagtttttaatctgattgaagttatttctttgctagaattttttgatgaataaaggtttatttatttttaactttttaatttttaatttttgtgggtatgtagtaggtatgtatgtttatggggtacatgagatgatttggtacaggcatgcaatgtgaaataagcaaataatgaacaatgcggcatccatttcctcaagcattttttcattgagttgcacaccatccaattatactttattttaaaaggtacagttaagtaattgactatagtcaccctgtgggctatcaaatagtaggtcttattcattctttttaactattttttgtacccataaatcatccccatcttcctacccccacacccccatgaccctttccagcctctggtaaccatccttctactcactgtgtccatgaattcaattgttttgatgtttagatcccacaaataactgagaacatgcaatgtttgtctttctgtgcctggattatttcagttaacataatgatctccagttcattttgttgcaaatgactagatttcattctttctatagctgaatagtactccattgtgtatatgtcccacttttttttacgcattcatctgctgatgcacacttacattgcttccatatcttagttattgtaaacagtgctgcaacaaacatggaagtacagataatcttagatatacgaattcgctttcttttgggtatatacccagcagtgggattgctggatcacgtggtagctcaatttttagttccttgaggaacctccagactgttcttcatagtggtcctactaatttttattgctaccaacagtgtacaaggaattccttttactccacaacctcaccagcatttgttattgcctgtctttgggatataagccattttaactgggggtgagatagcatctcattgtagtattgatttgcatttctctgatgatcactgatgttgagcacttcttcctatgcctgtgtgctatttgtatgtcttcttttgagaaatgtatattcaaatattttgcctaccttttgatcggattattagatttggtcctatagaattgtttgatctacttagacattctggtgattaattccttgacagatgggtagtttacaaatattttctcctactctgtgggttgtctcttcactttgttgattgtatccttttctatgcagaaacattttaactagatgtgatcctgtttgtcaatttttctttggttgcctgtgtttctggggtaagaaatttgctcaagaaatttttgcccagatgaacgtcctggagagtttccccaatattttattgaggtagttttatgggttgaggtctttagatttaagtctttagttcattttgatttgtttttgtatatggctagaaataggggtctagtttcatcctagcaccatttattgaagtgactgtcttttccccattgaatgttcctggcacctttgtcaagaataagctcactgtaggtgtgtggatttgtttctgggttctctattctgattcattggtctatgtgtctgtttatatgccagtaccatgctgttttggttactataactctatagtataatttttttttgagatggagtctcgctctgtcacccaggctggagtgcagtggcatgatctcggctcactgcaagctccacctgctgggttcatgccattatcctgcctcagcctcctgagtagctgggactacaggcacccgccaccacacccagctaatttttttttttatttgtagtagagatgaggtttcaccatgttagccaggatggtctcgatctcctgacctcgtgatccgcctgcctcggcctccgaaagtgctgggattacagcttgagccaccgtgcctggccactctgtagtcactcttctagagtggcagtttggggatagcaccaggagatatcagctgtgatggcttggagaaacggtgtaaaccagcagtgtaaacaagagcagggcatgtatgagtagttgagaacggtgaataggagtatgactagacagaagatagtagggatgaaaagtttttttggggcacagtctaagttggtctggtgtctggaatgagactggggcctaataaaaaggagcgtctatacaggagcttaaatgggctgtaccttgtagcattctgaggacaggtctgacttctgagaagggaaagtggtaaaagtagtgtccagtcctttttaagttggtggctgagcttggtgaggtgtgtttttaatagactattagtttgtcactggatactaagagcctaaaaaaatgcttgactgatttgactaataagggctggtcttttatcagactgtatagaggtgggaaggctaaactgaggaattatgtctgacagaagggaagaaatgactgcagtggccttctcagaccctataggaaaggcctctacctatctagtgaaagtgtctacttagacaaagaggtattttagtttttgggactcggggtatgttgagtaaagctaatttgccagtcctgggtgggggcaaatcctcgagcttgttgtgtagggaaggggcctgaataatccttgaggagtagcagatggaatagcagatggaacactaagaagttatttccttgaggatagatttctacgatggaaaggaaatgaaaggttctaagaggcgggctagtggcttgtactatagcatagcctgcctttgctggtgtgtggtgattaggcctggtggaactgccatcaataaatcaagcgtgatcagggtgagaaacagggacgaaggaaatgtggggaaatgggatgaacatcaggtggatcagagagatgcagtcatgagggtcaggtgtggtgtctggaataatgtgggaggctggattgaagtccgggccaggaacaatggtaattgtgggacttaacaaagagtgagtacagctgaaggagccagggagcagaaagtatatgcgtcaggtatgaggaagaaaatagattttggaagttatgagaaatgtagagagtgagttgagcatagtttgtgattttgagggcctctaaaagtactaaagcagcggcaccgctgcacgcggacatgagggctaggctaaaacagtaaggtcaagttgtttggacagaaaggctacagggtgcggtcctggctcttgtgtaagaattctgaccacattaaccatgcctaggaaggaaaggagttgttgttttgtaagggattgaggtttgggagattaatcggacacgatcatcagggagagcatgtgtgtttttacgagaattatgccgagataggtaacagatgaggatgaaatttgcgcttgactgaagtaatggggtctgtctgtgaagccttgtggcagtgcagcccaggtaatttgctgagcctgatgggtgtcagggtcagtccaagtgaaagcgaagagaggcttggatgactggtgcaaaagaatagtaaagaaagcatgtttgagatccagaacagaataatggattgtggagggaggtattgaggatagtagagtatatgggtttggtaccatgaggtggataggcaaaataatttggttgataaggcatagatcctgagctaacttgtaaggcttgtctggttttaggacaggtaaaatgggggaattgtaaggagagtttataggctttaaaaggccatgctgtagcaggcgagtgataacaggctttaatcctttcaaagcatgctgtaatgggatattggcactgagcggggtaagggtgattaggttttaatgagatgataaggggtgcatgatcggtcaccaaggagggagtagaggtatcttatacttgtgggttaaggtgggggaatacaagaagaggatgcaaaggaggctttggattgggaagaagggcagcaatgagatgcggctgtagtccaggaatagtcagggaagcagataatttggttaaaatatctcggcctaataagggaactgggcaggtggggataactaaaaaagagtgcataaaagagtattgtctaagttggcaccagagttggggagttttaagaggtttagaagcctggctgtcaatacccacaacagttatggaggcaagggaaacaggcccttgaaaagaaggtaatgtggagtgggtagcctccatattgattaagaaggggacggacttaccctccactgtgagagttacctaaagctcggcgtccgtgatggtctatggggcttctgaggtgatcaggcagcatcagtcttcagccgctacgccaagaaggagtcagtcagagagccttgggccagagttccaggggctctgggagtggctgccaggtgagttgaacagtccgatttccactggggtcccacacagatgggacacggcttaggaggaatcctgggctgcgggcattacttggcctggtggtcagatttctggcacttgtagcaagctcctgggggaggaggttctggaggaatgcctggccactgaggttcaggcgtttggaagttcttgtgtgctggagatgtggctggggtttgtctcacagtggaggcaaggaattgcaacttttttttttattactgtacaccttgaaagtgaggttaattaagtcctgttatggggtttgagggccagattccaatttttggagttttatttaatgtcaggagcagattgggtaataaaatgtatattgagaataagatggccttttgaccttttagggtctagggctgtaaagcatctcagggttgctgccgaatgagccatgaactgggctgggtttttatatttgatgaaaaagagcctaaacgcttctgatttgggataaagaaaaaggagcattaaccttgactatgcctttggctccagccacctttttaagagtaaattgctgggcaggtgggggaggggtagtcatggaacaaaactgtaagccggatcaggtgtgaggaggggaggcgataaaaagtttatagggtggaggagcagaggctgaggaagaattgggaactagctcggcctggcgaggaggggagaggtcagatgggtctgtagaaaaggaagattagaaagactcagcgacgcttggggttgggcctgaggggacaggcgggagggaaagaaggaagatttgggatgaattgcattgggcagagactaggaagggactgatgtgtaaaagaatgcctggacatcaggcacctcagaccatttgcccgttttacgacaagaattatttaggtcttgtaggatggaaaaattgaaagtgccgtttttctggcaatttgtaactactgtcgagtttgtactggggtcaagcggcattgcagaagaaaaaagacgcttagattttaggtcaggtgagagttgaagaggttttaagttcttaagaatacaggctaagggagaagaaggaggaatggaaggtggaagctagtccatagtgaaggaggcaagcccagagaaaagagtagagacacggagaagtgatgggggtttcttgccctccagaaaagcagagaaagggttggggcacggaaataagggattgggggttcttgccccctagaaaagcgggacttgccactaagggtgaaggagaaggggttgaggggtacttgcccctcccccagaaaagcagagaaggggtagagacatggagagaaggggttggggtacttgcccctcccccagaaaagcgggacttgccgctaagggtgaaggaccaaggcaggcatccctgcgtggtctgacacctttgaaatgtgggtgaataatcagagaggcatccctgcaatgattaaacaccaagggaaggctgccttcccagtccgtgaccggcaccggagttttgggtccacggataaaacatgtctcctttgtctctatccgaaaatgaaaggaattgaaattaagagaagggagagattgaagtgtggcgccaagattgaaaggagaaagaggttgagggatagtgaaggaagttggagaagagagtaaaaagaggccgcttaccggatttgaaattggtgagatgtttcttgggctggtcggtctgaggacctgaggtcgtaggtggatctttctcacggagcaaagagcaggaggacgggggattgatctcccaagggaggtcccccgatccgagtcacggcaccaaatttcatgtgtgtccgtgtgaagagaccaccaaacaggctttgtgtgagcaataaagctgtttatttcacctgggtgcagttgggctgagtccgaaaagagagtcagtgaagggagataagggtggggccgttttataggatttgggaaggtaaaggaaaattacagtcaaagggggttgttctctggtgggcaggggcgggggtcacaaggtgctcggtgggggagcttctgagccaggagaaggaaattcaaagggttagtcactcagttaaggtggggcaggaacaaatcacaatggtggaatgtcatcagttaaggcggggcagggcctttcacttcttttgtgattcttcagttacttcaggccatctcggcgtatacgtgcaagtcacaggggatgggatggcttggcttgggctcagagacctgacagtggcaatgtatggccacgttactgaatctacatgttgcaagagaaaaactagcaggtaagggaatggtcagttatttatttgtcttgtgctcagtaaatcggcactttacacaatataaggtgaacatagactagctacctgtggaaatatttaaccttttatctgtagctatctgcttaaggaagggcatctttttgcagaactcagcttttagcttaattttgtttcttatgtcatagtgaattggggtctcaagtttttattttcctttcatacccctgcctttttccttttaaaatcttttgaagaaagcattttagaagaaaattactccctggtcttgaattttgtctgatctcgcatggctgtgatgttttattcctagaccaatagatcccacgttattaggaatgctcatttttagcaggttgtgaaatcttatgtcctgcaaagaaaaaaataggaggaggaagagagacaaacacacagtagaaggaacaatcctggaaaactgatataggccatatcactctgaagtgtgttgtcagtaggcacatatgaaaatgtttcgtgtgtataaatcggtttctgttattttcttctgaagtttaagttgtctagtttgcatccccatggcttaagaaaatcacagcttaatatttagtaatttcaaattggacaatagggggaaaaggaaaatgaaaggaaaggagaaaagaaagaaaaaattgaaaacattatttggagacttgtagtcaggaaaaattttagactttatttcatattgtagaaaataataaaaactgataaaccttaggcaagactagaatcaaacaacaggtactataatttatagaagcataatttttctctcttcaattccccagttttattaaacagaaaatcatagtaggaccaatttattggtaaaataaattttagtacttttacacttggtttaattatttgtataaagtgcaacaagaataatcatttgccatataggagctctctctctttttgtgaattggctttgctggatctttttgcactacgaatgtaagattagacgtttgtgaatgcctgaagcctagccaaggatttatctgtgcctgcagatacatatgtgaattgggtgaattcttctctttctgaggtcttaagaaagcttggagttcctggaccagtcaaaaagtgacattctttacttaccacaggtcatgaccctgtaaaggataagatatggggctagtttttccaaggggcttctattggctctgtaggtcagcctccttttctcaaggcaatcggaaaatgtcattccagtcaaggacttagtaaaataacgagtgtctcgaattacgtcctgtgataaaagaaaatatattcttattaaacttatgcaaataattatattgccataaattgagaatactctcaaaatagttttcaaattttggagaaattaggttgagagaaaggaattatatttttaattttgctcataagaacaaattttagtgaatttactaaattcactttattaaattgttaaagctgtaaatagcttaaaaggaaagttttcttgactctgaaaaataaaaccaatcagcaaatgttttaaacaaaatcttatacaagattatttcagtcttctattagtttggtccatgcaattaactccatgttctgctcaatattggatcagcaagacttattaatacatgagctctccatgaaaggcctggacattttcctatctattccaatgatgctatatctaaatttatcaaaaacttattttttaggagtactcctcagagttcaatagcagattacaaactgtcctataaaaggattaaagtaaaacaacaattgtgaatgacaaaaatcttagaacagccatggttaaagacaccattgacaagtaaatttggtttcttctgtggcatacagcaattttccataataatcataattactactgacaacatctactaagacatattagaatcacaggaattgcatatatttttgaaacacataataataacacattcacataaatataatataatccaaagaaggttaaatgtcattgtttatttgacagtgcttcctgtgtgactttactataccaaataagtcaaatatgtctcttttggacttccggtgacctattattaataaatatatgaagtcaaagtactaattttacaatttaattttggaaagtctgtcaaatgtcagaagtttaaaatacttaatatgataatataggctcataggtcattgtaaaagaaatcattcatttagtcaaagtgataactcaaagtttttttaaaaaaggcaaaaatctttattttttgagagaggagacttaatttcccaaacaatgagccctaagagagactgcatgaggccaattaaatctgtctctcaaatcttataaacaaatctattaaattttaatcattttgaccataagctataatttccataaacctttaaataaccttttaatgtttttttaaattaaaaagtgggttaatgctataagaaccttgtttatctaacgcaggggtcctgatgctggtctttcatcaaactataatattaatgtgtaatttatatggaaactctgaactaagtttatctctcaaaattggcccttataatttcacagacgcatgtcttctgtgacagtccctgggattagaggggttcagcagttttaatttctggcactgtgtctcatgaatgcagtttattttgattatcatcttttcctgggtctgaagatgagggtttgactggtgttacggtttaagatttagcaggacttggtgtgctttttagacccagaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatgtggtggtgtgcgcctgtaatcccagctgctcagaaagctaagacaggagaattgcttggatttgggaggcagagattgcagtgagtcgagattgtggcactgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataagaataacgaattattttgataaatgtaaaatctgttagacaagttaacaaaaagaataaaaaagatcttctatattatgtttgctttttcctatgaggagtacatttaaataacatgcaatcaaaactaatgtaaaccgtacttgaattagttagatatagaaagagtgtgttccgggtgataaatgaaaattcttggtttcatagaacaattaaagccaagagcacagagggttatgttagaagaaaacattttatttagacctttaaggtaaaactttttttttataatgtcaggccacaatagcagaacctgagggaaaaaaattacagaagctattgacaaagttgaaggagaaagttattatctcaatccttctcaaagggaagagaaagctgaaagcagtgggacacaataaaagttgaacttttgggttaaaaaattaaaatctcttgtaattttattaagagtgaatcaataccttaagaaaatgttgttctaaccaattctttagtgaattaattcttttttaatatcaagtctcaatctctggaatgactattataaataatttccctttaattatagcaaacttgatcacttttttttttactcataaatcctcttcttacaaaccttattacaatttatacaaatcatgtatgatatgcttggactttctgtgttatcctaaaggtacctctttcttaaataaccagtcattttagaaaaaaaaaattaatcacacaagattctttctcatataaaattattttcccttcagcttttcttaccaaaaatacctctttatacctacaactttctgtgtatctctcttatatactagtttctttcactttgtttcataaactttagcctttgtattagacaaaaattattttcctttaaataagaacatattttttagaaaaatgtctccctatatttttttaaattggaaataacccagatagttaatgtaacataactttagattataaatggtcatcatttaaagttatttgtctgttaatcatttttatagcctgtgatttcagatgtttacctaagaaccttaaggttaaataacttttttcttgttgttgttttgccaataactcaaaagttagctgttttattaagccaacaattttcaatgcattatttttacaaaaattacacaaagatgaccatgttttgggttataagctttataaccctcatgccaaatttggacaccttataatatttagcagggataaatattaaactgcttgatcaagaaatctaaacaataatgtgaattgacaattctaaagacatttctaattttattttaccagcaattaaaacacacttatttattaaggattttcttaagtcacatgaacttgaaaaagcatttgggcttttctgtcttctgtttttctgataaagtatttgatttaaatgcttttgtaaatccaattaattacagctcctttatatatttttagtagtgaaacgtacatgacacataaatacgtagacttattagtcatgaagataaaagtagatcttaaagattcatattttagatattttagacttccaatttagatatttcagacttccaatttctttttttttctttttgagacagagtctcactccgttgcccgggctggagtgcagtggcatgatctcagttcactgcaatctgtatctcctgggttcaagcgattcttctgcctcagcctcccgagtagctgggactgcaggcacatgccaccatgccaatctaatttttgtatttttgtagagacagggtttaccatattggccaggctgctctcgaactcctgacctcatgatccgcccgccttggccttccaaagtgctgagattacaggtgtgagccacggtgcacaagctccaatttcttatgacctgtttaactagatagccctaaatttgcatactaaaggaacaactcttaggtgaaaatcagatagcaaaatttacatctcaaggtacagagagagagtggtgtgctagagggagattaaaaatggataccaagtcaaacatgaaattgtagaaatctaccttatgattgtatagaagaccaattttatttagataggtagttttaaatttagtctctatcttttaattggatctctgagctctttgcacaaagctccactgaatcctaggtctccaaaaggaaagagattcatgagactaggacatgtaatgcttttacggtgcacttggctacaaagacatttctctaagtgtctaaaccacacccttttgtatcttaaacacccatgaatagcacctgttgtaagaactattttagtaaaaaaaaaaaaaaaaggtaacacaatacaaaaacaggcattaagaactgagaaacttgtctgattgcactcttggggttccataaggaaaaacagagatttctccccaaaaaggagtctgggaggaaacctgtattttcttaaggaatcccaggctgttagaaatgattttaggtccctcacacagtggagggtggcaagaagaaggaaagacatgtagaagtaaatgaatgaaacagtcaactgagctgtttcttctcagccaactgagaagaaaaaagaactttttctcaaaaaacaagatcctaggagagaaagaaagcataaaggcacatacacacatacacacacacacacacacactcacacacacatcttggatattagcttttaattaagctgatttttaaccatggaactaaatacatccttttaaatttcattaccatattttagctgtgacaaactgctgatatttcaaaagtaacacaactatcaacccagaaaagattggatttaggaaccaaacccaggctgtcatggtgaaaaaagggcagaatcttagctactgaactacagcatggggtaactaccattgctctgtcctcttggcttggctaggaataaatggccctgttatgtacataaaagcccctcaggtaatcaatataattttttccttttgctggttgttttttaatttttctttccttttacagaggcaggaatttaatcaactcagtagcctttttccccataatttggaacttttctttggctttgaccatgttgagtagagttggtcaaacctaacgggaaaaagactgaaacaacaaaaacaaacaaacaaaaaccagttaagtcaaacaaacagacaattgtacaatttataggatcgctgagtgatctaatcgtacggagaaattaaggccagctagttgctaatcttaacttttagtaattaaggagaatttccaagacaaaaactacaattcagctactgcctaggaatggggcccaggctgaacactgctctctaccatcctagaagcagggaaaactcaaactcaccttccctgcgggaagtgggctgaaacttcagaaaggagttgttggtctccttcatcatcatggagcaggaaaactccccttctttgtttgaagcaagtgaaactccagaaaaggtgttgcacaacaaaataaatcttagatcttaaccaaattttgagagatcaggcattctctctgcagtgggagccccctgaccttggcaaaatgtgcaattggttttgttacaggaaaggggtcccaatccagaccacaagagagggttcttggatcttgctcaagaaggaattcagggcaagtccacagtgaaaagttaaagcaagtttattaagaaagtaaaggaataaaagaatagctattccatagagagagcagccccgagggctgctggttacccatttttatggttatttcttgatgatatgctaaacaaggggtggattattcatgcctcccctttgtagaccgtatagggtaacttgctgatgtggccatggcatttataaactgtcatggcgctggtgggagtgtagcagtgaggatgaccagaagtcactctgtggccatttggttttggtgggttttggccagctcctttactgcaacctgttttatcagcaaggtctttgtgacctatattttgtgctgaacttctgtctcatcctgtgacttagaatgccttaattgtcggggactgcagcccagtaggtttcagcctcattttatccagcctctattcaagatggagttgctctggttcacatgcctctgacagtgtgagcaatgaagatagctcaagcttgcacctggcgcccgtaagagccttgtgaaaggttagggccatctccactaagagtccttcccttggtcaccaatttacaaatttgtaaatcaaaaggtatgagagataggtcttaatcaatttagaagtttattttgcaaaggttaaggatgcacgggggagacaggcctgtgcctttctcaaaagattattttgagggcttcaatatttaaaggggaaaaataggttgaaggggaaggagaggtgagggtatgttcacaattctgaatccacaggttgccagagaaaaatgagcaggtaggtaaatagtcaagtatgtatgcatcttgcacttagtaaactgacactttaaacaagataaagtgaacatagagtacctactcctggagatatttaacctttatacctgtagctacctgcttaggaacaaaagaaaaagccgcttttggtgactcagcttcattttgtttcttttggcatagtaaattggggtcccaagtatttatttcctttcacagaattcacttgcaataatgttaaacaaggttccttttaactttgtccagggaacatagagtttgtttgttttctgagctatctggtaaagtctattgtgatgaaatatttgaataatatttcagcagaatggcaatcataaggaaaaagtattggctaatgcaagtgaattatcttctattgtctaagggtaatattaggcttaattatttttacttttaaatactgagtgttacagtgatttcactttcatgtgcatagcaaagtgacaacaaactggtggaagaaataagatttccagaataatcccttaaagcatatttggaatagaagctaggagttaggaagatagcagtgtatgtaaggcacattacctgcagtccaataaagaagccaggccgggcgcggtggctcacacctgtaatcccagcactttgggaggccgaggctggcagatcacgaggttaggagttcgagaccagcctggccagtatgatgaaaccctgtctctactaaaaatacacaaattatccgggcgtggtggcacgcgcctgtagttccagctacttaggaggctgaggcagaagagtcacttgtgcccgggaggcagaggttgaagtgagccgagatcccgccactccactccaggctgggtgacagagcgagacgccatatcaaaaaaaaaaaaaaaaaaaaaagccaggggaaaatgtttgaataaggttaacatcatcgaaaccattgctaaattgattaatcatatctacaagtgatgtttaaaggaatcttttcactaagttaaattgttaacattgaaagaatattaacctcaacaatcgcattacaacaattttgtaaagacttgtgtgtctgcagttgaatttagttgcatttctgtgcctactttgtattcatgaggaacaaaaatgtaatgcgataaaatttttaaattatcagtattttaattttttatgaagtttgggacatcaaactatcaacaaagtactgtttcagtaaaaataattaccaaaaatcttattaattttgaaatcttgtgaattaggagtatgcgcacatacagacagagataattaaaacaatggtaaaaatagatctaattcagcaacataaaaagagatggtgagagaaacaataatagtggctaacatttgttgagcacttactatatatgagatattgcgctagtgttttgtttgtgttaatagattttcttccttaccacagttccatcaaccagatgttattatctccctttgcagatgaaaaaaacctaggtatggaaaaggcaaatgaatttccctagttctcccagctcgtgaaagatggagccaaggtctgaattcaggcagtctgattccaaattccatgctctcaactctgtttcacattgctaaagtaactgtggacttttgtgctattagtacctttaagcggtgtggcctatttaatgatataccttattccatattattcagtatcaaacaaccatgggacttggtttacgtgcatgtgcgcacactaatacacgttgttactgagttgcatatacagactcagtggatggaaatgtataaaagcccaagtagattacaaacccatttaaataaaacgacacactttgattattttctaccattatttgattattttccctcagttttttgtattgaaccaactgtgttacacagaatctgccagtgtatacttcttcattacacttgtcttttctgctcttcaaattacctgtacccctatattgtaatgaaaatctttaacaacaaaaaagtaatgattattaaaaaaaaaatagagcaaaagaaaaagtctcccctttctgccttcattgtcactccctttctggaataatcactccacatatgtaactgccaccaagatccatatcccacaggttttattctgggtctcttttctccggccatggtggcctttttgctgtttctcaaacatgccaagcacacttctgacttggggaattttgcatttccttgttcctcttctaaaacgttcttcttccagatgtcttgtactttcatgtcattcagatctctgtttaaagatttctttactcctgaacaccccatataaaatagcattccctatccataactctttaaccagcttgattttcatagtatttatcaccagctgacactaagaccccaaaacgcacctgtgtagaagtgcgtgtttgcgcacgtgtgtttaatggcataaaacaaacaaaaaaaattatcttagagatctaaaatccagaaatcagaaataagtgtcagtgaactaaactcagggggttggcaagaccatgtttctttctgaaaattctagggacaatacacttctttgttttctccagtttctagaggctgtctgaattccttggctcatggcccttttccgtgttcaaagctagtgaagtccacgtcacatggatgcttctttcacatttaaaggagccttgtgattacaatggattcactaggccaggtcaagtcaatctctttgttttaagtcatctgtttagcaaccttaattccatgtgcaattttaatatctccttgccatgttacctaacatatttacaagttctggagattaggacctggatgtctttaagggtcattactctacctaaggttatattatatataacattacatctatatattctccatatatatgaagaatacatatatatagtttatatatgtttactatatatacacacatatatagtttgatatataaatatatacacacatatacacagatatatacatatgtttactatgtatgtatatacatatatagtttatatatgtatattgtacacatatgtttactatatatacatgaatatatacatatattgcatatatacactatatatagtatataaaatagagtatgtaaactattatatacacacaaactgtgtgtgtgcatatatacatacactttatggtatagagagagatgataaattacatgtatattacatatatttacatatgtaatttatttatgtaatatgtattacatatatgtagtttatcatctatctctctatttcataaagtgtgtgtgtatatatctatatatgcacacacacagtttgtgtttaaataagtttatatactctatatactatatatagtgtatgtatacaatatatatattcatgtatatatagtaaacatgtgtacacatacatatgtacacatatacatatataagctgtatatgtatatacatacatagtaaacatatatgtctatgtgtggatatgtgtatatgtattatatttatatatgtatttatatattatatgtgtgcatatataaaaatataaatatatataaatatatacacatatataatatataaatgcatacatagatataatacatacatacacatataaaatatatgtatttatatatcaaactatatatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctccatgaaaacataggtgtttgattcactgttctctctggcaaacatcagtgctcagtgtgtataagctgaatgactgatgcaagaggtgggtccctcagtcttgggcagctccactcctgtggctttgcagggaacaaccctcctcccagctgctttcatcagctggcattgggtatctgtggcttttccatgtgcacagtgcaatccacagtgtcagtggatctaccattctgggatctggaggatcgtagccctcttctcacagctccactaggcagtgccccagtggggacagtttgtgggagctctcgccccacatttcccttctgactgccatactgaaatttctccatgagggcttcacccttgaagcacacctctgcctgacatccaagcatttctatacatcctctgaaatctaggtggaggttcccaaacttcacttcttgacttctgtgcacctgtaagctcaacaccatgtggaagctgccaaggcatggggcttttaccttctgaagccacagtccaagctgtaccttggccccttttagccatggctggagtggctggaatgcagggcaccaagtcatgagactgcacacagcaggggggccctggaccaggctcaggaaaccatttttcccttctagacctccagacccgtgatgggcgtggctgctcccaaggtctctgatgtgccctggagtcattttccgcattgtcttggcaattaacatttgtctcctcattacttactcaaatttctgctgcctgcttgaatatccccccagaaaatgggtttttctttcctactgcattgccaggctgcaaatctttcacacttttatgttctgcttcctcttgtacactttgctgcttagaaatatcttccaccagataccctaaatcatctctctcaagttcaaagttccacagatctctagggcagaggcaaaattctgccagtctctttgctacagaataacaagaatcacatttgctctagttcccaaaaagtttctcatctttatctgataccacttcagcctggactttattgtccatatcagtatcagtgttttgataaaagccattcaacaagtctcttggaagtaccaaactttcccacatcttcctgtcttctgagccctccaattctctaggaagttcaaactttcccacattttcttgtcttcttctgagtcctccaaactgttccaacttctgcccattacccagttccaaagctgcttccccattatcaggtatcctgtagcaatgcccctcagtaccaatttactgtattattccattctcctgctgctaggaagaaacactgaagactgggtaatttataaagaaaaagaagtttaatggactcacaatttcaaatggcaagggaggcctcacaatcatggtgaaacgcagaggagcaaaggtacatcttacatggcagcaggcagaagagtgtgtacaggagaactgcactttataaaataatcagatcttgtgagacttattcactatcacaagagcagcataggaaaaacccatccccatgataaagttagctcccactgggtcccttccatgacacatggggattatgggagctacaatttaagatgagatttcagtggggacgcagccaaaacatatcactattataaatatcatcttttcaaattaagtttatgtgatagattacatgaattgattttcatacattgaaccagccatgcatacctggaataaatcccatttgatcatggtatttaattattttatgtttcgtgtattattgaatttttttactaatatttgttgaggatttttacatctatgttcatgagtgatattggtctacatttttttgttattgtaatatcttggattttagtatcagggtaatgctggcctcatggaataagatagaaagtattcctgatgcttttatcctgtgaagaaggttgtatacaattagtataacatgtttcttaaatgtttggtataattcaccagtgaaactatctgggcctcattctttctgttttttgttttgttttgtttttttgagatggagtctcgctctgttatccaggctggagtgcagtggtgctgtctcagctcactgcaacctctgcctccctggttcatgccattctcctgcctcagcctcctgagtagctgggactacaggcacccaccaccacgcctggctaattttttgtatttttactagagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatttcttaaacagataaaggcctaattcagatcatcagttttttcttgtaggagtttgagtagattgtttattttgggaaattggtcgatttaatttaggttattataattgcaggtatagttttttcatagtatttcattattatctttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaaggtagaaacttaaatactgattttaaatgtttcctcttttctcatatatgtattcagtgtaataaattttcctctaagcattgcttttgctacctcccacaaactttgatgaattgtgtttttatttttatttagtcaaaatatttaaaaacttatcttgagatttcctttgacctaaatgttacttaaaaatgtgttacttagtctctacatatttggggatttttccagttatttctgttattgattctactttaattctattgttgtctgagaacaaatgctatcacttctttttgaaaataaattggataagatatattttatggcttagaatgtggtctttcttggtgaatgttccatgtgagcttaagaatgtctattctactgttgttggatgtaatacatgaagttgtaaagtaatatatagatgttaattatatccagttgattaatggtgttattaaggtcaagtattttctatctgtttctgcctgctggatttgttcccttcccacagaggagtattgatgtctccaactatgatagtgtattcatctatttctccttgcagttctaccagtttttacttcatagaatttgatgctctgttgttgggtgcatatatgttaaggagtattatatcttttttgagaactgatgtccttattattctgtaatgccccctcccacctttttttttaaatcaatttccttttgcttttctttttttttaaattttattattattatactttaagttttagggtacatgtgcacaacatgcaggtttgttacatttgtatacctttttttaacctctggtaactttccttgctttgaagtttgctgtgtctaaaattaatatagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgcattctgagaagtgcactgtcatacaaattttttaattttgcaaacatcatagactgtacttacacaagcctagatagattagcctgctagacacctaggctatatgttatagcctattgctttgaggctacaaacctttacagcctgttattgtactaaatactgcaggaattgtaacacaataagtatttttgtatctaagcatagaaaaagtacagtaaaatatggtgttataatctaatgggaccactatcatatatgcagtccactggtaactaaaatgtcatcatgtggtacatgattgtagttgaattaatatctaccatacttcttactgtatttctgtcttgttcttctttgtttctatatttgtattccactctttttgtgctttttgtggtttcaaatgagcattttatataataccattaattttttttctcctttcttagcatatttgttatatttcttctttgacttatatagtagttgccctggtgcttgtaagatatatttacaactatttcaagtttactttcaaattacaccatactgcttcatgggtagtgtaacttgcaaaacaaattatttttattcttctctcccgtttattgcatcattgtgtcattctttttattttagtgtaagcatacataatcaaatacattatagatattattattttgaataactgttatttcttagatcaattaagaattaaaaaaaactttttaatttaccttcacttattttctgcagtgtctctctgtttttatgaagttttgagcttctgatctatattattttctctttctctaaaaaactgctcttaacatcttgcaaggcaactctgacgagaaattcctttaatttttgtttatctgagaaatccttatttttctttcatgttagaagataattgcacaggtttcataattttaggttgttgttttctatcaatgctttacatatttttattccactctttctgtgctggcatggtttctgagaagtcaaatgcaattcttatctttgttcctatataggtaaggataggtattttattttccctctggtttcttttgggacttttttccccttgtctttgattttgtgtagtttgaaaatgatattcctaggtggactctttaaagcatttattctgcttgtttttctatgaacttccaagatctgtggtatgttgtctgacataaatttggggaaattctcagttattattgtttcaaatatttattctgtttcatattctatttttggggtgtccctattatgtgcatgttgctacttttgtagttatcccttagcttttgggtattttcttctgatatttttctgtctttgttcattttgctttttacttctgcagattttaattggtatattctgaagctcatatagccttttctcaggtatgccaagtatactaatatgcttgtcaaaggaattacttatttctgctacaatattttgatctctagcatttgtttttggttctttcttagaatttttatctcggcttaaattgctcatctgttcttgcatactgtctcttttacttttatagcccttagcatgttgctcatagtcattttaaattcccagtctgataattccaacatctctgccatatgtgagtttggtcctgattcttgctctgtctcttctaattgtgttatttgccttttaggtgacttgtaatatctccttgatagcaagggaggatgtattggataaaaacctgctatacatgtgccttcaataatgtgttggtaaggcacagtccggagaagaggcatcctacagttccaagcttaggtatcagtctttgaatgaacctctgactctggaccataaatttcacaaatgcttctcaatttttttttttttttttttgagatggagtctcactctgttgcccaggctggaatgcagtggtgtgatcttagctcactacagcctctccctccctggttcaagcaattctctgcctcagcctcccagtagctgagattacaggcactcaacaccacacccagctaatttttttgtattttttagtagagacggggtttcaccatcttggccaggctggtcttgaactcctgacctcacaatccaccagcttcatcttcccaaagtgtcaatttttaaaaaaatgtttttctccctaggcaggataggatggctagagtgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatgattgctttctctttcactctgctagaatgagaagatttttctccaacatttactataagatccaggtcgagctcctgaagagaaaatcatcaaaaaaggggatccttgaattggtccccctggagttattagccctcagacttgtccaacctgaggctctagcaattcaattatagtacatttttttttcttttttaccctagcactatttcctttctggtttttgttatgagtttctgctccaggaagctgttactccttatatttactttgtctctccatctccaatcttggagacagtggtttgccacatgtcctcatctcttttatggatccaagaatcattgctttttcagtcggtttagtgttttacttgatgttagaaaaaaatggcgccctccaactttcttttctgcaaaagtagcacccagaagtcccagtatattttttaaaattgtattcacttatctcatgtcttatcagtcctaaacttgtacttaaaattccactataatttcttaattaatacacaagttatttaaaataagatttgccccaaatatgtagggattcttatttaaaaatgttttctaccattgcctgccataattgcactgtggcagatattgtctgtacgatacctactttttgcaacctgttgagttctctttttcttttcaacttttattttaggttcagggggtacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccgaatatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgtcgcccagtttcaagtgaggttcaagtgattttcctgcctcagcctcctgagtagctgggattacaggcacatgccactgtgcctggctaatttttgtatttttagtagagactgggtttcaccgtattggtcaggctggtcttgaactcctgacctcgtgatccacctgccttggcctcacaaagtgctgggattacaggcatgagccaccatgcccaaccagatgtagaattttatatgaattttatatgtatcttagaggtcagtcttgttaattgtgttattcaggtcttttatgttcttgctaatattttgactacttgacctatcataattgagaaacaaagatatgttgaaatttcctctagtgacaataattctactgacttttgtttatatattttatacctattaaatccattgttttataatcattgtatcttttaggttgatatatcaatatgtagaaacctctatccataatgatgtttatgtaaatctatttgggctattatttatacagctacaagtttttttttaattgcttcttattcttttaccatcatcaacacttcctcatgaattaggaatacctgttatcaagatcgcatatttagatttttcaaaaaatagccaaactgaaaaatctctgcctttaaactagcaattttgtccacttacgtttattgtattttatatagtcagacttgtttctactatcttagaatattatgccaatttactcccttccctgttgccttttaatgttttcttatactttttgaattgatatatttatctctcttacaacaaggcaaatactgtagcatattgctatggtctgaatatttgtactgtctctgatccaaaggtaaagacttcgagaagtgattaggtcatgaaagcagacccctcatgaatgggcttagtgtttttataaaagagaccccagagagctattttgcccttcccactgtgagattactgtaagaagatggccctcttcctgctgctgtcctgatctcagacttttcaacctctggaactgtgacaagtaaatttctgttgtttataaggtactcagttttgttgtatgctatattttgctatatttttaatagaagccccaaacatactaaaatacatgttctcatgttctttgatacgcctctttaacctttatactctctgatactatctcgattttccatctaaaattttaaattttagatattatatctattttctttccttttctatttttggtctcattttttaaaagacaattacaaaattatcaagtgttttattcaccttgttttacaaatctcacacaatatcttcagtatttgattcttgttttattgaagtatatcttccgaatttgatttcagtgtgtatctttacatgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgacgtgggtggatcacaagatcaggagattgagaccatcctggctaacatggtgaaaccccgtctctactaaaaatacaaaaaaattagctgggtgtggtggtgggcacctatagtcccagctactcaggaggctgaggcaggagaatggcatgaaccctggaggcggagcttgcagtgagctgagattgtgtcactgcactccagcctgggcaacagagtgagactctgtctcaaaaaaaaaaaaaagtactattaatcttttgtacatccacacttactgtttaaaattgatatgctttcttttctgaaagacttcaaatttttttcttgtcattgatattcttatctaaactttctccatatatatgtgtgtccctatgtcttttgctgggtgttcaacaggcactctcaatctgaggttttcacatttttgttgaatattggaaaatgtgcatttattttattttttaaattttctcctcttcaacttattatactccttttaaggaattcattattaagttattgttaattttaattaaaatctttgtacactttaaacatatatatatagtatataagttgtgtgtatatatatgtgtgtgtgtgtatatatacaccttaaactttgtataccttaaacttaaagatatttatatatacataagtgtaagttatataaagataccttacatatatatatgtatgtatttccaaatttttaaataaaatttctggccaggcgcagtggctcctccgtgtaatcccagcactttggaaggctgaggtgggcgaatcacttgaggttgggagttcaggaccagcctggccaaggttgtgaaaccccctctctactaaaatacaaaaattagccaggcatggtggcatatacccctgtagtaccagttacttgggaagctgagacaggaggatcacttgaacctacgaggcagtggttgcagtgagccgagatcacaccattgcactccagcctggttgacagagcaagcatctgtctcaaagaaaaaaaaaattccatcttgcattaattgataacccccaaatcattcaggagcagattgtttattttccatgtatttgtgtagttttaggagttccttctggagttgatttctagttttattccactatggtctgaaaaaaatagttgatatgatttcaattaaaaaaaattattcggccaggtgtggtagctcatgcctgtaatcccagcactttgggaggccaaggtgggcgaatcatctgaggccaggaattcaagaccagcctggccaacatggtgaaaccacatctctattaaaaatacaaaaattagccaggtgtggtggtgcatgcctgtaatctcagctactcgggaggctgaggcaggagaattgcttgaacccgggaggcagaagttgcagtgagccaagattgtgtcactgcactccagtccatgtgacagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtatgattctaccagctttctgacctctgacctcttggaaagagcagccccagttagtgaaaaggtttgaccctgatcaacaatgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaactcaccccagcaacacagggcaaggatatagatgcttcagtttgttcttttgtgttaaatgtttacaaggacctcagaactaaagcctgttctctggaggaaataaagaaaatatgtttggaggtgcctgaatatgaaaaaaaaaattgagatttgttttgtgatgtatcatatgatctatatttgagaatgttccatgtgttgatgacaagaatgtatattctgcagttcttgggtagaatgttctgtaatatctgttaggctcatttgttctagagtgtagtttaagtacattgtttttgttgactttctctctagatcatctgtctagtgcggtcagtgaagtttttaagttctccactataattgtgttgctgtctactgatttcttaggtctagtagtaattgttttatgaatctgggagctccattgttaggtgcataaaaatttaatctttttttgttggattgatttcttctatcattatataatcatcttccttgtcttttttttttttaactgttgttccattctgtggaaatcgaaatcaaaaagtgagcaggagctattcttacatcagataaaacagactttaaagcaacaacagttacacatatttatttcacatattccaattttttttcattttcatagcttacttcctttggtaacattcactatattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattcttccaaagagtgttattctttagttagttagttagtttctttgttttataaggtatttaacttcgttgacttggaattgcaaactatgtgttggtgttttaatcagctcaggtgctaaaacaaaaaccatcaacatatatatttgaaggatatgcaaacattcagtccttaacagatggtaataaaaacaatgacaatgagtgagtttgcccagaaaaagtatatgaagtaaaaagaggagagtgtctgaaacaaatccctggaagaacaggggataaccagaataacataatccatggatacttgtgaggaatgatgcaaaaaacaggatttgagtcatgcaggtgtagtcaactctaagcttctactggaaaggacacaaaggagagttatgggaaagagaaggttcagtggggcaggggagttattttttaaaataaaataaactgtagaagcttagaactgtcttctgactgtaagtccagaaattttaccgtattacactaatgaacagcttgccgtgactgcaggtagatagagactttacctcttatctcgatgccagttgtctcttcctgccagtgacacattaaaatctctctgacaattatgtacatttgtatctctgttttgtttttatttgaatgaacttaaagcagagagctggaggttggtagttcacaattttaataaaaatagaaatttatcaagcttactgtgaagctagcacttcatgttcctggaggtatttagaaagcctcgcatatgcccagggtagtagactcacttgtaaaacacctgagaagaccataagcttttacctaaggctgatcctcaggctcagcccaaggcttaccaaaggcggaagaattaaaaaaaaaatagctaaaataaaaatttataagaaaagagttatggactgaatatttgtgccttccttgccaattacatattgaaaccctgagcccaaggtgttggtatttgaggcctttggcaggtaaatagatcatgagagaggaacccttcatgatgggatttgtgcccttagataatgtgagaaagccaactaaatttttccctccctgtgagggtacgagtagaagctagctgtcttcaacctaaaagagggccttcaccagaattcaactgtgttggccccttgatctcagacaacccagctttcagaattatgaaatatacatgtttatttctcaacccatttagtctatagtatttattatagcagcctgaactaaaaccaaagttcagtggcaaccttaagcaggcagaatacagaatcatcgaattttaagataggccaattgaaaatttcagtctgagaagcagaaaatatatatatatatatatgaagaaaagtgaacaaaacctaaggacctgtcatataccatcaggtgaaccaggatacaaattacagggatttcagaaggagaatagagagagaaaagggaaaaaagaatatttgaaaaatgggctggctgagaacaccacaaatttgatgaaagacataaatctcaatagcctagaagcttaaggaactccaagtaaaaaaactgaaagaaattcactttgagatattttgtaatcaaaccattaaaagtcaaaataataataataatacagaatcttggaagcagctagaatgggaatcatcatgtacaagtgctgtcccataggattaataactaatttcttgtcagaaactatggagactagtgaatgatatatttaataaggggctgatattcaaaatctacaaagaacacttaaaactcaatgataagaaaacagccaattataaaatgggaaaaagatctgaacagataccttactgatgggcatatacagatggtaaacaactatatgaaaacatgttcaacataatatgtcaatagtgaattgccaattcaaacaatgagctttcattacatacttattagagtgagtaacattccaaacacaaaaaatgccaaatgctggcaaatatgaggagcaaccagaattctcatttattgctggtaggaatgcaaaatggtagagccactttgtaaaacaatctgatagtttcttatgaatctaaagacaggcttactgtacaatcctgcagtcatagaccttagtatttacccaaatgacttgaaaacttatatccacataaaagcctgcacacaagtgttatagcagctttattcatgattgtcatgacttaaaagcaaccaagatatctttcaataggtgaataggtaaacaaactgtgatacagtcaaacagtgtaattttttttagtgattaaaaagaaatggaacatcaagtcataaaaatacatggaaagacatccaaaacataactgtaagcaaagaagcaaatcttaaaatgttatatattgtaagatttcaaatatatgagattctggagaagaaaaatctaaagaaaggaatgtgttcagtagttgccaagtgtttgaggaagagaggaagaaagaaagaaacagtgcagaggatttttaggtaagggagactattctttatgatacagtaatgaagaagacctatcaatatatatttatcagaatcgatagactgtaaaacacaccaagtgaaccctaatgtaataatgcatccaaattggttcatcagtgtaaacaaatgtaccacaccaatagaaggtaaacataatagtaggggaaactgtgtgtggatagagggaatatgtggaagctctctgtaatttatggtcaaattttttttttgtgaatctaaattgctctaaaaaataaagtctattaagtatattaaaaaatttttcaagaaaatactagccaattaattccaacagcacatttaaaagattgtacaccataacaaaaatggattcatcctggaaatttaagcatgattaaatacatgaaactcaaaggaatgcaatatattaagcaaagaaaaaagccacatgaccatcttactagatgcatttgacacaaatccaacaccctttctcaacacaaacacccagaaaactagtaatataagggacctctctcaacatgataagggcatttatgaaaaatcttcagctggcatcatatttgatattgaaagactgaaagttttgtccctgtaattaaaaacaatacaagaatattcatttttactaatgctattcaagattgttctagaagttctagccagatccattagacaagaaaaagaaacaaaaggcattcaaattagaaagaaggaaaactgtctttatttacagataacataattatatgtaaagagaagcccaaagaatccacaagaaatctactagagctaataaataattaaagaaaaattacatagtagaaaatcacacacacacacacacacacacacacacacacatattacttgtgtttctgtacaccaggaataagcattgaaaaataattaaaggagtaaatccatttatcatagcatctcaaaaatatatataggaacaaatttaaacaaaaaggttaaaaaaaatcacacactgtaaactataaaacattgcttaaaaaattaaagacccacataaatggaaaaacatccagtgtttatagattataaaatttagtatttttgaaatgacagtgctacccagatttctctgcagatttaccgcacattctatctaaatcccaacagcctttttttttttttttttcttgcagacatggaaaaatccatactgaaagtcatatgaaatggcaagggtccccaaataaacaaaataatattgaaaaaataacaaagttggaaaaaaatttttaaaacttttattttaacttcaggggtacatgtaccagttagttatataggtaaattgtgtgttgcagatgtttgatgtacagattatttttattattattattttatttatttatttatttatttatttatttatttatttttgagacagagtctcgctctgtcgccaaggctggagtgccatggcgcattctcggctcactgcaagctctgcctcccgggatcacgccattctcctgcctcagcctcctgagtagctgggactgcaggcacccaccaccactcccggctaatttttttttgtattcttagtagagatgaggtttcaccgcattagccaggatggtctcgatctcctgacctcgtgatccacccgcctcggcctcccaaagcgctgggaatataggcgtaagccaccatgcccggccgatgtacagattattttatcagccaagtaataaacatagtacttgataggtagtttttctattcgctgtattctcctaacttccaccctcaggtagccacaatgtctattgttcccttctttgtatccatatgtacttaattttttgttcacacttataagtgagaacgtgcaatatttgattttctgttcctgtgttagtttgcttaggataatggccaccagcttcatccatgttgctggaatacaattgctgggttgaatgataattctattttaagttctttgagaaattgccaaagtgcttttcacaatggttgagctaatttacacttccaccatcaaggtataagtgttcccttttcttcacaacttcaccagcatctgttattttttgacttgttaataatagccattctgactagcatgagatgatatctcattgtggttttgatttgcattatcatattttatttatctattcatttgtcaatgaacattttagttgcttctacctcttggctattgtaaataatgctgtgatgaacgtgggtgtgtgaaaatctcttcaagatcccagtttgaatttctttgaatatatacacagaagaaggattgatggcttctatggtaattctgcttgtaacttttttgtgaaaactccaaactagttttcatgatggcagcactattttacatttcaaacaacaaacacagtggatccaactttttcacatacttattaacatttgttgtttttctttgaatagtgagtattctgatgagcgtggggtgatagctcatggtagttttgatttgcatttcccttatgattagtgatgttgagcatcttttcatatgtttattggccatttatacatcttgtttggagaaatgtttattcaagtcctttgtccattttttagttgcattatttgttttttgttgttgttaagttgcagaagttacttatatattctgggtattagctccttattaaatatgggatttgcaattattttctgccattctataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacggcaagatgccacatctttaaaaaaaaataattagttaggcatagtggtgcacagctgtagtaccagctattgaggaggctgaggtgggaggattgatagagcccaagaggttgggactgcagtgagccatgatcactccattgtactccagactgggcaacagagcaagactctgtaaaaattcaaaatttaaaaaattaaatggcattgaaattaaaatctgtagatgagtttggatagtatggatgttttaacaatactaaatcttccaatctatgagaattgaatgtttcccatttatttgtgttttatttattttggtaatatttaataggtttcagtgtaaaaatcttcactttgtcatttaagtttattcctaagtgttttatcttttttatgatctagtgagattttcttaatttccttttgaaatgttcattggtagtgcatagaaacacttcttaattttgaatgttgatttgtgtcctgcaactttgctaaatgtgtttattttttctaaattttttttggtagaatctttacatataagatgatgtcatctgtgaacagagataattttatttcttttccaatctgaatgcattttatttctttttcttgtttaatttcttttcctagaacttccagcagtaggttgaattaatattaatgttaggagtgggcatcttgtcaaatgttttttctgcattaattgagatgatcatgtggttttgtccttcattttgtgaatgtgatgtattatgctgatttaattttgtatgttaaaccatccttgtattccaggtatatattttgctggatcatgatgtgattttttaaaatatgctgttgaattcagtctgctagtattacatttaggatttttgtatcaatattcaccaggaatatttttctgtagttttctttttttctgtctttatgttattttggtattagggtaattctggccacattaagtgaattttggagtttctttcaaaagtattggtgttacttattctttaggagtttggtaaaattctctagtgaagacattggttactggttttatcttttttggaagtatttgatactgcttcaatgtcctaattatagttctgttcagatttttaaaattgaatcataattcaattttagtaggttgtatgtttctaggaatgtattcatttattctatgttttccagtttgttggcttataattgttcatagtcatctcttataattctttttaatttctgagacagccgttgtaatgcctgctctttcagttctaattttagctatttaagtctctctctcttttttattttagctaaaggtctctcagttttgttgatatattcaaaagaccaacttgggttcattaatttttttctgttgtttttgtttattttctattttattttttctactctaatgtttaatattttcttcgtctcttaatttcaggtttgtttttgttttcctggttccttgatggatacagttatgttatttatttgagatttttctttccttaatatcaatttataaactttccctttagtgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataattacaacatttttaatttgttaagatttgttgtgtgggccacggtggtctatcttggagaatgttccatttctgctggagaaaagatgtattctgttgttatttgatagagagtgctctatttgtctgttaggttaattggtctatcatgttcaagtcatttgattcctatgatagtctccctggttgttctgtatatgaatgaatgcaggatattgaagtatcattttattattattattattatgttactgtccatttttccttcagttgtatctatgtttgtttcatatatctcattgctttagttttaggtgcagatctatttataattgttggctcttgctggtgaattgataattttatgccgctataatgtcctttgtctcctgagacagattttgtcataaaatctagtttttctgatatgattatggacatacctgctctctttaggttcctgtttgcatcggatacctttgtctgtcttgatacagtcacttgtgttggtcataaaattcctctttgcctccacaaagttctatttttcagctggcttcctgaaagtgctactcctgcatgcactgccattcccctcccagttagccagggctattcacatggaaataaagaaaatagctcaccatcatggccatctgagaacagtgtctagcttcctataaatcagttaatgaaattagtttaaaaatagcaaccttaactatactcctctagcaatcgaatgttgtaaccaagttagaaaatcatgctttagtagtgtactgatgatagtattatagggctgagaagtttcaacttgtatagggaaaaatgggtatttttttatgataatgttttcgagtaaagaagaaaaactgttttagttccatgtacctataaacattatatagttctttgattaaccaattttcattttttcttctattgtttttagatgttcttggcagccctgtcattcagctatattgctaaagcactaggtggaatcattatgaaaatttccatcactcaaatagaaaggagatttgacatatcctcttctcttgctggtttaattgatggaagctttgaaattggtaacttttattttttctatttgataaccatacttgcataagttgaaaaacaaactgttcatgcatgctttatatcactgggtctggactaggtgtaaatttgtctctcatgggcaatttggcaatatgttaggatatttttgttgctataaatgggctggggcagggaggatgccactggtacctaggggtagaggtcaggtatgctgctaaacactgtgcaatgcaccagacagacttaccaacaaagaagtatccttcccaaaatgtctatagtgaggatgttgaaaaactctggtcctacacaaactcatggtttgcaaattaagtttttaggaaactttatctcccttgtctcaaggtgccccagtgtgaagaaaggttgagggaggactataattcttatggttttaggtggaaggactgcataggagcaacctacactagattctactgtttaactgtgtacaacattgggggtttaaagtcttttttttttttgaacattgaagatactgctttgatgtaatcattttaatttggatttctccaacaatagtgagattttatataataattgaaaatattatataataattgaaaataatatattttcaatataataatttttcaaagaaaaattaaaatttttcttattttacaaactgctagcttatagcctctgctaattttccctttttcttttcactttctaattatttggagggaccaccaaattgtctattatatagactgcaaatattttctacaattcatgtttctattctaactgtatttacacaatgcttaactaatgactaaaatgtaattgtcaaaggaagatttatctctttatataaattcagaatatttgtgattcaaagatatgacactctacatgtccttcacttgtttacctcccaggctcaatgaaatcatctagatttttagaattggaatgttattagttttaacgtttaattcactgtatgtctatttttattatgaaattaatccttaacatttttgttaaactttgcagctatttaacagcaattatttgaacatcattatcagtttggtttcttacctctatttcttgaatcctatgactgcaaatctcatctttactctttctggagtataccttcatgtatagatgaccctctgtatccacaggttccacacccacggatgcaagtcacattcaaaaaatataaaacttaaaaatggccatatattaataaaaatgatgcgaataaaaacaacatagaatagcaactatttacatagtatttacattgtattagaagtattagaagttatctagagatgatataaagcatacaggaggatgttgataggttttatgaaatactacatcttttgtttgtttgtttttgtttttcaaggcagagtctccctctgtcgcccatgctcgtgcagtgccctgatgtcatctcacagcaacctccacctcctgggtttaagcaattctcctgtctcagcctcccgagtagctgggattagaggcgtgtgccaccacatccggctaattttcgtatttttaagtggagacaggttttcaccatttggccaggctgatctcaaactcctagcctcaagtgatctgctagcctcagcctttcagagtgctgagattacagacgtgaccctccacatccaggcaatactacacctttttacctaaaggacttgagcatccacaaatcttggtgtctacagagcatcttagaaccaataaccagtggacacgagggatgactgtaattatttttttttaggaagaattgaaaacgtggcatattttctaagcccttgcctgttggaatatttattttagtatcatatttaattgataatttgtctgggtatggaattaaaatttccaaatccctttttctcaaaacattaaaaatatttatctactgttttataacattcaatgttgtatatgagaaattattaccactgtaattttcatgcactgatatgcatctcttttttatctttaaatatccaaaaatttactagcatgtatccgagactctatctttctacgttatttctgctggacaaacgtaggaactttcatatgaaagcttacgtcttcctctaacacaaaaactttattttctgtttcctatttgtttcttcctgtattttattctctcttttcttctgaaacatgtatgagataaataatatattttctgaatatttttcctttaaaattttttcctctaaatttctacctcttttctttatgtttcatcaattttctctgatgtgtgatgtcatcttttatatcaagttctaatttgtaaatttttaattatattttaaatttataacaacactttattgttgtcttattatttttagtctgccagttctgattctatggctgcaacatgccattttacctctaaatatactaacaggattttttttaaaaaaagtttctactctttttagtttaatattgtttaagtatttattcttgtgttgctttatctgctggtccattctggtgctttctttcatgaaactattttccatcagtgttcaataattcttgattattgtctgttcaatgttatatataaggctacagataaatctgaattggtctactcttattgctcttcttccatgttttaatctaaataatttatactcaacattacatctcaaataatgtatcctccaggaaactttcacaaagcccctaattaatttaagctccctatttccataatctaatagcacatctatccatctgttttattttattactagtgtgtttctagagaacaagtaccacgatttttttttatatttctgactctgagcactgtggtaggtacatagtataaatttaaagaatgcctagaataagtttaaaatatgcatgaatgattatctttccctcagattaggaagacattttccattccaatgcaatccagtaaactccaaattttcaaaaaaaaactttgcttctctcatatagccaaattacccaagtgctttctttgcatataaaacctattctacttattaatactatacaacttttcaatgagtggtttaatgtaggagagttcaccttcacagttaaattacatggtctttgagggaaggtacaatgtcttgggcatatttgcattcatttggggcattcagttctactagatacaaaattacactaagtcatatcaacataattttgttttttttctaggaaatttgcttgtgattgtatttgtaagttactttggatctaaactacacagaccgaagttaattggaattggttgtctccttatgggaactggaagtattttgacagctttaccacatttcttcatgggatagtaagtgttaaacagctctgagccatttattatcagctacttgtaaattagcagtagaattttatttttatacttgtaagtgggcagttaccttttgagaggaatacctataggtatgcatagagaaatggagtatatttcctatataatagttcatgtattgctttattcatcatgtatttctttatttatcatggcttttataaacttttaaataagaataatattatataaggtatacagttttatatgaaatgaatatcttatttaccaattttagtataacatatgtattttatgtttttgcctgtaagattttgattatcctcagtaaggcttcacaacttcacctgctgctgtacaggttttcccatcagcatttcactgaagctgctctttctaaggtaactgtgtagttatgattagagtaagaagctcatatgagaaaactgaaaatagcaataacttaaataagatagaagtttattttttacattttttcaagtccaaggatgatatgattctacttttcatcatagtgctatgccttgcatggccttgtcctcttgttacaaattgtggcaatgtatttccaggcaacaggatagaagaagagaagaacaagaacaaagagtgcacacaggctgagctccaggagcattttcagaagcaaaacactttcactgatttcacatttacgggaagtcagttacgttttacacatagatatgtagatgttggaaaaatgtactttattccaggcttccgtatttccagctaaaaaaaccaacttctgttactatggaaggagagaagaaaggatactgagagacaacgagcagtttgttagagacaccaattccttaatgccaaatccagcaatcatgcctattggtcaccatatgaattctgttttcccccccccctacatttggcccttataagaactttcttcttaatggtactgctctaatactcatcatattccacaatcttgattcatttttctatttttgtggcttcatcatgcccatctttttcctttgcttctgacaccataatttctgtgtcccataattccctctaatcttcttaatatcttattcttcattatttttatggagaatatgccttaaatgcaactaccccagcttcatcttccattgctccccacatttgaggaccacattctaggcttacagttctctaatgtgccataatatgtcatatctttgcatctgttatttctacagacttgaatacttttcttcctttgtctaccaatttgaattctacccatcttcaatattcatttaatctgtccttcacattgtgaagttttctttgatctaccctcacctccaagaaaagctgatcatttctttttttttttttttttttttgagacggagtctcgctagtcgcccaggctggagtgcagtggcgcgatctcggctcactgcaagccccgcctcccgggttcacaccattctcctgcctcagcctcccgagtagctgggactacaggcgcctgccaccacgcccggctaattttttgtatttttagtagagacggggtttcactgtgttagccagggtggtctggatctcctgacctcgtgatctgcccgcctccacctcccaaagtgctgggattacaggcgtgagccaccgcgcccagcccctgatcatttcttttttgtgggtgtgtgacaacccaggaccttgtatattaaatttactatatcttcgatcatacacatttatcttagagagtgtgaaatttccaaagtacaaacactgtgtgttttatttcttgatcttcatgttttatttcttgttctttgaagttgagcaaaatgcctggcacactatatgttgtccttagaactcacagagcggttagtatttttgagcatcagcgtctgtccctgatccagctccatctccgttgttcttattttttcctcataaagtttaaatgaattagaaatttgtttttattgagttttgaaaagtcaagcactttgtgtgtgtgtgtgtgtgtgtgtgtgtgtgtgtgtgtacatgaaagaaaatcagacagattgaccatctttgatggtaactcaaagggataaatagacatagttaacagataaaaaaacaacaggtgaaaccatgatatttcatatcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaatttggagaagacagcggttcaaataaaggagaaaatttctctgtatttctgggaaaactgaaaatattcagtagataagcaaaatgttcaatttcatgttgctcttacagttataggtattctaaagaaacccatattaatccatcagaaaattcaacatcaagtttatcaacctgtttaattaatcaaaccttatcattcaatggaacatcacctgagatagtagaaaaaggtaagaattaatagtgacagtaaaacaaattctagattgatagatttaatcacgtctataaagtttctgatattctttaacaaaattgatttaagaacaaataggaagaacatttatcccttacatacagacaaaatcatactgttaatgtatgcagtcgattcttaaacaacacaggtttgaactgcacctgttcgcttatatgcagcttttgtccaaccaaacagaaggagaaacccaccaccgatgtggaggtctgacttctataggcggtttccacagggcaaatgagaggacttaagtctgtataaatttgtgtacatatgagttgtcctagaacaaacctcctagtgtacaaatggattattgtataccaagggcatttagaagtagataagaaaaaagaacaaatttagtaggaaatttgcaaagaacatacacatttaaaataaaaaagcagaaagtggtagaaatatgtgaataatataactttctctttataaagatgcaaaatgttatagcatttgaagactttgtaactattataaacacaataatataagtataattttaaccccaaaatttattaaaaataaatgaagtggaggaaaaaaaatgatttcaagttttctgtattgctgggagagtataaatttcaaagtctttctggagattaattttcaatacatattaaagaacaaaaatatacttgcctactttcttgattaatcttaaggaaatcatcagtaatgttcacaaggacatttcataatcacagccatgacatccatgtttaacagaataaaaaaaaatattttgtaacgacaaaagaagagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcgtctgtgtgtagtgtaattatagaaaatttttacttgttttctttgtgcccttccttattttcaaactttgtaaagtgaatatgaatcacttgtaattaggaaacaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtaacgtacagaatatattaaatttcatgattacattccctggatctacccttgaaataataatgtcattatttttttcttttacctattagaaaaatatttgcagaagtgtattgtataatattacttttaaaagcatgttaaatgaaaaccaagtatttgtgacatctgattaaattgttttgtaatacttacaggtagtttgaatgcaataggaatgattggtccagtcattggctttgcactgggatctctgtttgctaaaatgtacgtggatattggatatgtagatctgagtaagtacaattagaacaaggtaccatgatagtgtcttttaagtgcaggacaccattcttccaaagaattaaattcagtctttcaatagttctttgtttactatttttcaagagttacaagtaggaaataaatccattaataatcagaataaaaaagaaatttagctcctatttatactttgcttttacaactaagtataaaaagagatttttaacaaatttattttagattacttgatccaaaataaccaaacttgaaatgtccctttcccaaaactgactggcccagtcaagtaaattttatttttcagttgatggtgacttggatgttgatgtgtagaactcagatgttgatgtttgctttgcgaaagcctccttgtggctgctgcattgacttacggcaggggtgggttaagagaggccacagtgcactttggttgtggtcatttttcctggttctcactgagggcttggcctatgggaacatttaatgagtgcttatagaacaaatgaatgaaggagaggatgcataaataaaatttacgacttttgtctttactctcagagcatgctttatttctcctcttgtagaagaataagaatcaatgttgtaatatctgcctcgacttcaggccctccttcctacagatataccttcaccatatccatatttatctttttttaacccatacttatgaaaaagtatttatctttagctaatattagtagatccaactggggtttagatttcctctttctgcctctcctccatctgcaccctctcttttcctcagcaaacacactgaagtctctcccatctatgtacacatacacatttttatatccccaaacaactttccaattgattaactgtttctcaatttatcttcaaagccaagtacctagaaaaacatcatctaacataagtatctcaccttctcatctcccatttacttctcatccactataatctgttttaccactaataaaacacaatcagcttctatgtaatttactaattgtaatggatatttttctataatttattttaatggatatttctactacttgttccatttttttcttcttagatttttttttaaataagtacctaaaactcaacctgtgaaaagctggtctcatcgtctgatttccaaacccactttgtttcctgtattccctctcttgatgaatatctgtaccttaattcaatgactgactgaattactatgccctgtaatctcacacttccctttatttaaaattggaaaaacttttctctcttttttatttttatggttctcaaagtctctttcaacatgtgacttttctcatgtaacccttacttcatcatttccattggtctcaaattcggtgctcctattaatcatcaagagcatgcctttattgtagcccttctcacaacaatctataaatatttgcatacttacccaccatctctttgagaacatgacagaatcgtgtctgtgttagcatatgataactcatcagggtttgtgaataaacaaatatgattttctatctcttgaggacttaaatagatcactccaaagagaccaaaggattcattccaagatggaatagccattattgtaggccaagaaatcataaagtgttttctattataaaactaaagcaagtacctgatgatatgttttatatcttccatgttagacatgtggcttagtgtagctacacgttatgtacatcatttttactcatttgctctactttaatcattgcttttaacactgagtacaaagtaagtgttgaaggtctttaggatagtagttttgtagcctctctattcagaaataagcacaccattttagaattcatggtgattcaacttctacccctgactgttcagaccttatcacatcttctcttattctgtgagaagcatgaagtgaacttatgataaagtatactttggtaaattttaattcctacaggatccaaagacataacataaatgagtaaagaatatcaagggcaggaaattagggtatgatggttagaatggggagagttgttgttggtgcactactctccccatacacactaaaactcatgtgctccccagctctggtctatacttttcatacagaattttggcaccggcattaataaggctttctgattggttttccagagaatccaggaaccaagattttaatgtagaattttccaatttttaagattgtgtgtgagccacgggaagcactagcaggacatatctagcttggttatgacctttagttcctatatatagaccagtgaaagaaccaaaaacagtcatcaaaattacatttctgacaagtgataagtaaacacttagcatgtataatggagttactgatttaactagtcatttcctgaagtctgcctgagttgttgattatgaaacaatatgatcacataaatcaattttaaaaccagatcagtccatactagcaaataatatatttctaaatagttttaaatcaattcaatattttttcatgtcaatgatttttcttatagatcagagtaatggcatcagttaagtttgctacaaacttctatggtgtgtgtgtttccgtgtgtgtatgctttcttaatctttattatttttattttactgagataagaacaattaaaatggactctacctctcaaaaatacaattgaaccttgaacagcacagatttgaactgtgcaggtccacttatacatagtttttttgataaatgtattggaaacatttttcgagatttgtgacgacatgaaaaaccttgcagataaactaggcagcttacaaatacagaaaaagttaagagaaaattagttatattgtgaatacataaaatatatgtaaatattattttataatttactacaataaaatatgcacaaatctattattaaaagttaaaatttgttaaactttacacagagaaactcttatagaccttacatgatgccattcccagtcacagtattaaatcatgactgcataaaattaactgtagtgcctacttcactgctgtaaaaattctgtaatcatctcctgttgttattgcagtaagctcaagtgttgagagtatttatttaaaatgccatgtgtcattcatcatctccatatgagtagttttcatcactctccagtaagtgatgaatcacagtaaaaagtgaacccttgtgttttctgcgtatttttcatcctgttaagtgctgtaacatcaaccttaagtaacactgtgtgagccgtatgaagtaccactagtgatgctggaagtgctcccagaagcaaagaaaagtcatgacattataagaaaaagttgaattgtttaatatgtactgtagaatgagctctgcagctggccactgtttcaatataaatgcatccagtacaaggaccattgtaaaacaaaaacaaaaacccacacacagaaaaatggatcaacatgaagcctcactgcagctacaacattgggcacataaacctgtccttttagtgcaatagctttttatatcatattgaaaattcaacttttatgtagatgcaagattgctatcagaaaggcataactgtagactcgaaacatgattcaagaaaaagtgaagtcattatatgaaaacttaaagcaaaaggaaagtgaatgatttaaagctggagaacttcatgccactaatgcataatttgaaaattttctaaagaggtttgcctcaaaaaagtgtcagtataacaggagaagcagctcctgccacttaggagtaacagaaaagttctaaatggcataaagaaagtcattgaggagaaaggacatctacctgagcaggtttttaatccgatgaaagtgccctattctggaaaaaaaataccacaaagtacacttattaatgaggaagataagtgagtaccagtatttaaggcaggaagggataggctaacgctgatgttctgtgcaaatgcagtggggtttatgatcggaactgttcttacctatacaactgctaatccctaagccttgaaggggaaatagtaaaaaacagttgttagtcttttggttgtatgacaagaaggcctgaacaataactttttttctgaaaagttatgacagtttccttccatgctttgttcctgaagacaggaagtaccttggcaggaagggtttaccttttaaagtccttttgataattggcaatgctcttggtcatccagaacctcatgagttgaatactgaaggtgctgaagtggtctgctttaccccaaactcaatgtctctaattcaccctctagatgtggggtcctaaggacatttaaggctcattatacatgttaccctatagaaaggattgtaaatactgtggaagagaaccccaatagagagaacattataaaagtctgaaaagattacaccgttgaagtcgccatcattgttatgtaaaaagccacaaaagccttcaaacaggaaacaaatttctactggagaaaactgtccaaatgttgtgcatagcttcatggaattcataaccattcaagaaaattatgaagagattgtggatatggccaaaaaaaaaaaaggtgtggagtgaagaatttcaagacatggatcttggagacattcaagaggtaacaggcacaacagaggaattaacagaagacaacttgatggagataagtgcttctgaactaatgtcagatgatgaggaagaagacatggaagaagcagcgacagaaacaaattgacatcagacagtctggcagaagtgttctgattattcaagactgttttgatgtattttacaacatggaagcttctgtaatgtgggcactgaaatgaaagcaaacagtggaagaaggattggtatcatatagaaacattttcagagaaatgataaagtaacaaagtcaaatagaaattatgatgtatttctgtaaagccacactgtgtgtacctgtctttcctgtagaaattatgatgtgtttctgtaaagccacactgtgtgtacctgcctttcctgtctttctttttacctcctccactgcctctgcctctactaccctagagaaagcaagaacagtgcctccccttcctcctcctctacctattcaatgtgaagagatgaggatgatgaaaagcgttatgatgacccacttccacttaatgaatagtaaacacatttccttgtgattttctaaatgtcattttctcctgcttattttatagaaagaatacagtttataatacatacagcatgcaaaatatatgttgactgtttatgctattggtaagaattctggccaactattagtgctaaaaaagcacttgataaaattcaacatcccttcataataaaagccctcaaaaatctggggatagaaggaacatacctacccaaatatatctacagattcaagttaagtttttggggaaccaaaagttacagacagattgtcaactgtttggggggtcagccaccctaaatcccatgttattcaaaggtcaactgtacaatacagtattattaactacaggcacaatgttgtacagcggatctctagagcttactcatcttgtataaatgaaactttttatacccattgactgggaactccctatttcccctttcccacaaccactggaaatcaccattctactttctgctttcatgagtttgactcttttgtatgcctcacataaatgtaatcactcagttgtagggaccagccccacagattcggtgggtctctcgctgtgtgcggagatgagagagtgtagaaataaagacacaagacaaagagataaaagacccctgggcctgggggaccactaccaccaatgcgcagagactggtagtggccccgaatgtctggctgtgctgttatttattggatacaaagcaaaaggggcagggtaaagagtgtgagtcatctccaatgataggtaaggtcacgtgggtcacatgtccactagacagggggcccttccctgcctggcagccgaggcagagaagagagaggagacaaagagaaagacaacttacaccattatttctgcatatcagagacttttagtactttcactaatttactactgctatctagaaggcagagccaagtgtacaggatggaacatgaaggcggactaggaacgtgaccactgaagcacagcatcacagggagatggttaggcctctggataactgcgggcaagcctgactaatatcacaagaggtggaggagcagagtcttttctaaactcccccggggaaagggtgactccctttcccggtctgctaagtagcgggtgttgttccttgacacttcttgctaccgctagactgtggtccgcctggcaatgggcgtcttcccagacactggcgtcactgctagaacaaggagcccttctggtggccctgtgtgggcataacagaaggctcgcactcttgtcttttggtcacttctcactgtgtcccctcagcttctgtctctgtatggcctggcttttcctaggttatgattatagagtgaggattattataatattggaataaagagtaattgctacaaactaatgattaatcatattcatatataatcatatctaagatctatatctggtataacttcttgttttatattttattatactggaacagctcgtgtccttggtctcttgcctcggcacctgggtggcttgccgctcacactcagtatttgttcttctgtgactggcttatttcacttagcacaatgttggcaaagtttaaccacgttatcacatattgcaggatgtcctttctgtttaagggtgaatagcatttcattatacgtatatatcacattttctttgtttattcatctctctgtagatattaggttgttttcacatttagactgctgtgaagagtgctgcaatgaacatacaaatggaaatatctctgtgagatcctaatttcgattattttggatatacacctagaagtgagattgctccatcatatggtagttctatatttaattttttgaggaaacttcatactatttttttataccaggtgcacgattttgcattctaccaacagtgtataagtgttcaaatatctccacatctatgccaacacttttctcattctttatttttgataatagccatcctaatgggtgtatggtgatacgtaattgtgcttttgatttgcattattatgataataagtgatgttggatatcttttcatatacctgttcatttcgataccttctttggagaaatttctattcaggtctttcacctatttttaaatcaggcaattatatttttttgctatggagttgtaggaattttttgtacattttagaaattaacaccttatcacatatatgctttatgaatattttctcttattccgtatgttgccttttcactctgttgattatttcttttgctgggtagaagctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatctggttttctcaacaccatttatcagagaaacaattatttcactatcgtggtcccttgtcaaagatcagatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttccttctattcccagatttttgagggcttttattatgaagggatgttgaattttatcaagtgcttttttagcatcaattgaaatgatcatatgatttttacctttcattctgtttatataatgtatcagatttattgatttgcatatgttgaactaactttggatcccaggataaatcccacttggtcatgatgaaggatcattctaatgtattgttgaatttggtttgtcactattttgttgaggatatttgcatcaatattcatcagagaaattggcctgtagtttttttgatgtgtgtttgtttgattttggtatcagggtaatattggcctcacagaaggagtttggaaatattccctgctcctccattttttggaatggtttgaatagtattggcattaattatttcagtctctttgttaaattatctgatagtttctgaattccttctctgtgttatcttgaatttctctgagtttcttcagaatagctatgttgaattctctgtttgaaagattacatatgtctgtttcaccaggattgttccctggtgccttatttaatttgtttggtgaggtcatgttttcctggctcatcttagtgcttatgttattcatcagtgtctgggcattgatgacttaggtatttattctagtctttgttgtctgggtttgtttttgcctatccttctttactaggctttttaggtatatgaagggactttggccacaacctcaataatactgtggtttttacagtcttagagaggtactgccttggtggccttggaaagtatatggaagaattctctggattattaggcagagactcttgttctcttcccctgctttctccaaagcaaatgtagtcttgctctttctgtgctgagctgccagaaactgggggttcactgatgcaagcaagcatccttgtggccccccaaccactgagactgtcctgggtaagacctgaagccagcacagcactgggtcttgcccaaggccctctttaactactgtcgggctaccatctatgttaactcaagatcaagggctctacaatcagtagttggccaagccagccaggtttgtatccttcccttcaatgcagtgagttcctctaggcctcaggctggcctacagatgctgtctgagagccaaggattggagcaaaaaacccttgcaatttacctgtaatagatatctgttttactatggctacgctggcacccaaaccacagcacaaagttcttcttgctcttctctccccttgccacaggcagaggagcctctccctgtgtccaccaccaccacaggcccaaggaagattctgccaggccaccacccatgttcaattaaagctctagggctcttcagtcagtttattatgaatgctgccaggtctcagagactcatccttcagggcagtgggtctcttagtccaggactaggctattggacagcatttctagacttgcctctggcccagggcaggtctagaaatgctttccaagagcttagtcctggactcagggaccccaaaagccttcttgttgctctgttctactgtagctgagctgctacctaaggtgcaagacaaagtcgcctttatttttccaccacttctcttaaacagaaggagtctttcaccgcaaccaccatggctgggattgtgcttggtcacacctgaagtcagcaaatctcagagcccaaggccctgagtgcattactttgcattactttggtaccactgctggttatttagggcctgagggctctttagtcaactgatgataaatgctgccaggagtgggtccttcccttcaaggcagtggattcctttttggcccaggatgtgcctagaaatgttgtccatgagttagggcctcaaaactctgcctggtgccctattttactgtggctgagctggtattagaaaaaatattttgcaatctatgccttagaaaaaaagaatcacctctccaactcttcatggactggccttattgtaggagaaaaccttcatcaatcagcccagccatatcttcttgggcctctcaaattttcatggtcgtccaaacatctatctttgtcttaggatcccccaggcatctagagtatgcagggtcttatcagcacctttacacatttgagacagaagacagtccttagtcaactcttaggaaagtttgaatatttggcatgctgtccaactctttcccttcccatggagaatttggaagctgagatttcttacctcatcactctgcttaaatctaggggcaggaagaacttggcaagtgcccatgtgctagtttaaatcatcatttttgtgttctttgtagcacccaggggccaagtgtatgcctaacctaaagacaaggaagacaaaatacctttccttgatagaactcagaaaagatgaaatgttatatatgtggtccaaatctttgtttccccatggaggagctaagagctgagatgttgttgttgtttttgtttttgtttgtttttgcctgctcactctgcactaacctagggggcaggatctgtgataaatatccacatactggctcatctttattctctgtagttcccaggtgtctggcatatgctgggtcctctcagtacttcgagacagatgagatagaagctaatctattgggtagcacttggaaaggttgaaatgttgaatgtgcagtccagccctttctctccccaaggataagctgggagcattttttaaaaattttattttactttaagttccaggatacatgtgcagaatgtacaggtttgttacataggtaaacatgtgcaatggtggtttgctgcacctatcaacccatcacctaggtattaagtcccacatgcattagctatttgtcctgatgctctccctccttctgcccccatgacaggccccagtgtgtattgttcccctctttgtgtttatgtcttctcagtgttcagctccttcttgtgagaacatgcagtgtttgattttctgtttctgtgttagtttgctgaagataatggctttcagcttcatacatgtccctgcaaaggacattatctccttcctttttatggctgcatagtattccatggtgtatatgtaccacatttgccttatacagtctatcattgatgggtatttgggttggttccatgattttgctattgtaaataatgctgcaataaacatacatgtgcatgtatctttataatataatgatttatattcctttgggtatatacccagtaaagggattgctggatcaaatggcatttctggttctagatccttgaggaattgccacattttttgtttttttctttttctctcacacattcgctctgtgttaagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatctctcagttagcttctgtatttctcacaaatgaaattgatctgaatattactgttgaatcagtatgttcatggagaaaaaggtatctgtccttcttattctggtatcttgctgatatctcatggatgcattcctgttacttaaactgtatattttctacctactaaaataactcattgacatttgagatatagcatttacacattactcttatacatactttaagggaaatatagttgaaataaaatggttaaatgatttctaacatttagagtccaatatttctgggttactcttaaactcagattttcattttgcatagtttttcatcctctgtgctgtctggagagttgcaaatgcaggttcctgggtagttagggtgctgtggatggaagctcctttattgtctctaagtattttttgccagctgcttaaattttatttctgaggctttcttgacctcattagatgattccaacattttcagacaacagtgaggattcatatttcttccatgaacagttattaaatggtctgaggagttaaatgtccaatgatgacagctgtccagtcatgaaatctgaaaagccaccaagtgcacacaagatcaggcaatgcgaacagtgtcatgactgactcctggacaatagcaattgcaagatgtcatcaacctagtttcagagataacaaaatatgaaaagaagaaaatagtgttttagaattgaaagtaaacatttggtttactttcttcatctatggaggactgcaatcattatcattatttcccagaacctactgtatttcaaaacgatttttgactggcttcttttaactgtttctcctaggcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggtaggtatttgacattcattgtcaacttggaattgttaatctcaatgaaacggagaagtgagtaaaaaaaaataaagcatactcaaatcatctagagtcagctttcttctctgctaaatttagctgaattattttttctaaaactcctattaaaattaacaaatatgtcttgagtacataaaaaggggaagaggattaggtttctgctctttagaagagagaaaccaatcaaaggctacaaacatctgttgcttataagccagagtatatattcattttaatataatatagtataaactgtgagggtttaaaggattataatttttcattcatttatttatttaacaaatgataccagccatcatactattctctggtaatagaacattgcctttattttttgagaacctggtggatgatattaagacgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtaaataatgtgaattaggattccttaccacttgatagtggtgcctctgtccaatataagccaaatgggctaatggagtaccattgagaagcaataatcaagagaatgatctggcagctgtcagagcaagatatatcaaatggtaaggtattgacagcagttttcagattagggagaaatggtgaagtagtaaaacctgaagcagtgcaaccaacacttaaacccttggcactttttaaagttttcattgaagtaaacttacaaactttccaaagtaacccatgttctttctctcatcagttccttcacttacctttttttttgttgttgttattttctcctctccaccacactaacccaagagcaatgggatggatgctggagccttgtgtattcactcatgagagtggattgctcaatttcagctgcgttggtagcttgaaattgtccatggtaggagaatttaccgtcatgtattaccatggaaattgaaaaatatcacaaatcgagtttgtttcccagtgaatctgttgttaaacatttaccagcacatcattgataagtttttgtagtttaacatgcatactaaaaacagcgtatcaaggattttttattttgtctatgctatgtttctactttaatcaaatccataacaattgatgaatttttttttttgagacagagtctcgctctgtcacccaggctggagtgcagtggtgcaatcttgactcactgcaacctccacctcccaggttcaagcaattctcctgcctcagcctcccgagtagctgggactacaggcacacactgccatacccggctaattttttgtatttttgtagagacggggtttcaccgtgttggccaggctggtctggaactcctgagctgagacaatccacctgccttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgtatagaagttcagtttagatgacatctgagttcctatttacctcaaaaatttaacaatttggttaattcacatgttccatttattttgagcaaaggtcgcgactctcttagaaagcctcacaaatcatttgtaactttaagtcttatataacttatatttacaaaattcagatattaatatatattttattattgaaatatgttatttttataactctataggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggtaagacatattttttacctgtttgcttgataaatgaaacactgctgagtacttgtgttccaagtcacattttattatgaaggtgattttatattttactaaatgtaatcttattatgtctcaaactttacaaaatttctccatcttgtaatatcatcgttgttctgcatttgaagttgcatctcatgttaggtgaatttaattccataggtgaaattcacctaattctataggtgaaattctaaagaaaaaaaattgcttgtgaataaaacatttagacgtagtatctgcataattggatcttataatatagtactgagatcctgagacaaacccttttataatataaccattataattctataattcatggactgaaataaggcctcagctacttacaaaagacataatattaatcttttcagaaggagaatcaatttaaatacattacaaaatatgcatgattcaaaacaaatgtcatattttagagaggtttattttgctacaatgcctattttcaaagtcatattgagaccttctcattaaggaaaggttatcttatatcccttttcccacaactccagtattgtagaaaccttgtagaaatttgataagtatttgatgagttaaacagtgtatcaaatggtatgtatctaggtcatatgtacataggaaagtaataattagaaaatgaatgtactgaagcattggaacaggcttctggatgatctccctgttgaactgacagatttaaacttaaaagattcagttttgactcccaataacctggcttgaattttttgttagaggaatcttcacctttaataacacttacgggactgtgaaatggaaaaaatgtaacagggatcagtcatttttaatcctgtatgtagacatttttatcatatcatggtagatatgtcttttatgaataataaagagatattaattcaagaatttaattctaaagcctgggcaaaattggagtgagttattgaggattgaaacattttgagaaatgtataaaggattttttagatggtaggatagaaatctcagagaaagaaagattttgtttttgttgttgattgccagaaaaaaagaaagctcctcatagaaataacctttttagacacgtaaatattcttagccactgcctttttcttgtgaggaagccaagccctcataattggccaaaataaattatttttgtctctcatgtgggtatacttgtcccttacctccaccctagtgtgccacccttctctcttttttttttttttttttttttgagatggagtctcgctctgttgcccaggctggggtgcagtggcgcgatctcggctcactgcaagctccgcctcccaggttcgccacccttctcttaaagaaataagaatgggtgaatttggttgatatacactgtgttttatatataaagacatatcagaaaaaccatatttgtataattatagcttttttctcttcttttatttctaggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatgggtttgtatatattgctatataaattgtgtaatatgttaaccatcaaattaaaagattatgtgcaagtaaaataaggtagaaaacaattgtaattaaactttattttaattgagagaaatttcaattttcaaattcttaaaatgtccatttcctaagacaataaaaatttgttttattccttccttaaggaaaagcaacatcggttgaaataataatacctatgatttctgggtaattaaaatgagtggtagacacttttaccccaattttatagatgggaaagtgagatttagagaaacacacacattatatggctagcaatgttaagattaagacacaaatttgagctattagaggtatcagatgtcattaaataaaattattcataatgtattttctaaattatcaatctccttatttttcttaatttaaattctatactcatttgaagatattttataaatccttaataattatcatatctttacaaaacaaataaaatctttaagcttaaacattatacaaataacattttataattttagtcataatataaaattatatcttatgatttataattatattataaagtaaatcagtataaacagtattatagttttattcagaaaatatgcagagattttttatcctttttcaactaattctattattcttgattttttattcctcagaggttcggttttaactacattgaaatctttttttttatgtagttaaaatatagattgtaaaattcaacaatgttaactaacatgcatagattcagaggattttaaagtgagcttagaggaacctcaatctaatgccattacctccctgaagagaaactgaatctcagaaaaatgaagttacttatataatgtaaagtttcattgatagaatgataaagacctcttgtctaagtcttatctaacctcttttatttcttttttaatttttactttttctaggtcataagtcatgtcttggtaaagaaggagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctttctctttttttgatatatttctatcatatattttcagaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgagtattagttttcactttttctcctctccttaatcaaaatcacagatttgatttaataaatacttatcaaatcttcctataactaaggtctccaataaaaagataaaacaaaaagattccagtattatctgtcctcgtgatagctgtgaagtgtaaacaaagcttcatataaaactctgcttaggacacaatcagacttctctgttacttgaattctaattagagattacccactttttttcttgagattttaagaatatgacctgttagaatttgaatgcatttagggtctctaagaagcatctcatttgactaaagcacatgatttttattatttggaattactttaccctttggaagttaggggaaagttcagagttagcctgttgtcagcactacctgctttacgagaacaataatctatttgcattttaatatatacatactgataagtgtagctagggactcactgtggccttggactttccaagaaatgagtcaagtcttcatgttcacttgaattccctattcttgatttcctattttgatgttcccaaagctggcacttcttttactcagtataatttagtatcctactcactgattgccaacatatccattggaaattccatttctttcttaactcaaaggcttttttttttccatgtgacacatatcctgtttttcccaatatcctgggtaactcccaatgattggaaattaggtatgctgttccccatacctacaatcaattcaacatctcacaagttgcataactatttttcaggccctttccctattaccaacattagcaatatagtcagctgcgattatgactctctaccacactcttccatgcttcaattctaaacattttctatctttcccttgcccaatatcctaccaacgtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttgagatggagtctcaccctgtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgcctcatcctcccaaagtgctgggattacaggtgtgagtgaccacgcctggccaattcttttacaagttctccttcagtaaatagtcttcagcagtagtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcacctctgcctggctctgtttcctctgcactctgtcccattttcatgagtggctagattttgtcccgtttcaaactatattttctggattcttttggtagttctttcccagagtaagtccctaatacttagaacctgccaaagagagtaagaatgtgtattttggaaagaaaatgtgggtggaagagaaatattttaaataatgtatattaatgaaaaaattatatacagaatttcatacaccaatttcttaaattcctaaattcagggagctattttgccttcactattaagcaactatatttttataacattttttaaactgtaaatattttagtttgagacgtctttaaatataatggaatgtattcatagccctgttgtatttggcaaatgtatttgttaatatttcaaaaactatttttaggtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagtaagtatgatcctgtaaaacattgtcatgtatattagactaaaacacacctaatgataggcatatttttctgtattttgagctcaaattcatattttgtcaatttttaattctttgagaatgcattttcttagaattattttgatatttcaataacatcattaataatttttgtctctaatacttccattgtcaaatctaggctctatactttcttctctttaataaaaatcttaaggcacacactgattgacagttgccttgattgtaggagaatctttgtgtgattgtaaaagaacttttaattttgagttgcgttgcatcctaatgagccagttaagagtaaatcatctgttgatttcattgaaagaaaacatttagcaaccaggtataaatacaaacttcaatttgtaatgaaattctaatgctttcaattcacccacagcatggcttttgacctggtatttcatgatacccttgtagggcataagaaaaatatgtgtaaataattcattccttttttcacttattagacagttatttagacaggatatgatgttcgatgaagaatatttcctagtaagtaaaaccaataaggtacttgttttctcacagcttagaaaatgacaagactgatgtgagacaaataagtataaaaataaacacataattacaaattgctgtttgtcttaataaggaaaaagactgccaattaaaggaataaaaagagaaactaaatttaggattaaagtaaggggatgtgaggggaaagactcccagagtacatctcaaaagaagtgacattatatctaaagatgtaaagaaaaagccaaatgaagggctttcagggagagggtctaggtgctgtttccttaagacaggaaagagctagaatttttgaggaatgaaaagaagccagtttattggaacacactgagtgagaggggtatggcagatgatgtttggagagttgaggggaagcagataatgtgtgcgctactggccaaaataagcacacaatcacctaaaacgggaaacatgtaaagacatgcatgtagatcttaaaaatatacatgataagtagagtgacctggggtaacacctaattgtacttttaaaacctactagttgatcggaagttcatggccagccaacagcatgacatggtagaaaaaaaaaaagcaaccaacaatgtgttttaacttttgttaatatgaatataaacctgtaaactaagtcagtttacagttgttaaattttcaccctgcctgcaaattttcttaaattcataccataaatattccacaagtatagcttcatcttaatataaaatgtcaattcagaaggagaagccttctgtatttccaaattacagattcattaacttataaaaattcacttcataatttcatactagtttgcctctcaacatgttttagcttcttaattgaaaccttttcatgagaaaaggagagttttaaaaacattgttccatccttgatgatagttatattttatctgaataaaaagtgattaaatcaacattaccacttatcagagcatttattaatttctcacctgcctttgatttcctttgaagaaaagttttctgaagctgactggagaataaaaatacaaacttcattttattaatgattttctaatgcttgcatcataaggctattgctaaaactagactcagcaggagtgtagacatttactcatccagtacatattcattatgtgtgtcagccacaaatccatgcactgaggatgcaaatgtgaacgaaaatgataaaacttcattagcatccagtggggatagggtacagggagtggatatatatagaagaactaataaacaaataagcaagtaaatatgtaaaacagggtaaatgtgaagcactagaaagaaaaataaatcagagtcagaaaatagaaaaagtggggataggtaagagatgctagttcagatattgtgaaagttatatgacaagagacctaaatgaaaagatgaagagagaagctacaagccatgctaaatgaggacaggaaaggaacaagctaggcaaggtagagcaaagacaaaggcccttgggtggagcatacttgatacatacaaggttagaaaaaagtgtgtgaggaaaagagaggtacgaagtacaatgacagagctagcgtgatccagattatattgttcacaggaaaggctttggagcttattctaagtgtgttcagaagccccagagggtttaagcattagtattacctaatgcttaaggcttacctgagaagatcactctgactgtgcatgacttgtgtttttggaagacaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctggaaagatggtgatactattgaacaaaaggggaaacactaaggaagggtagtttggaggaagtagaaaagcaaaatttcttatatccctgtaaaactgagctgcctgttaggtatctaccaacaatgccatatgtagaagccaccatttaggaaaatcattaaagccatagacacaaatctagagttggcaatatacagatgctatttaaatccaatgccacattgagatcttctagggactgggtacagatagaaactacatcctaggaacaacaggcactctaactttagcgattaataatagaaggagaggacactaaaggaaactgaggaggtcccatgagttatgaggaaaattgggaaaggatcatgtccttgaagcacagtgaagaatatatgaagaagcagtgaataaagaaactatgtcaaggcctgctgagagttcataggagttatggactagaaagtgaccattggatttcattatatgctcatcactattaacctaaacaaaactagtgcatgaagatgggaggtgaaaaaaaggctgttttggttgttttaaattttttcatttttatggatttagagatacaattgtagttgtgaaacatggattatattgtgcagtggtaaagtctggggtttaatgttcccatcacccgaatcgtgtactttatattcaataggtagtatttcttccctcccactcccttccaccctcccacactttagggtctccaatgtcaattattccactctgtaagtccttgtgtgcccattgtttagctcccacatcaaagtaagtacatgcattttttactttctgtttctgaatcatttcactcaggataatggcctccatttctatccacattgctataaaatacatgatttcactttttaattgctcactagtattccatagtgtatacatatatacaaaatttttaatctaattatcagtgaatggaaatttagagtgattccatgactttgcttttgtcactagtgctgtagataagcatacaagtcagttgtctttttaataaaatgatttctttttctttaggtagacaccctgtggtgggattgctggattaaatggtagttcaatttttaggtcatcaggaaatctctatactgttttccatagaggttttactaatttacattcccaccaacagtgtataaacattcatttttcttttcatcttcaccaacatctcttgacttttgaccttgtaataatagctatcttgatgagtataagatgatatctcattacggttttaattttcatttctctgatgattagtgatgttgggcatttttatatatttattggccatttgtatgtcttcttttgaaaaatgtctgttcatgtcgtttacccactttttaatgaggtttttttcctttttttattgagttgtttgagttcttgtagattctggatattagccctttgtcagatgcattgtttgcaaatattttctcccattctgtggtttgtctgtatactctgttgattattattattatttttttttttactgaacaaaagttttgtagtttaattaagttccattggtgtattattttgttgcatttccttttgagggtgtagtcataatttctttgcctagatcattgtccagaaaagtttttcctaggtttacccctaggatttttatagtttcaggccttacaattacgtctttcatcctttttcagttaatttttatatatggtgagagatacgggttcaattttatgtctgtgtatatggctctccaattttcccagcaccatttattgaatagggtgtcctttcctcactgtatatgtatttgttactttgtcaaaaatcagtatgttgtaggtatgtggctttatttctggcttctccattctgttccattgatctatgtgtctatttttatactagtacccttttattttggcttatagccatgtagtataatttgaagtcaggtaatgtgataccttcagcttcatttttttgcttaggatggatttgctagtcagacttttttggttccgtatgaattttaggatttacattggtaatttcataaaaattgtgttgaatctgtagattgttttgggcaggatggtcattttacacaatattcattattccaattcatgagcgtaggatgtttttctattttttttgtgacatatatgacttttttcatcagtgttttgtagttctcctcgtagagacttttttacctcttagtttaaatgtattactattttttatattcattgtaaatgggattaagttgttgatttgattttgagcttgatcattattgttgtatggaaatggtacttatttttgtacattggttttgtatcctgaaactttactgaagtagtttatcaagtctaagaggctttcagaggagtttttagggttttctaggtgtaagattatatcataagtgaagaggaataattcaaattcttcttttcccatttggagaccttttattcctttatcttacatgattgttcctgataggacttccaatactacgttgaatacgagtagtgaaagtgggcatcctcatcttgggtccattcttagaagtaatgcttacgattttcccccattcagtatgttattgactgtggtttgtcatatacatggtttttattattttaaagtatgtttcttctatgcctagtttggtaagtgtttttatcataaagcgatgctggattttatcaaatgttttttctgcatcaatttattttatcatacgctttttgaaaaaagatttctgttaattttgtgaatcacatttttgattcgcatatgttgaaccatccttgcatttcaggaaaaagtccacttttcattgcgatgaacctttttatgtgctgctgaattttattttctagagtttttttttttttttttgaggatatttggatctatgttcatcagggatattaatgtgtagttttctcttttatttgttatgtacttgcctggctttggtatcagcatgatgctgacttcatagaattagttgaagaggattccttcccccttgattttttggaatagttttagtagagttggtatcatttcttcctttttggtttggtagaatctggcagtaagttcatctttttgttgttgtcatcaggagattttttaattattattactaattcaatttaattgctcattattggtctgttaaggatttctgtttcttcctggttcaaacgtgtgaggttgtatgtttccaggaatttatccatttcctctaggttttccagtttatgtatgtagagatggtcatagtagtctctgatgatcttttatgtttctgtggtaatagttttaatgacaccagtaatatttctgattgtccttatttgaatcttctttgtttttggttaagctactagtaagctatctatcttacttatattttcaaattacaactttttatttcactgatcctttgtaatttttttgcccaaatctcatttagattttttctttgatatttactatattctgctagctttgggtgcagtttattcttgttttactagttctgtgagacgtgacattagattgttaattttatatctttctgtctttttgttgtgggcatttaatgctacaaacttccctcttggcactgatttgttgtatctcagaggttttggtatgttgtgtctttattttcattcatttcattttcttaatttttttttttttgtttttggggacagaatctcactctgtcacccaggctggagtgaaatggtgtaatcttggctcactgcaacctctacctcttgggttcaagcagttctctggcctcagcctccctagtagctgggattaaagacctgtgccaccacacccagctaattttttttatttgtaatagagacggggtttcaccatgttggccaggctggtctcaaactcctgatctcaagtgatccacccacctcagcctcccaaagtgctaggattacaggtgtgagccaccacacccagcctcatttcaattaaaaaaaaaatctgccttgatttcattattgaccaaataattgttcaggaacaggctatttaattttcatgtatttgtgtagtattgagaattcttctaggtactaatttctatttttattccactgtactctgaaaaggtacttgatattattttgagttttaaaaaaaatcattgagtattgccttttggcatagcatgtggtcagtttttgaaaatgctgcatgtgtacatgagaagaatgtatattctgaggttgtagggtaaaatgttctgtaaaatgttctgtaaaatgttcgtcagatccattgggtctaatgtccattgtaaaagtttctttgtcgatttttggctgccatgatctgcctagtgctgtcagtggattattgaaagaccccactactgttgtattgctatctattttgttttccttaggcccagtagtgtttgttttatgaattggggtgctccaatgttgggtttatatgtttggaattgttatatcttcttgtttaattgatcctttatatgataaccttctttgtcattatttatggtttttgatttgaaatttgttttatctaatgccagtataactactactgctctgatttggtttgtattttcatagaatgtctttttgcacccctttggtttgagtctgaaaaggtctttaccagttacttgagttaggtgggttttttgtatgcagcatatagttggatttttaaaaattcattctgccagactatattttttaagaagagtgtttagtatatttatatataaggtcagtattgatttttgaggggttgtttctataatattgttaattatttcttaattgctttgcagtctcaattaggtaattttaaaataagatctgtaagttttatactttgtgtgtttccataatgataagtattgctctttcatttctatatgttagaactccttcaagcctttcttgtagagtcagtctgtttgcgacaaattcccttagtgtttgcttatttgggaagtactacttttcttcttgaattataagtcttagttgagcagtatacaaaattcttggctggcatttttttttttctttaagagactgataataagaccctaatttcttttggcttgtaagattcctgctgagaagtctgttgttagtctgataggattctttttacaggtaattagatacctctctcttgccacgtttaagatttttaaatttttgttgactttgagtagtctgatgactatatgtcttgtgctggttattcttgcaatgcatctcacaggaatcacctgagctttttatatttggatgtctggatctgtagtaagtcagggaagtttttgggagttattctttcaaacaagtttcccacacttttaactttttcttcttctccctctggaataccaatgattcataagtttgtatgcattccataatcccatatgtcctgaaggttctgttaggtttttcaatttacttttctatgtatttttcctaccaagtttatttgaaagacctgtcttctagctctgaaattgtttattctgcttggtctggcttattgttaaagctttcagaagtattttgcagtcccttcaatacatttttaatttttagaagttgtgtctgcttctcgtaataaaatctttctcttcttttataccctatgttattttttttcatttatttttggtaatttttaactttcttttggatctcaagctttacataatcccatattacttgaaggtcttatttctcgaagacttctttagaatcaatattttggattctttatcagcatatcaaagatttcattttggtttggattaatagctcaagagtcattgtggtcctttggacctttaacaatctatcttctttatacttccagaattctttctctggttctttctaacttagataggctatctctccttattttgaatttattttgtttgaattaggttttttccatttgaaaatgtggctataatgtgtgttatgtaggatctaacaggctatattgaagaggatagagagaaaatgccagaaagggaagtgcaacagtcagcacagcaagttattttcaggagtagtgctacaaaagaaacagacaaaagttgtggttgatagcaaagttgtggaataaaacttctgtttatgttcaatgctagacgtaatagcatgcttacatactgatgagaatcatcagtagagatgaaggaaactgacaatgcagaaaagagggaaagcaattacagaggaagatgaaaagagattaaccaggacacagagtttttctctgtacaagaagggaaattttctatgtgggtaaaaggcaggtaaatgtgtacctgtagtgatgaagaatattgaacttttttctgctgcttctactttctttgttataaaaaaggaatgtaatcagatgagaaagaggaggaagaaaagaaagagtctttggatcagaaaatgtgaactagtaatcctgaagattaaagaaacatactgacagggaaaatggactagtagaatattggacgattgccctggaggccccctgaatgtctgtgcttatgaatttaaagtgagcacagtgagatgtttgaattctttcctccagggatgcagctctttgtatataggttcagagaaggcagaggattagatgaaagcatttttgcttgtctagtacagtaaaggatgagatggacaaaaatttacagaatatatgcagatgagcaattataacaaaagatcatgatgagaaaggaagtgaagaggtaaaactagatatgacctgtgaagaggttaggggaatcatagcctaaagagctagggctggagcttcttgtaacagatatattaaagggagtaaatttaaaacttaggaggtagttatgaggactgggatggccaaaatggagaattttaaaagtgggtactgatgaactgactgtgggtggaagactttccagaaaagaggtcaagaaactgaaaggccagagaacattgggagcataatctatatgatctatatttcctaaaataactaggaaaaagggcagaaataattttcacaaaaatgacagggagtttggaatgaaaattgtcaagaaatgatgagagttgtgatgtgccattctatagctaacttcagcaaggaggttagagaatagtatggtagggtggtgcacttcttcttgggacctagaggtctgtcagaagaaagactcagatctggaagtggtaaaaatgaaagatcaatgagaacttctacatttcaggcccattgatgtggaggttgtggaaggaaaaagcctacaggagagagttacatggagtgtcattgggagtaagccaggctttgtttagaacaagaaagtgaaagggctacaaagaatgtaggaactaaatattttgctggtaacaaatatgagtttccctgggaaaaatgaaagggtttgagtaatggaaaaagagtaagagagtgagtgggattaagggatgtagtaaaccatgtggaatgagagccttggtacccagacaggatctcaaaatcttgacattctgctggtgacaggatgtgaggcatgatgtaagtttatgacaaacaaaacatcaattgaaaaggcccaaaggagggtaatgtttcagaacttttttaaaaaactgcattttagtgggttagctagaaaagatttgtctcatatacacaataaattagagctgttcttcagtcttttgcaaacaggaaaacaagcattccctacctgtgctatctattgttagggtttcattaggtctaactggaaattacctcaagaaacagcaggtcatgatggttgattgtcattagaaagaacaacagaggatcaatgtaaatgaaatctcttaaattaaacaattaaatgaaatagcacatttaacttcttagggtgccttttgtgatgaattcatcctgagagaggtgccagctgctcaatatcatatgtaaagcaggagtcacactacagtggtaaataacttacatgataaccatgcacgagcgtgtgcacatcagtgaggatgtgagtatgagcaggcaagaagtagtgtgagtgtgcatgcatgtggatgtaggggtgagtgtgtgtgattgttattgtatatgaatattaccatatcacacacattcatcatctccactgaattgttgaagatttcaggccagctcttaggaaaatatcctccctatctgcaagtccccccaagtctcctgcatgccaccccttcccctgggtgaaaatacagctcaataacaaatttcagtttaccttgtgtgtgtagtataccgacaaagtgtaacttctgaaaatcaagtacagtgaaaaatacatgtcaggctattgtcaaaaaactcaaccagggttgaagtgcaatctctcccttcccaaaatctcctttgagaaatctgatatttgagagtaataactaaatagataagttaaactcccctttctactgatttcttcttgaccatctctttatgaaataaacttcctcctaaatagcaggcatggattctgtattcatttgtttttatgctgctgataaagacatacccaagactgagcagtttacaaaagagggaggatttagttggaattacagttccacgtggctgggtaagcctcacaatcatagtggaaggcaaggaggagcaagtcacatcttacatgggtggcagcaggcaaagggagcttgtgcaggaaaagtacgcattataaagcaatcaaacctcatgagacttattcactatcatggaacagcatgggaaagaccacgattcaatgatctcccactgggtccctccaacaacacgtgggaattatgtgagtaaaattcaagatgagatttggtggggacacagagccaaaccatttcattccacccctgtcccctccaaatctcatgtcctcacatttcaataccaatcattctttcccaacagtcccccagaatcttaactaatttcagcattaacccaaaagtccacagtccaaagtctcatctgagagaagtcaagtcccttccacctatgcacttgtaaaaacaaaagcaagctagttacttcctagatacaatgggggtacaggcattgggtaaatacagcctttccaaatgggagaaataggccaaaacaaaggggctacaggccttatgcaagtttgaaatccagcagggcagtcaaaacttgaagctccaaaatgatctcctttgactccatgtctcacatctgggtcacactgatgcaagaggtaggttcccgtagtcttgggcagctctatccctgtggctttgcagggtatagcctccctcctggctgccttctcgggttggcgttgagagtctgcagcttttccaggtgaatggtgcaagctgtcggtggatctactgacagcttctgggatctggaggatggtgaccctcttctcacagccccactaggcagtgccccagtagggactctgtgtgatggctttgacctgacattttccgttcatactgccctagcagaggttctctatgagcaccttgtccctgcagcaaacttcttcctgggcatccaggcatttccatacatcttctgaaatctaggcagaggttcccaaacctcaattattgacttttgtgcacccacaggctcaacaccacatggaagctgccaaggcttggggcttgcaccatgtgaaggcacagcccaagctctacattggtccctttcagccacagctggagcagctgggatgcagggcaccaagtccctaggctgcacatagcacagggaccctgggcctggctcaggaaaccatttctcctaggattccaggcctttgacgggaggggctaccatgaagacttctcacatgtcctaaagacattttccccattgtcttgggaattaacattcagctcctccttaggtattcaaatttctgcagccagcttgaatttctcctcagaaaatggggttttcttttctatcacattgtcagactgcaaatgttccaaacttttatgctctgcttcccttataaaactgaatgcctttaacagcaccaaagtcacctcttgaatgctttgctgcttagaaattttttctgacagataccctaaatcatctccctcaagttcaaagttccacaaatctctagggcaggggcaaaatactgccagtcttttcactaaaatatgacaagcatcatctttgctccagtttccaacaagttccttatctccatctgagaccacctcaacctggaccttattgtccatatcactatcaggcttttagccaaagctattcaacaagtctctaggaagttccaaactttcccatattttcttgtttttttctgagccctccaaactgttccaacctctgcctgttacccagttccaaggtcacttccacattttcaggtatctttttagcaacgtcccactctaccggtaccaatttactgtattagtttgtttttacgctgctgataaagacatacctgagactgggcgatttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcaattatctcccaccggatccctcccacaacacgtgggtattatgtgagtaaaattcaagatgagatttaagtagggacacagagccaaatcgtatcagattcattgtcctcagtgtagttttgtgccctcagctgtgctaacaaagtgctgctgtcctttgtcaaagcagggccaaaacacactttctgtttattgtctctcctaatagataactattttagatttaactttcaatgtattatgtttaatttagtttttgtcttttaaaattttataagcgctattgaattcttttcagaatctcaataaatggcagttctctggcaaggtatagaggcaaatatgtgtacatgaaactgaggtttagagtgctagctcattgtgttggattcttataacatatgagataagcattatcatgcccacttagcaaacaaggaaactgaggccaagagagattaagtgatatacttctacaagtcatttggatgagagaaagcataatttgtctatttactttcaagaatattaactagcatggtatctcttagtaggtgcttagtgaatgtttcttgattgatggtggttacttagctctctgaaaaaaaccatccaacacttcgaggagaaaaaaaccctttttatcagttaattcaacatttcagtaaaagtgggttatttgagccacagtcatccacctcatcccagctctcctcctttactaatgaaagataatttcatttctcttggtatgtactaagttatcacagggatggtagtgtcatcagtttattgaacacagaaaaatggaattgtagaaatgtaagagtgagtgaatttccaagtgaggatacaaatatgctctgtagctttaatgtgacagtcaaatacattagacactagaatacagaaaagttttttgacccttctggttgtataatataatttacgaatcatattaataagctattctgttaacattgatgacagaaataaggtggtaaaaagaggtctgctaagaattactcctggataaaagtatataatcctttaataggaggtaccttgactaaatagtccacacaaaatcattttcttcataagcataataaagtctattccaaccactttcttataggattttcataaggatcaaatgtgaacatatttgttaaactgccttgaaatcataaagcatttaataaataaagaaattattattattatcactcaggtgtttaccttttaaaacagttgaaaatgtaactttatataacgtgggaaattcacttaagagtattcattctaccagggagaggaatgatgctgataaatgttttgatattaactcagtttgattttttaatgacatgtattatttctttgcctttatcatatttcaggattgttcaacctgaattgaaagcacttgcaatgggtttccagtcaatggttataagaacactaggtatgacaaatatatagattatacattttaacatataaatattaatgttaaatactaaagactgaatgcaattaattttcaactataagactgtataaaaaagaataggtaagaatcatttctattttgtgataagtgaaaataaaaaggaacgggaaaattgagtggtctaaaagataatttgatgttaattctagttagagtcaatctgttaagagcaaggaatcatcatatttatattatattctttctaacagaaacagaaagataggtggtctctgaggttttccttctttcaggaaaataagaatatttctcccaggtatacgcagagaggaggaccttccttccaaatggagacattacttaggacagccctaaagtagcttgggaaccctgggaatctggtcaggctgaggttgtctagaacaacagaagctgacattcactgtgccatttcccactgcctggtcctctatggctggacagctaaccattagcaggagttaatgcaaaagggaatgaaaattcatactctagaactaggcttgttggattatgaggatgtcctgaataaaagaaagctcagaaaattgtggtttatggtggcaagggtaggattttagactctagaggctaaaggcctatttctaaatattcaaaagtgatgagaaaagatttaggaaatgaacctttgtcccttattgccatttgccttttttactgcacagatacttgttgttaaataatgtctagtctaacctctgtgagtggtcctttgtaagaattgtaaacattatgtgcttattcctgggaagtaggaaaagggcatcattcatctagggattggtgcagaggactgattatggtccataggtaaccactgatggcagaaggaaaaggaagtgggaggggtcagtttctgggacccttgcaaggaaaggaaaaagtataactctatggccaaattaccgtgaagaagttgtacatgaagtgtattcggtgagaaggtcacagatcctgaaatgtaaaaggaaatataaaaggaataggagagagaagatgaagatgctgcagggttgcattgcctccatcctaaccgtccctttctgtgtccctaatcttccagcctctgtaatcttagcagttctctacctccagattcagagacgatacctcactcctggaatctgggccacagaggctgaaaatagcatctgggtagttaggactccttctgatatgttgaaatgagactatgacaatagaagacattgtttaagcaacataaaatagaaaaaaattgaattttgccattctaattgtgaacatccaattttgttatgtccaatatatggcacaatggaccctaaatgcttctgtgggaaacatccacacttggtagcaaacttccaattcatgaacaattgtcttaaatatgatatatgtgtaaatggtagaagacctatatagtgtattaaactaaaagaggtatttagaaaataggttatcagaagatttacaattctaataagacaaagtttgttacttaaaacatttacttcacaacgtttgtttaaaccagtggcataacgtgaagaaaataaattgttggcatctatttttttttatttttctaagggtcgctgtgattttttgaaatctgcaaatttctcacccattatctcagtaccagtttgcttcagatgcattggcctcagacaacattcccttgtgaatctactatttctcagtctcagaaaattgagaatgattaaaagtaaaatgaatcggtaaaacattcatgtataaatcactgtcattttttgtgacaaaataaaatctgaaaagtatgaatcacaaaacagaacaagaacaaagtaaaatcttgtatgcttcagttctgccatctgaatgatagctctctactatgatgtccctcaaaattttgaacaaattacctattcttaaaactaggagttaatctcagaatttatacttctcctataaacaacatatgtatccctggaatgcctcacagtcatcgaaatcaggcactacaaataaaaattgactttgggacagaccactgaaaatatatgcaccattgtgcactaacagaccactaacagaaacaaaatttagcaacggagaccctaacctgcagcccaggttgctttaggaggtattaaaaagtgcatgaaatcaatggagagaaaatgctgaattgtgggctctgatggcactaagaaagagagaattgggctctgagcctagaaggaagtaaaactggccaatagctcggagcaccccgtgaagctgggcctgaacttctctggggagggaatcctggtgtaagcatttactttttaattatcttaaaatagtattaaaatctcctgcctttacagcagtttagatgagagcttttccttttctcaagaagttataatttaactgtcagtaatccagccattcttgcctaagaaaaattccatatgaaccaacataactttcatgttttactaacaacattcccctttttaccaatcagacttaagttaataggtattgtaggaagaacagagtatataggcatataatactctttcttccctctgtatatagggagagaagagtagatcaaatacatctgtgacattaccatatgatttaagcctttgcgatttctaataattttgattcctgggtggatgtaagccaaaccaatggaataattttccaaaactttaaacttgtattaatccaaaatgtatcaatatcgactatcgctcagttacatttgaagcatttcacttggattgatatctttttatctcatgttgcaggaggaattctagctccaatatattttggggctctgattgataaaacatgtatgaagtggtccaccaacagctgtggagcacaaggggcttgtaggatatataattccgtattttttgggtaagttgtcgtaaacacatttcattaatagattttttctttgtctatgttaatgtctaagatatagcatttttagtgtgatcgtaatattaatgatagctaccatttagtgaacaattactttgtattcactattgtatcaagcattctggtatctcattttaatactcatagaaactgtaggaaatgtatatattcctcctttttccttaaatatgaagaaaacaagattgaagaataatgagtaacttgtcaaaaattgcacaactaaaagaaatacagctaggatttgtacttgaatctcttttgattacaaagctctctcccactggcttctccaggaagacacagaatgaccagctgcagctctggttatatggtaattgaggaaagaaatggaaaaacaaagtttcattactcttctattcataggcagaagtatcctgcaagtgacattaagacaactagattatctggaagaaacaaaaagctgctgcaattgtaccttacctcttatagaagcattaatttgtaatttatatattgatcaatatataaatttgatttctgaaactataagtattagaactactcatagtagaatttcttttaattatctaggaagaataaatgtgtttgtaagtatgacccaaatgcctgaaagtataatagaaaaataatggtgaaaggatttatattgctttgtgtatatacccaataataggactgatgggttgaatggtaattctgttttatgttctttgagaaatcgtcagaccgctttctacaatgacagaacttatttacattcccactagtagtgtataagcgttcccttttctccactatgtcttcagtatctgttattttttgacccactaaaaatagccattctgacttgtgtgggatggtatctgattgtagttttggtttgtagttctctaataattagtgatgttgaatcctaattgaactaatgcatgaacagaaaaccaaatatcacgtgttctcccttgtaagtgggagctaaacattaagtacatatggacacaaagaagggaacaatagacactggagcctacttgtgggtgcagagtgagaggagggtgaagaaacaaaactacctgtaagtgactatgcttatttaaaaagagaaagagaacaagaacagataataaaatattttaaaaactgcattacacaacgtattgtaagcaaagttcaacagcaaggggtaaattagaagaatttataattcagagatagacacaaccaaatgtcctatgtatataaggatctcttaaaaatctccaaaaacaggccggatgcagtggctcacaactgtaatcctagcactttgggaggctgaggcaggcagatcacttgagaccaggagttcgagaccagcctgacaatcatggtgaaaccttatctctagtaaaaatacaaaaaaaaattagccaggcattgtggtacatgcctgtaatcttagttacttcagaggctgaggtgggacaactgcttgaacctgggaggtggaggtggcagtgagctgagatcaccaactgcacactccagcctgggcgacagagcaggattccatctcaaaaaaaaaaaaaaatcaatgcaaacatcaaatgctagcaagaatgggaaacaacaggaatttcctgtcattgctggaggtgatgtaaaatggtactggagtgttggaagacagagtgaaattttcttacaaagcaaatagagttattgtacgattaagccatcatgttcccaggtatttacataaattagttggagacatgtccacaaaaaaacctgtacttgaatataaaaaagtggaagcattgaagatgtccttcggtaggtaaatggataagtaaactatgttacattcatatagtggaatattagtaatcaatgtattagtctattctcacactgctatgaagagctacctgagactgggtaattcatgaagaaaagaggtttaattaactcccagttccacaggcttaacaagaagcatgacttggaggcctcagaaaactcacaatcatggcagaagcctaaaaggaagcaaggcatgtcttctcctagtgacaggagagagagagggagagagcaaagggggaagtgccacacacttctaaaccaccagacctcatgagaactcactcactatcttgagaacagaaagggagaaatccacccccaagatccagtcacctcccaccaggttccttctccaattcaacatgaaatttgggcagagacacaaacccaaaccatatctttcaatccctggtcgttcccaaatctcctgttcttctcatattgcaaaatacagttacccttctcaacagtccccgtgtcttaactcatttcagcattaactcaaaagcccacagtccaaagtctcttctgagacaaggtaagtcccttccacctatgagcctattaaattttaaaaagttagttacttctggccaggcgcggtggctcatgcctgtaatcccagcactttgggaggccaaggtgggtggatcacgaggtcaggagattgagaccatcctggttaacacggtgaaacctcatctttactaaaaataccaaaaaattagccaggcattgtagtgggtgcctgtagtcccagctacttgggaggctgaggcaggagaatggcatgaacccaggaggtggagcttgcagtgggccgagatcacaccactacactgcagcctgggcaacagagcgagactctgtctaaaaaaaaaaaaaaattagttacttccaagatacaatgggggtacaggcatttggtaaatactcttattccaaatgggagaaattggccaaaacaaaggggttacaagccccatgcaagttcagaacccaacagggcagtcattaaatcttaaagctccaaaatgatctcctttgactccatgtcacacatctagggcacaatgatgcaagagatttgtgcccaaggctttgggcagctccactcctgtggctctgcaggtacagtccccatggctgctttcatgggctggtactgagtgcctgcagcttttccaggcacacagtgcaagctgttggtagatctaccattctggagtctggaggacagtggccctcttcttatagctccactaggtagtgcctcaatgggaactctgtgtgggaagtccaaccccacattttctctctgtactgccctagtataggtttttcatgagggctccacccctgcagcagacttctgcctggacatccaggctttttttttttttttttttttttttttttttttcttgagacagtgtcttgctctgatgcccaggctggagtgcagtggcatgatctcagcttcccgtaaccaccgcctcctgggttcaatcaattcttgtgcctcagcttcctgagtaggtgggaccacaggcatgcaccaccatacctgactacttttcatgtctttagtagagatggggtcttgccatgttggccaggctggtcatccaggcattttgatacatactaggaataggtcccaaacctcaactcttgctttctgcccactcataagcccaacaccatgtgaaaggcaccaaagcttggggcttgcaccctctgaagtcatggcccaagctgtaccttgactccccttagccatggctggagctggagtcagtgggaaataaggtgtcatctcccaaggttgcacagggcagcagggccctgggcctgacccacaaaaccatttaaccctcctaggcctccaggctggtgataggaggggcctccattaaggtctctaaaatgtcctagagatattttccccactgtcttggctattaacatttggatcctctttacttatgcaaatttctacagcaggcttgattttattctcagaaaatgagtttttcttttctaccacgtggctgggttgcatattttccaaacatttaaatgtaagttccagtttcagataatctctttgttcacacatatgagtaaacacttttagaaacagccaggtcacatcttgaatgctttgctgcttagaaatttcttccactagataccctaaatcatctctctcaagttgaaagttccacagatctctagagcagggacaaaatgccaccagtctcttagctaaagcatggcaagagtgacctttactccagttccccataagttcctcatctccatctgagacaatcctgaacttcattgtccatatcactagcagcattttggtcaaaaccattcaacagtctctaggaagtttcaatctttcccacatcttctgtctccttctgagcactcctaactgtttcaacctctgctcgttactcagttccaaagttgtttccacattttcacatatccttatagcagtgtcccactcccagtaccaatattctctattagtctgcctcagaaaacttacagtcatggtggaagggggaagcaagtcatgtcttctcattacaacaggagagagaaagtgtaaaaagggaaggactacacacttctaaaccatcagatctggtgagaactcactatcatgagaaaagcaagtgggaaatccacccccatgatccaatcacctcccaccaggccccttctccaatataacatgggatttgggcagggacagaaatccaaactatatcaatcaataaaaagaaatgagctatcagcctacaaaaagaaaaaaatgaaacttaaactcatatagctaaataaaagaaggcagtccaaaaaagcttcagattgtataattttaactgcgtgatcttgtagaaaaagcaaaacaatgggcaacaaaatcagtagtttcttggggctcagtgtggagaaggctggaatgagtaggcctagcacaaggaatttttagggcagtgaaactattctatatgatattgtaatattggatcatgacattatgcatttgccaaacctatagaactttacaacataaaaagtgaactctaatgtaaaatatgcatttaataatgtatcaatattccttcatcagttttaacaaatgtgctatactaatacaagatattaatgataggagaaactgtgtacctgttgggcagggagatctccatacagttttctggtaaaactaaaattgctataaaatataaagacaaaaaaatcacgaaacatttttcaaagaagaagtcactaatggttatgaaacatataaaaagattgcagctctgttattatcaattgtgttataattgtagttctgttattatcaatgaataagaacatgaacatcatcttgataataaaagaattataattaaaaatcacccagattgtcaacaatcaaaaatgttgcttgaagactgtgttggcaaagtatataactttgagccaacagcaatacttctaggaatttatcctaaagatatctatactcccaaaatactgaaaacaaagtaagaaccaatcaagaagatatcaattaaattaataatgtgcatgcaggcaaatgaatattctgagttcttaaaaaaaggaaaaatctttttacttactaatatggaaggctattcacaatatattggtatattcacatatatattatgtgaaaaaaggaagcattacatgaaaaatgtgtgcggaatatgctattatttatgtaaggtggggaatatttcttagttcaggttagatctctggtgaaaactccctggatctaatttactaaaagaactttcttctacctgatgtgtaaattcactgtctaacatccccaacaagtaatgatccagatttttctggaattacagtaaagcagcattcagcagcccacagacattctcttaaatttaaaataattatagaaaatctttccctaaatgggagatttctttcctccctccctccccttccttctttccttccttcccttcctttcttcctcccccttcccttccccttccttcccctcccttccccttccccttccccttcctcttctcctcccttcccttcccttcctttttttttttttttgagacgcagccccactctgtcatccaggctggagtgcagtagcgaaatctcggctcactgcaacctccgactcctgggttcaagcaattctcttgcctcagcctcctgagcagctgggattacaggcgcccgccattacggcaggctaatttttttgtatctctactagatacggtttcgccatgttggccaggctagtctcaaactcctgacctcaggtggcccgcccacctcagtctcccaatgtgctgggattacaggagtgagccactgctcccggctgggagatttcatttctatttataaaagtatggaaaaaaataacaaagaaaaacttaataaatttactttaagaaaatatttattttaattgaaatcataattcattttaaggacaactggcaagatgctccccagaatctccccgaagcaataatcaccaagtccaagcattagcataacattttgaaatggtgatactttagttatgttagtttcagtatgaaaaggccactaaaacattgttttaaaaactgtactacttctttttccttcagtaaaggtttaggtaaaagtaaaaggaaatgaaaagtggaattttaaagtataataaaaaaatttaaaaaagggcagttcatttgccagttaatacactgaaagttaaataattaccttatgatttttaatagattttattttttagaatagtttcagaatcacagtaaaattgaggagaaagcacagagatttcccatatcttgcctgctcccgcatacatgcatagccttccccattatcaacatctcccatcaggatggtacatttgttacaattgacaaaccagattgacacatgtttatcactcaggatccacagtttacatcaggtttcacatttagtgttgaactttctgtgggtttggatgaatgtaaaatgatacataaccaccactccactatcataaaaagtagtcttgctgccctaaaaatcttctgtgctctgcctgttcattcatcctttcccagtaatccctggatccctagaaaccaatagtctctttactacttccacaattttgtctgcttcagatcatatagttggaattatacattttgtagccttttcagagtagcttctttaactcagtaatatgcatttaagtttcctgtacttgtttgtattgcttgatgggttatttctttttagcactgaacaataattgattgtctcaatacaccatagtttatacatttgcctactgaaggacatcttgattgcttgcaggtttgggcaattataaataaaagttaataataaaagttatccatgtgccagtttttgtatagatacaggtctcaacttctttgtgtcaacaccaaagtgcaattacttgatcatatgataaaaatatgtatagttttataagaaattgtcagactggcttcaaaagtggctgtatcattttgcattttgaccaacaatgaatgagagtttctattgctccacttccttatccacatctaatgtctagtgttctggattttggccattctaataggtatgtagtggtatctcattgttgtttaaatgtgcatttgcttgatttccttgatgacataagatgtgaagcatctttttcttttttttttttttttttgagacagagtatcactctgtcgcccaggctggagtgcagtggcatgatctcggctcactgcaagctacgcctcccaggttcacgccattcttccacctcagcctcccgagtagctgggactacaggcacccaccaccacgcctggctaattttttttttttttgtatttttagtagagacagggtttcgccatgttagccaggatggtcttgatctcctgaccttgtgatccgcccgccttggcctcccaaagtgctgggattacaggtgtgagccaccacacccggtcatgaagcatcttcttatatgtttatttgccacctctatattttttgtggggagatatatgttaaagtctttggcctactttttaactgttttttctattgttgaattttgacagttcctaatatttttgaaaacagttattgaatatgccttttgaaaatattttctctcagtctgtggcctctgactctcatcttatccttttgacagtgtctcttactttctcagagcagaatttttttgttttgttttgttttggaaatggatctcgctctgttgcccaaacaggagtgcagtggcaccttcttagctcactgtagccttgcactcctaggctcagggaatccgctcaccttagcctcctattgatgtgatcatgtgattatttttcttagttagtccattaatatgatgaattatataaatgatttgtgaatgttgaacctgtcttccaaacctggaatatatgcctggataactgttttattcagaggttttaaattgtaatgaagtcctctttgtcaataagttctttcatggattgtgcttttgctgttgcatctgaaaagtcataaccgaatcctaggttgcttactcctgtgttacgtcctaggagttttatagttttgcattttacgttttggtttgtgattcattttgagttaatttttgtgaagcctaaattcattattttgcatgtggatatctaattgttccagcatcatttgttgcaaatactatattttctccattgtagtacctttatgtttttctacagatccattgactgtatttaagtgggtctatttctgggctatttattctttccacttacctattcgtatattattttaccaaagtcacactgtcttggttgctgtagcttcatagtaagtcttgaggtcaggtagtatcagtcctattattgtgttcttacacttaagtattgtcttggctatttagcatcttttgcctcttcacataaactttagaattagcttgtcaatatccacaaaataacttatagagattttgattgggcttgcattgaatctgtgtatcaagttgggacaaactgacatcttgacaatattgagtcttacgatactgtacatgaacatggaatatcacttcattttttagtgcttctttgatttctttcatcagagttgtatagttttctgcctatgccttttgtatatattttgctaaatttatacccaatgtttcatttttgggggtgttaacgtaaatagtaatgtatttttaatttcaaattccacttgttcattgctgatttataggaaaacttttcactttggcatattaatcttatatcctgcaaacttgttataactgcttattagttccagtagtgtttttgtctattatttgagattttctacatatacatatgcaaacaaaggtagttttattccttcctttcaatctgtatatataccattcccttttgacttttttttttaatcacatggactttctgtgtaccatgttgaaaattaatggtgaaaagggacattcttggcttgttccaaccttataaggaaagctctgagttcttcaccatcaagtaaaaaatgtgtagaatttttggtgtatatgtttttaatcaggttgataaaattctcctctattcctagtttaatgaaagtttttgttcacaaatggatgtttgattttgtcaaatgcattttctgcatctattgatgtgatcatgtgatttttttcttctttagcatgttaatataataaattatataattgatttttgaatgttggaccagtcttgtaaacctgaaatacattccacttggttgtggtgcctaaattgttaatgcaatgtcaaattcaattagctatttttgagaacttctgcacctgtatttgtgagatgtatcgctctgtagttttcttttcttgtgatgtttgtctgctttgggtattaggataatgctgacctcataggagacaggaagtattcctgctgcttctattcctctgtaggaaattgtaatgaattggtataaattcttacttaagtgttttatagaattcgcccatgaacccatcttggtttggtgttttctgctttagaaggttattatcaattcatttctttaacagatatagatctattcagatagtctgtttcttcttgtgtgaattcaggtagattgtatctttcaaggaattggtccatttctttcaggttattaaaattgggggcatgatgttgtttatggcattcccttttgatccttttaaggtcaatggggtctacagtgatgttccatctttgatttctgatattagtaaatcgtgtcctcctttttatctaaattagcctggcaagggactccaattttattgatttttttctgagaaacagcttttgtttttgttgattttctcccctcatgtcccattttaaatttcactgtgccctacttttactattatcttcggattactttggatttaatttgctcttctttttctagtttgctaaggtaaaagattaaatgattgatttaagatattcttcatttatctctaattctgctttcgctgcatccataacatttgatgttataattttattttcacttatttcaaaatatttttaaatttctcatgaaatttcatcttgacccatatgtttcttagaagtgtattgcttaatcttcacagattttgagactttccaatgatctttctgttgttgacttctagtttaattcccttgtggtttaaggacagatattacatgattttcattctttcaaatttcttctattttatttttatttttatttatttatttatttatttatttatttatttatttatttattttgagaccgtcttgctctgttaccaaggctggagtgcagcagtacgatgtcactcactgcaacctctgcttcctgggttcaaacaattctcgtgtcttggccttctgagtagcggggattacaggtgtgtgctatcacacctggctaatttttttttttttttttgtattttttcttttcttttcttttttttcagatggagtttcactgctgtcgcccaggctggagtgcaatggtgcaatctcagttcactacaacctccacctcccaggttcaagtgattctcctacctcagcctcctgaatagctgggattacaggcctgcacccccacacccagctaatttttgtatttttagtagagatggggtttcaccatgttggccaggatggtctcaatctcttgacctcgtgatccacccatctcggcctcccaaagtgctgggattacaggtgtgagccactgcgcccagccttttttttttttttttgtatttttgtagagacggggtttcaccatgttgttcaccatgttgatagtcttgtgtcaaattcttgacctcaagtgatctgcctgccttggcctcccaaagtgctgggattacaggcctgagccaccacgcctggccttaaatttcttaagatatcttttatagaccagaatgtggtctatcttggtgaatattctatatgagcttgggaagactttgtagtctgttgctgtttgatgtagtaggttacatctgttatactgttggttgatagtgttgttgagttcaactatgtctgattgaattttgcctggtgaatccgtgcatttctgatagaggcatgttgaagtctccaacataattgtgggttcatttacattaagtatccacttaacattgtccataggttcttagaaactgattttaagcaaaacaatacactatgtaccatagtaactatttttataccaattatctatggtgaaattggtttcattatacaatacataaattcacttttaaaattataatttccaagaacctgtagacaatgttaagtgaagacttactgcatttctctttgcagctctatcattttctcctcacatatttagacactccatttttacatgcttacatgttaagtattgttctgttttgtaaaaggataataggataactgatttctttgttattatgtaaagacttttttatccttcataaatttccttgctttgaagtctgctctgtttgaaattaaaaaattaaaataggtactcccattttcttttgattaatgttatcagtgtatatcttcctcagtctaattacttttattctgtatgtcttcatatttaaagtgagtttcttgtagactacatatagtttggttcttggttttaatcctctaacaatcttattgttatcttttgagatggggtctcactctgctacccaggctgtagagcagtggcttgaacatggctcactgtagcctcaacctcctgggctcaagagatccttctgcctcagcctcccatgtagctgggaacacaggcatgaactaacatgcctagctaattttttgattttttgtttgtttgtttgttttagagatgggcaactctgttgcccagtctggtctcaaactcctgtactcacttgattctcccatcttggccccccagagtgctgggattacaggcatgagccaccatgcctggcttattttggtcttttaattggtgtatttatatcattgacattcaaagtgattactgatataattgaaagaatactgacgatatttgttactattttctatttgctctccttgttctttgatcctatttttgtattccactctctgtcttcccgttttgttttaattgagcattttatataatttcattttctctcatttgttagtttattagttgtactttttaaataaaaatttcagtgattttcctagaatttgcaatatacatttagaactaatccaagtttatattttagtaacactttattagttcacagattatgagtacccttataataccaaaataaccctaattcttctttcctacacattgtgtcattgctgtcatttactccacttactgtaagcatacatacacatatgaataagcatgtatattatatataattaaatacattgtttctattattattttaaagaaactgatttctattaaatcaatttagaataatttttttatttaaccttaactgatttcttctctgatattcttccatctttatgtatatccgagtttatgacctatatcattttccttctaacaaacttcttttaagatttcttgcaaggagagtctactggcaaaacagtccctcaatttttgtttgtatgacagtgtctttatttcgacttagcttttgaaagataatttcatatggtacagaatttttaagttggtgttttatttttcttaacagttaaatatttcacttcgctctcttcttgcttgcatggtttctgaagagaaggctgatgtaatcttttctactctataaataaggtttgcttttccttttggtttctttcaggatgttttcttcatctttgattttctatagcttgaaaataacaaacctatgcatagtttttctggcctttatccttcttggtgttttttgagcttcctggatctgtggtttggtgtctgacattaattcaataaaaattttctgtacttattatttgaaatctttattttgttcctttcattttccccttcaagtattttcattataaacacttgtgtagtccttccaatgttcttggttattctgttttttctttcttttgtcttatttttctttgctttttttattgatataaacttagagattgtttcctcagcaatgctctatctaataataaatccatgaaggcatttatcatttctgttacagttttcttatctgtattctttcattttggttcttagaatttttatctctttacttaaattgctaacctttcttacattctgtctacattatccattagaccacttgacaaattaataatagttgttttaaatttccatccctgatattccctgacatatctgggtctggttttaagtcttattcttttcagactgtgtttattgtcttttagtatgtgacttgcaaatttttcttgacagccagacaaaatgtattgggtaaaaggaattgctgtatataagcctttattaatgtggtgtaaggcgatgaagacaaagtagcatcctgtagttctatgataaggcctcaatcttttagtgagcctgtacctctggactgtgaacttcaaacttgcttctcagtttctgtctcccactccttaggtagaatgagatggcttgagggggctggagttatgtattttccttcctcccaaaggaaggctagagacagctggggtttagtttctgtagcttcatatgtttttttaataatagaaaaatatcttatgcccccaatgaaaataataaatagaattgttctcttaatatttgtatgtgtaacttgtttttctttcttttaagatatgcatactggggagaaaaaaatgtaagatattttacacatttaaaataataatcgactctctattttctcttttcacagaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatggatcttcttccaacctcccattaagatcctgcagaagaaatagaaatattcaaatattgcaaggtgtaattgtgagacaacttattataatacgtgttaagtttctactggacccatggaagtggattaagaaaaaccgactttagcttgagaaagcaaaacccattgataagatgtgtcttcattgcatctgtctgttctctgggagaagcaaaatctgtgttacttccttgcatacttgtttgtttattcattgtgcacaagaagatatcttccacatcttcacaagctggataagaaatagagaaaatgagatcaaatatttaaatattgcattttctggtagtgatgcaggatatttcttggcctcttcactggactcacaatagaggtgccctgtttatttggtctgccatgctcaaccccttgtgggagggagagtgtgagtgacgaagtgcaggaccatgtgggctgtcctggtcatcgacacagaaacaagctctgtgagtttctcatggccagaccaggtgcgagtgagtgaatgctggacctgggcaaccgctccaggcactgaaacgagtgagttacatgcagggctggcagccaggcaaggtgcaagggtgctcaggatcctgaagccccagaggggttgttatggtgctcctttagttccaccgtctacagtctaacagatggcagcatgttagcagctcagttggccccttgtctctttaccttgggtggctgccctctgccagtgagggcaaaggccagtgtgacagatttttctgggtacctgcattcggtgggttccaggcccttgtctggtgtccaagaagaatgaggtcacattgacagttgaagggtggtgaaggtggagagttttaatgagtaatgaaaacgactctcagtggagaggggagctggagaggggatgggaagggccggttgtcttccccgaagtcctgctgtctcttcctcgaattcaggctgtctccccagtctaccagctgagtctggagtctttataggcacaggatggggagtgtgtgctgactggtttctgagtatgcaaaaaaggttaaagtgaaggcaccactcaaaggtgggcatgacagtatagaaaaccaattaagaaagagtagttatatctaaaatagttggagggtgggaccagtcagaggaaagcctgccaaataagaagacaacttctcaatctggtctaaggctttaacttctagcctggcttttggactttaaactgtcatcagcttggaggtggggtttcaccgggaacctgcccctatttgcctaggcatttggctgtctcctgtcactatcaggagcaacatctctacttagtgaatgctagaggttgtagtttataattctcaattggttaaaagatgttttgtatcagaatcaactgtaaaaatatattttaaaagaaatataattatatacctactgtagagattccaaattcaaacatgtgtgatatcgcttggatatctttaaaacattccacatgatgctaggattccttgatagaccaccatggtataggaaaaggtatacctgagtgtagtaaagtcacaagaaattattactagaatatgggaactggcctggaagatatatagatatatacgtgtgtatgtatgtgtgtgtgtgtatgtgtgtgtgtatatatatatctttatacctgttctcagactgtaatcctaaggaaaaaaaattaatcacacaaacagaaatttgaggaaacccacatacatgctaggtttgtaggtatcatataacaaatctaatgtgatcacatgcacacacacatatacacacacacatataatcatatatattgaatacaatgtgatatttcaatacatgtatacattgtgtaataatcaaatcatggttattagtgtatccatcaccttatacatttataatttcttaattatgagtacattc

SEQ ID NO: 14002 - DNA, 14226 bp, Human
ttaaggtttttggcccatctttaaaatcagattgtttgtgtttttattgttgagttttaaaagatacttgtatattttggataacagtcctttattggatatgtcttttttttttttttttttttttttgagagagagagagagtctccctctgtcacccaggctggagtgcagtggagtgatctcagctcactgcaacctctgcctctgaggttcaagcagttctcgtgcctcagcctcctgagtagctaggactacaggcacgcatcaccatgtttggctaattgttgtatttttattagaaacagggttttgccatgtttcccaggcttgtctcaaactcctgacctcaggcaatccactggcctcagctttccaaagtcctaggattacaggcgtgagccaccgcgcctggccatggatgtgtctttgcattcattttcacccaatttgtggcttgtgtgctcattcacttgaggaaatgccttttgattttaattcaatgcaaatattaccaaaaacgtgatataattccatttttagcttattcaagtaaagttcataaatattcattattctacaaatatttatggtgcaccttatcacatgtcaaactctgactaaggataccaattactctagttaaactgtgaccgtacagaatcaagacatctctgtaaagagagcaaatttaattaactgatctgaaaattttacctttgctggctcacagtgctcaattaccatgtaattgaagtgatatgtgattaattaaattttttagctccagcatatttggagtgtttcccatgatgtattagagtcaaaagccatggtgttctcccaagtaatgtataatataataaaagagacagacctattacaaaatgaataggcagtgcagtgggatagaaaaagcactgagctactatctgtgtgagctgggagaagtataataagttaaattatcatcttggcctcactttcatttttggtaagaatggagtcattgggctagaatctgtaggtaatggattcttactgctatacgtagaataaccattttgtgtactaaggaccaatgcagccctacctgtagctgggcagcagccagagtcagagtgattggaagaaaaaaattggatctccaagttgaaggtctagccttggaagaatctgttactataaaatgagaagcagaataagtaagccagatgaagagttaaacccgtgcttgtagatttttgttggcttggtatttttttgtgtttaattcaagaagaattagaggcagtgttccccattaagaaaagacataaactgattaaaaggagacccaaagaagggaattatcactgctctgctaagggacgtggaaggtgaggggacacagcacagttgtatatagagtggccactaatccagccacacagcagcatttccatctgcctcctgccatctttcccctgtatggagaaccacaggattttggtgatgttctatttcttgactttggtgacggttacagtatttgcttaattattatttcattatttacatgttttgtgcacttttccaaaccttttaattgttaagaatatatggtaccatgtatttaagaatacatggtaccatataataagaatatatatttaagaatatatattattctttaagaatatatggtaccataatgtcctgaatgatacctatgagagcagtcatttgactttggcaaaaaaatgaggtttctcatggagtcaatttatgcagcagacagaaaaaaaaatcctttgaaagacaaatacattgtgtgcttcctgccaataacgatgtaatacttcctcgttttagttaatgaaaaataacacatactttcaaagttctgtagactctaaaaagaaagaaaacactcaaatgagtcacctatttccacattcgaggctgagaagctatataaatttctgcagtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggtatgtcacagcccacttacttagggttccattcttttgccatctgcattaagaaatgtgtttttcaattatttcccttcccatgttagcattgcagtggaattttctttggggtggttcttcggattataaaagcaatatatgttttcatcaagtagccattaaaagcaggtttcagaatctgctcaaatcgggcttgagttccaaccctccactcactatgtagatagactcaggaaggtcatcaaacttctctaagcttcaggtttccaatttggaagttggagataagaatggtatcaaccaaatgagggtgttgtgaagcattcaacacaatacctgaaacattgtttaaattaagttcttatttttatttattataacttgagattctttttctatagtatacagaatattgcctcttaagatacaacctgtaaatatactgtttgtgtatttacaatactgtttgtaatggagatatctgaagtcagaaaacatgggtagaaattacaactctccaacaagtcaatgacaatagacaaggcattaacatctgactttgttttctcatgtgtccagtagaaaaaataatattatgtgttttatacctcatggggtattctagtaagtaaatgaggtgataacaaaaccaactagcatgtatgtaacaattgtagattataaagtacttatatagacattgtgtcatttaatccttagttctataaaaagaggaaaccaaagttaaactgattagtgtacttattagtggtagagatagaaatcaaggacaagtgcttctggttcaaaaatcatgttccttgcaatatgcttcttaataagcagtctaataaatataagcagtctactaattattatttggttaactaatgggatgattacttataactattatttgtaaatttaggccttaagcataagaaaagtcaatttttaattcacattaacttagacttttaaaaagttccagttataataagttagattgaaccacataaagttactagtatttaacttttaaaatctccaaaacagtagttttatatggttccacctaatgaattctccagaaagagtactctgcgtttagtttctttacttagagtgaaggttggcagaaacttagtcttcacttggagggatgttagctaggtttaacaaaaaaacaggaaaagtcatctcaacaaagcagagagatttcttccagagggtgtcttggtaaagtctgtagctctagaagggattaaatgggttatttgtttttaaataaaggatcagttatcaattgtcatggatgaacaataagtatttgttgtatttaatgagacaattgttggtaacaggaaaaaaagacacaatattaataagatttcttacataaattgcatattcctgggcggtcctaagacaggtaaccattaccatctactccaaataaactgcaaattagtgagccaatgtttaaatcattttaacaacaatattatcaggcatcatataaccctacacatgtttctaatgtatagaagtcagaacacttgagttcaaatactggttccttcagttactcacaaggtgatcttgtgcaatttatttcacttctctgagctgtgtttcttcatgtataaaatagggataacaatgccatacttgtttcatagagtggttatgaggtttacataaaataaatatgtaagtgcctggctctagtaagtgcttaaaaatgttcctgtgaggttgctattgttgttagttcattcacttttgttgttgttgtatttgtgctgctggattcctatcctcatattcagatactgagaaactttagagaaattcccaggaatccaaccttgcatggaataaacctgggagtcctactgtatactgcaatctcccaaagtgggtttgactagagatttaacagcagaaagaagggctgggaatggaatgagcagaaagagggaaaagaggacctaggagtcaggaaagtcaagtccagttctgctactaatttaaggtgtgaacctgggcacataaatcatttagttgctataagctttggttccttcaccggattattaaattgaactatttaataatttcctaatatcttttcccagagctaaaattttaagaccctttaacttttagctggaaccgcatctcagctggactttagatagggctggttgacctcagatctcccccacagggtctatgataacacagagaatgtcccagtcgtacccctgaggacagactggtacatgcttcctgattgctcttacacacttctaggctttataaagtgtacagtgtaattctccccaaaacatttaaatggattttttaaaaattgagggattcttttcttttgctcacgaaatggcacgccagtgcttcattagcaatattaaattttctcctcactaatgcacacttatttttctctgtgactatgtaattattctgtcttcaaatcattatttgaattcacaggaaccaaaggcaagagatatataggcttctaagataaaagaatataataaacaagaactatagattaattactctcttttcaataggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggttagttttgctctggctcattttggcaaaaacaataaagcctgtttcctaggggtcaaacattgttttcttgtttgctactaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggaggtaagaaagattcctgtaggctaatcctgtgtcctgttttgtttgttcatggtttatatcagtgctcttttcttatgaagattaaaatcctttaatgagatatgattggtagatagatagttaatagatagatttagcaatattattataatttttataatctggtaatatagagccactttttatagcagcagttggcaaactatgatgcatgagccaaatccagcccaccttctgtttttgtaaataaagttttactggaacacagtcaggctccttcatttccctattacctatgactgtttgggctcaggctgcaactgtgacagagatcacaaagcttaaacacttgttatctgaccctttacagaaaaagtttgccaacccctgttttgtaacgtgaattattatttatatatacagtcatgcactgcttaacaatgggaatacactctgagaatgagaactttggcaatcttgtcactgtgctaacatcatagaatacacttacacaaacccaggtgatacagcccactatccacctaggctacatagtatagcctattgctcctaggctgtaaatctatacagcatgttactatactgaatacggtaggcaactgtaacacagtggcaagtatttgtgtgtctaaacgtatttaaacattgaaaaggtaatgtattgagctatgacattatcacaactactatatcactaggctataggaatttttcagctccattataatcttataggaccattgtatatgtgatctgtttactgaaagatcattatgtagcacatgactatatgtttacaatatatctacctaacatcgatattaaatcaacagaaagagtcgcagcttccaaaggcctcaagagtcccctgagaagtggtatatgacctgttgctaatgcctttcatgtggcaaggaagtaggaaatggaaactttcatattaaagaacttaaaaatatataacacagcagggtgtggtggctcacgcctgtaatcccagcacttcgggaggccaaggcaggtggatcatctgcggtcaggagttcaagaccagcctggccaatagggtgaaaccccatctctactaaaacaaaaattagctgagcatggtgacgcatgcctgtaattccagctgcttgggaggctgaagcatgagaatcgcttgaacctgggaggcagaggttgcaatgagccaaggtcacaccactgtattccagcctgggcaacagagcaagactatgtctcaaaagaaaaaaaaaatatatatatatatatattttttttttttacgtgggtttttctatatgtaaaacccatttttttagtatatgtgttatatatgtgtgtgtgtgtatatatgtatatataaaacccatatacataaattgttcttaattgctagtgtttcatggtgcaaatttagagaaaaatgttgcccatttcagtctgttctatgtggaatggtccggctactgtagctgaaatttgaacttcaacccacaatattgacaacaccgaagaaaatgttatgggaaagcactaatcatggcactacaagttttttaagagctagataaactggactggcctcatatcacctcgaagataaccagctctgcatcacacattaaaggactataaaaagccattttaagagatcttgagcatggctctctaagagactatttactatgcccacgaagaataagctaggtttttaagaaaaaaaaaaaaaaaaacctatgaaatggtgcacaaattacttgccaaatgtggtattcatattcattctccctcccaccaccctttggccgagcaaagtggtcaaatttaacaaaagcttaaatgcaaccttaagttagatataactgcattttaagtcctgtatccagtaagctttcaatatatggtgattatcagtgatgagcaatggttctgtgaaaggaaaagtgtctgggccaagaaagcacccaaactaccctgtgagtgcaaccgacagcacataacaatgtcagctacttgcactgggctgccttttttttttttttaatttattttttgagatggagtttcactgttgtcacccaggctggagtgcagtggcgcgatctcagctcactgcaacttccgcctcctgagttcaagcaattctccagcctcagcctcccaagtagctgggattactacttggtggcatgtgccaccatgtccaaatttttgtatttttagtagagacggggtttcaccatgttagccagacaggtctcaaactcctgacctcaggtgatccgcccacctcggcctcgcaaagtgagccaccatgcctggcctggactgggctgctttttctagcctcaataatcgtataaactgaaaaataaaatgactggagaaaaaaaaaatcagtcactaagaacaatcactccattttctttcagctcatggggactcctacccatttgatgggccaggaaacacgctggctcatgcctttgcgcctgggacaggtctcggaggagatgctcacttcgatgaggatgaacgctggacggatggtagcagtctaggtatagcatctcatgtctcttctactccacatccgttttaaaatcctggacttacactaagttaaataattatattaatttataataagtattgagcccttgctaagtgccaaacactgtactatatgcctgaaatgcattatttcatgtaatatactcataatgctacacacagaagatggacactcaggctatggagtcaagcaccactgatccaatttgctgtacgtctaccaattactctgtgtcattgggcaagttattgaatttctctgagcctcagtttcctcctctgtggaatggaaatataaatagttcccacatcaaggagtctttaaattaaatgagataatgcttatacagtgcttggaatgtattaataattaattaaattatagctctttcttcatatttccaaaaaatacatgccccaaatggaaaagaaagagaagtagaaactatgatatttgagaagtatatgcaattctggaattattcactattttccagaaagaaccaactccatgatttagtatatcatatttatcattttacatagtaggatattataggcacatgagagaactaatggagaagagctctggcataaataatcccaattagagacaatttttttaaggctaccaactggccctaaaagggaaatttgtacttgtgtttggcaaaaggaattcaccatagcttgctgtcttgctgtgaaaatctatgttaaattgtgatgctgcctcccatttgcatctggcatattcttttcattcttctttcttcccacttaaggtaggttaaaggcagcttccttcaattcaatgcaacgccaccagagctcaggccactcctcaaacgcacgggctcacaccttccacatacttgcaaagcctttcaatgagtatgagggagaacaaaggatatatgtaatacaagttaatgaatcaaaatcaaaaacaaagcccagcattgcctagagaccctgcctttcaatcttcgctttctcaaagccaccattctctcttctgatatccaaagtcactaacatttattgaatggccgtgacttcccaaatattgagaaactctagctatcatgacaaatctagagggcagaaattactgtctctgtttaacagatgagaaactgagactcagcaacatcaattaatctgtccagagttgtccagctagtaagtagtggagctacatttcaaacctaggtcttagtgcttttaaaacctttgctttccactgcagagtattgctgcctgaatgaaagaagcaaataaaaaaaattacacatttttaataagcagaagtagtgatgagattaaagcactcctattctgattaaccttctaacccctctccacttttgaaagcctagaaacaaataagtaagctaccgtgggctaaaacttgggtatttttctttagtttttttaaattatgatatcatatatataatattacataatgtatgtagctatttttatcattactgtttgtcacttcttcggttgtagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggtaatatttattatttcaaataagaggatttcccattttctttttagagtggggtaggaaaagaaaggctgggaaatgggtatttacctggaaaaccacactggaactcatatcaaaaagcctattgaggggaggaattggggaccttagatacttaaaatataactaggctgtaatatactatgaagatgttgattgtgagtttcagtaacatagtatcatgtggtaaaattatgcaaatgatattgtccagattttcttcaagctgccacccactgctcttcctctctcagtttaaatagtttaggagagtgtcccctgtaggggtggactgaagggacaaaacacctttcttcatagctgcccactcctaaggattcaatcctagataattataagtgaccctgctcttcctgtttgcacgtacatgtagagaaagcggttaaccacggacagaaactgcttatcattcctggtcttgatacttatgtatatcccttgccccagtctatgcttttttggtttaatcaagttccaaattcagtttttttaagtgcactgatttggatttactgtattgagtcagccaaaagtagtatttgagaaagaaatcaaaggacaagaataaaaagctctgtctctggataaagataaggaaagtaagattcaaagaggctaagtggactgtccaaggtcatgtgactgtcgagtgcttgagccatgattccaagtgagggctatgtgacttcatactttttctacgacatattcctgcctatcactacccagtaagctttttatcctagtaagaataaaagaatacagaatgacatctttaaatcagcagatataactaaacctagccagtaaaaatatcaggatgaagagaatacactgcaaaaagatcacttaagattcttcaaatgatcacgtgagcaatgaaagtgcttccacataatagaggactgtcctcaggggagaaatattccagtaagacactggatttaagatatcagttcaacctagcatttgctataaatcagcatgtcccaaactgtattctcagaacactagtcctacagggtgattcccagaaaaggaggctatggagaaataagttcaagaaacactacctactgtatttcaggtgtatagactattagagagtatggagtattgaacaaatgtttaactcagtgtttcctaaattataatcctttttatgggtctcaatgagtcccataaactagcacttcagagaacacactttggaaaatgctgtgtaactattcccaaaagttacgacgtaaagaaccactgctgtccaaaagattcacaaaatgctgactattgttcgtaaagttatcatgaacaaaactgaaaatactatcctccccttacataaaactgtggaactcatggaatattctatagcagtctataaatattttagaaccctaagaaaaatacaaagagactaaagaaggtctgaggcatgctgattaaatttaacaggaagaaaagagactagtgcattaaaaccttaagtattagacaaaagggcatctctggtcagagttggaaacaagtaacttctggacaaatggaaatagaatttaattatgtgggctgtatatgtagggagttaatctaaaaagtaatatgagcagaaaacatagattccaaagaaagtgattaagatacaagattcctaatgctatactcagaatgataaaaataatagctggctgggcgcggtggctcacgcctttacccagcacttcgggaggccaaggtggttggggatcgcttgaggccaggagctcgagacctggacaacatggtaaaaccccatgtctactaaaaatacaaaaattagccgggcgtgaaggtgcatgtctgtagtcccagcaactcaggaggctgaagcatgagaattgccggaacccaggaggcagaggttgcagtgagtcaagatcacaccgctgcaatccagcctgggcaacagagtgagactccatctcaaaaaataaataaataatagctaacatgcattgagtacttgcagtatcccaagacttcacatggattaactcatttaattcaagaattcaatgagacattattatccacattttacagatttgtaatctgatgctaagagaggttaagtagtaaactacctaaggtcacacatctagtaaactggtagaaacaagatgcaaaggtacctgagccctgggcccacactccagtcaatcctgccttcttagcctctggaggttgttcttcagaatctttgtcccagggacaagaaatggtctgagtgaataatagattatactttctgtgacatttcctttgcctgtataatcttaggatggtttttatgcattttctacatatcagaatgttctttttttttctctcaataggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttatttatagtttggagcactctttctgtgaagacatactatacaatgaaacgaaagactaagacaaaaaaagaatcccaccacactattttgaggtcttccgcagcacctcacccttccacccaagagggaaggtgggagctccacctctttattgttcattagtgtggcccaaagttacactaatttccccttacctttgtggcccgtgctctcacactgagtcctctggaaagtccaattcttcccacaaatgtctgagaatttccaacaacttaagacttaccacctcacggtcacttccagctccaagttcctacctgcccctcacctcctgattttcctgcaacctctcctgctgcagccactctctaggttcccttcccttttccccatgccaacgcagatgttggtctcaccctgttctctttaactttctacagaccagtgctacaggctttaatgagaatgtagatgttgctggagatttgcataaatagtggaattttctactgtgcaagggtcatgaaattgaacaaaactaaaattggatattatggatattatccccatccttcaaatcctttttttttttttttggaggcagtgtcattgttacccaggctggtgtacagtggcacgcgatctcggctcactgcaaccaccgcctcgtgggttcaagcgattctcctgcctcagcctcccaagtagctgggattataggcacatgccaccatccctggctaatttttgtatttttagtagagatggggtttcaccctattggccaggctggtcttgaactcctgacctcaagtgatccaccagcctcagcctcccaaagtgctaggattgcaggtgtgagccaccgcacccagcccaaatcctttacttatccccgatcaggaatttctcattggccacctgcttctgcaggctgcagcctcttgccacctgtctcccaactcctcttgtctttaaaccccactccttctcacttccccagaaactcattttcctgatgtccttcagctcaggtcctccctttccacacgtagaaacccactgtgtttctctgggtgaagcactctctatgcaaggtttaaccttttagcagaacacggagctggcaagggctttgctgtttcagccttctctttcttcctccttctccacactcccaacacccatgaatggctttctctatagggagatgaacaattgaaatttactttcttactgataaaaattatccttcccacacataccctaaaagcagatcaatatcccgaaattcggaactatcctgcagccttaggaagccattccaagaatagatcaaatgagaggagaatccacaatccaggcaaaaaattaagtatatgtgaacaagcgttcaaagacccttttaaaacataaggaaatatataaatatgatgctagaatgaaaaggaagttatgtcattaaattcaagttcttcattttgtagaagacaaaacagagattaaatgatttccctaaggttcacagtaagcaaaagtggtgatttaagcattttgttgtttgtttagctctttgtattttgattttagacagcaggaggcagtatctaccttgcagctaaagtggatatctattgttcttacctgcccagcatcccatcaccctacttctggggacaagaaactgcctcttccctttgtgtacaatcttcatgagatgtcacataggttgcctcaagctgcctgggctgagagaagagtacaggacccaagcttggcctatcagacactctcccaaaaacactggaggggttataggtggattcatcctggccatggggctctggagacactgcctagtgaatcctgcacccagacagattccctgaagctgccctgggccctgtccttctcatagcttaggtgtagggcttctcttccagatttacaactgaccgcactgccttccagtacattttgtctattgcttaagttatccat

SEQ ID NO: 14003 - DNA, 8449 bp, Human
  misc_feature (1)...(8449): n = A,T,C or G
acactgtaccttcagtagtgtgagagattgaggcaggggtggggcgtggtatagacaatgatgtatgcaggagataaggacatgagccacggagcagcagggtcacgcatgttcaggcatgcatggaatggggaccacgttacagggcagagatggggatcatgggcaagctgttgagggatccaggctgtagatttgctgatacttagagggcagtgagaagagtgaccctggagcacaaagtagcagcaacctaaaaaggcagatggggctaaattatgaagggtcttaaacattaggcaaaggagtctggacttgatttagtagacgaatgggggaggggatgtttcagaatgacctgagcaagagaagagctagggaatgaagtcttttaggaagggaactccactaacagtgggaagggtggtctggggatgggactggatagaatccactgcaaccatctagatagtaagaagcagccgatttggggactggatttagggagcaaagtacaaggaggggctgacctttctggacggagtgactgggaaatgatggtatcgctgacagaaatggagatcaagagctttggagagacactgggcttcggctgacattgaggtggtggctggacatctgagggagaggacagagccggtgggaacaggagcaggatggaaagacaggaggacagactgtgcagatgagaaaagccactgtaaaacagtaaacatcaagacaggctacatgcataggacctctccaaggaaaggcagcctagagaaaagggaggaggactgaggagacatagtgcggggaacggggcacgaagggatccaggggcagcacagccagacaggggggtggagaagcctggggcacaaggaaaaaagacagggacacggcttccagaaggtggtcagagggctcagagtccaaggaaaataggaatttacagaggccactgggttttagtcaccttacaaacacggcatctgtatgccagaccctgggccaggcttcacggtgttgggtagaagttatcctcattcagcagacatctaccgagtgcctgtgatggtggcggtccctgagtgtggaagagggagactgaggccagattctttctcgagaaggtccaaaccacaatgaggaaggaagacggctgggggaaggagggagtggacggaaaaatacgtacagttgagagcagaccactaattcaaaaaaattagcacttaaggaaagtgagaactagaaaaataagttgagaagacaaaagtcttgcaacacaccccctacccctacccaccagaaaacttagacttgaatggttctcagcaagagaaaagacattgctgtagaatggaacttgttgtgggaggtgggattaccacggaaataaatagaagacagcctccctttccaaagagccaaaaggaacccatttcgtctagttaagagacgaggcaaagcggtaaaatggtgacaacacgtcctggtgagtggttctgaccgtgaatggttggaaaatgctgtgggaatcagaaaggggaaccgtctgggagaggtggtgtcaccgaaggcttctcggaggaggtggcctctaactcgagccttaaaaatgggcgaagaggcgaggccggggcctgcccggcgcggagtactcgggagccgcctccctcctttcagagctctcagtcccgtccccgggcctcgctttctcctctcgcctcgctcagctcagccgggcgcaggttcctagcactgacgacagcgagcgatgacctcagcgccgccaaggctgcgagggcgggggctggggtggcgggggcggggaaaagcgccggagcgcggggccgagcggagaggctccgggccccgcccccatcctctggccgcgaccaatgagcgccgccgccggctgcccccctacctccctggacctcctgaaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacaggtgagcgcatgccgaggggcctggcgccaccgggggtcggccccatccctgccagggccgtctttcttctactcctgcggcagggtgacccacgggagcagctttgggactcggtggccctcctccgacccccggggcggcccgcagtccccagtttcctgggtcctcctccccagccctgtgctcgggtctcggccgtggcggttctgatggggcgcgcccctctacgctctcggaggcgcagaccctggtcctggagtgccagcccgagtccccagcttatgcccctgtctcattacgggctcgtctccctcgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaacaatttggagtcccagtgcggttcttcctgccggtcggggtgcgctgtgcctggggtagtccactggttgctgactggcttcaagttggaatttgggccccctttgtgttatctttggttccccttagccatctgccacctattgtggtagggaggagagcctcgtagctcgtgaccctgccgtgcgggccttcaagttgggaggtgaagagataagcagcccgctcgctggctggggagagacctctctcccagctgtttctagctggttactgtcagttttgggaagcgatagccatctcggaacgcacccacacagaccctgccttctgaggaaaacagatgtttcatcaaaacaacccagttttcactcccttaggcactgctaaggaaggttctccgactcttctgaaggaagcagagggaacacagggtgggaggtccagtgacttgctgtggacccaacaatgttggcagccttcctggccctgaaacttcagctcacaggtctccagaggccctgcctggacatgccagtcccagtcacacccttcccttgctttgggggtgtgccaaaagcaatacactggccactagagagtaccctagagctctagaatcccctcccaacacgcacacacacacacacacacacacactctctctctcacacacacacactcagtacacacacacacacacacacacacactctctcacatacacttgtcctggaagcaggaaagtggatctttccagcttccataaaattttctctgctaagtggaaagagggtcctagaactcagaggaatccacctcccttacttaaagggcccctttctctcctcctgtcccttgaccctccaccccgccctatggtagtatccatggcctagctgctctaaccagggcatctgcccctggtcctgtctccacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaacttgtgtggtgtagagaagttaaaatcctcacgttgtacatttgtgtttccctttcagatccaaatcctttctttgtgtttaatagtatttctcctcacttgcactcagacaatctatagcatgtgggtggtataaaagaaaaatctggttgtatggctgggccatttccaagcatcccctctttcctggaaagtagctccttacttccctccgttttgtttgtttgtttgtttgttttgagacagttttgtcactcaggctggagtgcagtggtgcaatctcagctcattgcaacctctgcctcctgggctcaaataattctcccacctctgcctcttgagtagctgagattgcaggcatgtgccatcaggcccagctgatttttgtattttttgtagggacggggttttgccatgttgtccaggctggtctcaaactcctaagttcaagtgatccccctgcctctgcctccgaaagtgctgggattacaggcgtgagccaccgcgcccaacctacttccacctttaatgaggattctaatttccctgtgaagatgctagaagtaacagggttctagtctgaacattccctagtctagccagatctccatcttatgcatcttgtttttgatagtcgttcatttcattcattcattcattcagtcagttattcatttagcaagcatgtattgtcagtaagtgctaggcactgaacttattaaaaatccttgagacacagcctgtctcacagaccagggtttggtaagcagcgggtaatgaactccttcccaggctaaggcaggattgttggcaattcccagaaaaggtgctcttgtcatctctggggctgtcatttgctatccaccatacttgtcttgttagacaagagcagctaggcctcaggatctatgcactggagctgaatgccaatgctacaggttagctagagagcagctacttctgacagcaaacactggagtgagagccaaaagtttgttaccaatttgtaactccctttggttacatgcaaggaaataacagtttttatcttccctgacttttgagttctttccatgagatttttgacacaagcccagagtttcccactgagggcaagtacattcccagcctggtctagttttttcttggctgtaggtgagctgtatttatttgtttatttatttctttcttttcttttcttttttgagacgtagtctcactcgctcttgtcgtccaggctggagtgcagtagtacgatcttggctcactgcaacctccgccttccgggttcaagtgattctcctgcctcagcctctggagtagctgggattacagatgcctgccaccatgcctggctaatttttgtacttttagtagagacggggtttcaccatgttagccaggatggtctcgaactcctgacctgaggtgatccaccctcctcggcctcccaaagtgctgggattacaggtgtgagccaccgcagctggcggtgacctgtatttaaactaaactttacacatgttgcttcatatacagtgacaactcccccaacttcatttcatacctccatgacctttatcaacaaacatacagttttccctagatgtgctatgttggaagtagcccagggaggctgtgtgtgctatgcctgtgttgagtgaggagggtaggggagccagggatggggttagggaaggccaggtcatctgtatcataaatagaatttggttaagactcattgtatcaaggggttgttactgaaaggagtagtcccatttttatttgtagcttctgaaataaatgtcctagacacttgtttaaaaagacctacttttttggatgtaaggacagggttagttagggttgaggaatttttgcccaccctcttttgagtgtatggtacaaagtcagcatctatcttcctgattcctaaaaggcctagctcatgaaggatatttcccttgtttagtggaaagcctgaaatcggggaaggttggc

SEQ ID NO: 14004 - DNA, 4529 bp, Human
gcactgcccagatgaatccttctcaaatttcttaccagcaaaaaactgtatgagaaaataattttttattgtttttctaagccactgaacttctggataatatgttatacagtcatatataactaatatgtaaccatcaataagggactacgtctatccaacaggggactacttaaatatattatggtaaatgcatataataaaatattatgtagtactgacttggaaaactctacaagataatttcttaagtgaaaaaatgcaaagtgcagaatagtatagaggatactgctgtcttagttcattttgtgttgctataacagaataccacagactgggtaatttataaagaaaatacatgtatttggctcatagttctggaggctgggaaatccaagagcatgatggtggcatctggtgacagcctttgtgctgcatcatcccatggcagaaagtggaagggcaagagagggcaagagcaagagagcaaaagggggccagactcactttttttctttcttttttgggacagagtctcgctttgtcacccaggctggagtgcagtggtgcgatctcagctcactgcaacctccacctcccgggttctagcaattctcctgcctcagcctcctgagtagctgggattacaggcacgtgccaccacgcccggctaattttttttttgtatttttagtagagatggggtttcgctgtgttagccaggatggtcttgatctcctgacctcgtgatccgcccacctcggcctcccaaagtgctgggattacaggcatgatccactgcgcccggccccagactcacttttataatatgcccattcttaaaataactaacccattcccacagtaattgcattatcctggctctgccctcatgacctaatcacctctcattaggccttgcttcccaacactgttgcattggagattgagtttccaacacatgaactttggtggacacattcaaaccatagcaactaccatttgtggaaaaaaaaaaaaaaatagctaggcacagtggcttatgcctgtaatcccagcatttggggaggctgaagcaggaggatcacttgaggccaagagttcgaaatcagcctgggaaacatagcaagacctcatctctatgaaaaagacaaaaattaactggatgttgtggcatgtgtgcctgtagtcacagctgctggggaggctgaggcaggagaatcactggaccccaggagttcaaggttgcagtgagctatgataacatcactgcactccagcctgggcaacatagagagacctcgtttctaataaaaattaaaacaaaacaaaacaaacaaagcagcctgtcatagtggcacatgcctatagtcccagctacttgggagactgaggcagggggatcactgaagcccaggagtttgaattgcagtgagctacaattgcaccactgcactccagcctgggcgacagaacaagaccctgtctctgaatatatatatatataatatatatatatttatatattttttatgtatatatattatatatatatttatatatttttatgtatatatattatatatatttatatatttttatgtatatatattatatatatttatatatttttatgtatatattatatatatttatatatattttatgtatatatattatatatatttatatattatgtatatatattatatatattttatatattttatgtatatatattatatatatttatatatattttatgtatatatattatatatttatatattttatatatgtatattttatatatatttatatattatatatatttatatattttatatatatacacacacatagagatatatgtacatatgcatagagataatacacatatattttgtaatgtgtatatatacaccatatatattatctattcaaaagtaaataaagttgaacattttaaaataatgctttgcggcgctgcggcagtccagatcaaaaatggcggcagttggtgtgttctcggtttctcggctgctgggtcggtcccgcccacagctggggcggcctatgtcgagtggcgcccatggagaagagggctcagctcgcatgtggaagaccctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcgggagatggcttaaataaataacttaaacttaaaaaaataaaataaaataatgctttgtctttaactcagaagtttcgcttctacgaatttatccttagtaaatgatcatggcaaagatttagcttaaaggatgttatcacagcttcatttgatattgtgaaaaaggtaaaacaacccaattattcaacaataggaaatttgttgaatagcttatgccattctcgtactcggccaccgtctttaatggcctcttagaaaacgatcccatgccctgggaagtgatcatgatatactaattgataagaagttatgacatggcaccgtgtaatcttatctttcaagtcaattgaattatataagtgtagattgagatgtagattaaaacacagggagagatgaagatagatacagaaaccaaaatgttaacactgatctctgggaggtccaattactgttgattttgttttcttctctttcacctgtgtttttcaacaataaatgtgctactttgtaaaaacacaaatgctacaaatttgtctcctttttttgtgaaggattcctagatgattctataaatagcagctccagatacagaatttgaaactttgtttttaaagagaacagagttttcaaagtcaaagattaccagacatacatcgttggttagagagagctgccaggcctgttctaagaagtcctatcatgttggtgacaacactgaccccctcccagtccagctggccagtggtggccatgtccagaggggacatcctgagtgcaggctgtgtccctaaactacctctaatcaaaactagtaggcatgggaggcgccagaatttgcataggatgatcttgggaccagtatacaatctgcacttccaaagccagcccactgtttgtacttacatcatagcttaaaaagtgggctggggccagctgggtgcagtggctcacacctgtcatctcagcactttggaaggctgaggcaggaggatcacttgagggtaggaggattacttgaggttaggaattcgagatcagcctgggcaatatagtgagaccccctctctaaaacattctttttaagctagccaggtgtggtggcttgtgcctgtactctcaactactgtggaggctgaggtgggaggatggtttgagcccaggagtttgaggctgcagtgagctatgatggtgccactgcactgcagcctggacaacacagcaagaccccatctcaaaaaaaaaatcataagtgttacaagtttaattctatgtccccaaaactcctatattgaagtcctaaccccaagtacctcagaatgtgattgcatttaaagacaggatgtttaaaaaggtaattcaggtaaaataaggtcatgaggatgggccctgatccaatcagaagaggaaatgaggagagacatgtgcagaggaaagaccatgtgaagagaaagagagaagacggctcccggccaaaaagagaggcttcagaaacctgccctgatgacactgtgctcctggacttccagctttcagaactgtgagaaaataaacttctgtgtttaaaccacccagtctatgatactttgttatgaagacgtcatgtttactaaagacatttttttttttgaaacggagtctcgctcttttacccagggtggagtgcagtggcgcgatctcggctcactgcaacctccatctcccaggttcaagcaattttcctgcctcagcctcctgagtagctgggattcacttcgcttccacgtccagctaattttttgtattttagtagagacaaggtttcaccatgttgcccaggctggtttcgaactcctgagctcaggcaatccgcgcaccttggcctcccaaagtgctaggattacgggtgtgagccaccatgcctggccctgaagacactttttaatgtatacttcatataagactgagaaaatgtccattgtccaaaacaaagacattttctagtggtgcctctgaggtatagagctgatggcagttatggggactttggg

SEQ ID NO: 14005 - DNA, 76165 bp, Human
agtttaacacatttcttaagctcatttaaccacaggaccatttatttcgaagcgaccctcccaatctgcattctgtcaaatctactttagaaaatactttgtggaagccaggctcatgcctgtaatcccagcactttgggaggccaaggcaggcggatcacctgaggtcgggagttcgagaccagcctgaccaacatggtgaaaccccgtctctattaaaaatacaaaattagctgggcctggtggcacatgcctgtaatcccagctactcgggaggctgaggcaggaaaatcgcttgaacccacaaggcggaggttgtggtgggcggaggtcgcgccattgcaatccagcctgggcaacaagagcaaaactctgtctcaaaaaaaaaaaagaaagaaagagaaagaaagagagagaaagaaagaaaggaacgaaagaaggaaggaaggaaggagggagggagggagggaaggaaggaaggaaggaaggaaggaaggaaggaaggaaggaagagaaaatactttgtggaagtcctatctctacctgctcctcctctggtctaaaattcactttgattaatgcaaactatcttttggaaatgccctacctacatgaaattctacccactggagactgattaaggaaactttgattcaacaaacactgattatatacaatttaaacagatcacactgtattgcagtaaatggctctaacttctacatatacagttgttcctacatagtcaaacatcacttatattttagcaaaaaataaaaaaactcctaagtaactataattgtcacaaagtccacgtattttcattagaacccactagagctgcactcagaacttatttactcttactttagcctgatcttaattttgtaatctctttcccaatcaataatacaaaatcaggctagtaaagacaaacttaccacagaaagaaattatacctgagaggctggccatgaaggcaaagacagaaaatctaaaaagtaaggccaagtgtggtggctcacacttgtaatcccagcattttgggaggccgaggcgggaggatcacttgaggtcaggagttcgaaaccaccctggccaacatggtgaaaccctgtctctactaaaaatataaaaattagctgggcgattatagcacatgcctatatataacacatgggattatagcacatgcctataatcccaactacttgggaggctgagacaagagaattgcttgaacctgggaaatggagtttgcagcgaaccaagatcacgccactgcactccagcctagaggagagagcaagactctgtttcgataataataataataataaataaaagtatacaccaaaattcacagcaggaacaattagtgcaggcatgatccactaagaaccagatccttgatgactttattatatcatctcccagacccccagagtgatcaagaaaaacttaaattctattcaagatagtaggttacacagagcaggataatgtaaaatacattttggaaagcttttcttccagtagatttttaaacaaacaaatacataaataagactggatgtgttaaaaggtcaaccttaaatttccagagatttctgagacgagaagcacaccatcccataccaatgctgggtaaatgaggtgtagttactgtccacactactgatcacccattgcttgacaaagcatcctgtggttctgcccttcagtgaccttcttagcacactctgctccagttccactcagcccctaggactctctaagtctcaaagatctgtgtccaacgtcaaaatccctatgcagctgacttggcattatgcagcctccactggtcatttatccaagtaacttaacaagagtgagagatcagggctacgacgcatttacatctaacaagtaaatggtgctcccccaaatatagccaagttagagtgctgggctggcagatttgggagtataaagagagctggggggtcacactcctgaaattgctgtgaccgcagcatctctaggtaagtgctcacaagtgctcacttttttgctccacgtagctatagttgcacctgatcaggttaccagtcaaggggggaagacaataaagtagcctttacggagggcctactaagtgcaaggtcttgtgttgagggcaaggttggagacaagatggaaagacaagacaactgcctttcaagaaacttttacaaggggtgaaaagacaagaatataagcaattataagacaaaaaatattcacctgcagaacaaaactgagtataatgcatgattcctcctctgattatttaggtcaatgttatactgttcagttagcaaattaacttggtaacttgtggtatctcttctgtgattgcttaagctattatttgaaatttttatgtttatttaatttgtttcccatgtcaggatttctgaaaaatggttgtgggaggaaataatcccaagcatcttacccatcttacaaagtgtcatagtctgatatgaattgactggtttgcagactgttctcacatggcatattttatggacttgggactggactgtgtctgacagtgcaatagcatccctcagagatttgtgatactttgaattcaggccaccatctctacggagaactgtctgttatagactcatagggctgaaaggaatcttggagattttctggtgcatctgattcattttacggaaggaaacagaaacccaaagaaatcataccagctacttaacagaactgatattagaatttctgtagctctgcctccatatttttttaaattgaggattcagaatatagtatgtaatactttaattttttaagaaattgtgagaattttaggatataactggagattatttaagatgcattaaagacggagaaggaaggaggcaacaaggatagtaaaccaaatcctaagtgtctgttcctgcctaaatagggcttcatgaaatattcccctggctccataaaagcactgaatggtaattgggaagtttgcttagattacatttgatattgaaaatttttcagacactcatgcctccttgagatagccacgtagtttataaactcctagagctgagattccttagtcccaggtgacttttcagctgccctaccttcatcatctgcaggaggaatttagagcattgaagagaataaagaagtctttgtccacaatttataacttttctcctattgccaaaaaaaggtgactgcccctaagcatccaagctgcaatctggagcattcccctccctactttctttcttccctgacccctcacagccccccagtcagaagcggtttctctaagttcccatagtactttgtttagactccttaaaaatttgtcttaatcctgttcaaagacttacttgagcattctcttatcccttactaacttttgcattcctatagggcagatactgtactttcctcttcatacccccttaaggagctgacacagtacattgtacacacagaagtttctcaagagagtattaattaaatgttgtaattaaccaactatttaaagaataatgattttaatcaaaagtaaaaattcaaaacagcaaatttatttcattccacaccatctactgtgtatctatttaaggtagataaactggaacaaacatggtttctatatttatttaaactctttgtagctcatttgggtttttttggtttgttttttgtttctcaaattatccccaggaagacgctttattcctgaaggacactgactgtcacttgggaaccaagaaggtaagggttattttcagcttgatcatgaatgcaatcattgaaattagcaaacatcattttacacgttctcattcttgccacactcataagaagacgaaattgatgagtttgaaaccaataacttaactattcttaaaggcagattttaaaatatatacaggttttaccaaaggaagaatggcttctcctatttgctcattacactgaaatgtacgaaatataatgcagaattttgacatacaagctccaagtcaatacacagtacttagttggcacagaacatgatgttcatagggtccaaatgcagtcttcacacaaaggctaactttgctgctccttgagcagagtctgcacccatgaatccacacagctgcaccttccctcacgtgtaatactgaaggaatggggagggatccgttcaatcctatgcccggtgcggtaataaaaaccctatccccttaaaacgtgtgtttattagaggtagttctagatgaattgggaccaaaaaagccaagctgtcattgaatcatgagcacatcattgctgacaagacacagtagtggtgaaattcccaggagagggatgaaagttgagagtagtgtcatggtacacagagggtaaacagagagagaggagccctcacaagtgggtgatggagattaggcaggcgggggtagtcatctcaattagaaggcccttaaagacaggaacagagtggttgaaggggcacagctatgcaacgttggaagcaggtcctgctcttggaacagagaagaggctaattaaggaaactctagagggtggtgctcagtgggcagcatgagtcatgcctagagacttgggtcagatctaacaaggtgaagtttatcagtcaaaaatgaatggtcttcccctgggtcccaactcacagttgcacaaatatagggagaagatctgacttagcaactgcatgcacggagaggattgaggggctttgctcgacacggagtggtgcgtcagcagtgtgagacgtggctgccaacaggcaatcaccacctcaagcatgacacctaggtcaagagaggtgagggcacactccagtggagggtgacatgtggtttggatatcacactttaaaagattaacaggagtgggttcagggaagagtgactgagatggtaagggattcaaaagcacatcatagaagaaccagtggaagttgaggctatttagcatggagaagataaagctaagcagaacacagaacagccatcaaaagggtgaagagttgtcacgtaggaaggtttgaactctttctgctgttcaaatggagaacaaatggagagccagattttaatttaaagcaagaagaatctttggcctatcaaagggaaaagagttgtgcctaaaagtatccaactaggttagatgcaccattgcaggaatatggagggataactcaaacatcatctaggtaatactactaggagatactgggttctgagtcacggttagagtaaatgaagggagaaaaaatctctacttgaaaactgtcagtgaggcccacagggaaaagccttgtttttccaggaggactaaaaatatggctcaactatcagctatggcagcctttccctgacttcagactttattctcctattgccatcacaagttttgcaatagccatgttaacaccaatactgtcaatttacttaatatttgtatttacattgattcattttcttttcttatttgtttttaaagttaccttatattcttgctgtatcagcattagctgagaaatttgtaagatatttaaaagctcaaacccaactccagacctagtgaatattcacagtaggattcatatgcccatttaagtttgacaaacactgatttatatcatagaacacatggatgtagcacgcttcctaagtgttaaacaaatattaccctatttccatcaattctgatttttttatattttttacaaatttatccctgaaatgaggatgcatattacaatctatgaaagaagcattgcagtttaaattagctgcatttttttatttgtggaagttataattgatggcaaattttgataaaataaggtaataggctttaaaataagcatacaaatattaaattaagaaatatttgcctaaaattattttgtgtacaagcaatgagactgtgccatggttttggctttagaaaaacagagtagtttcatacaagcaaagtaatgctttaaatcagtagttcccaaacatctctctgaggaccttatcaaaaaatcagattccctggtcccagccatagagattatgttgcagagggttttgaagtaaatcatcttccaacacttttgggtatcatgcttaacgctaagtcaagctacatattataaggtcgtaaacctgtaaccagtcaggattcccttatgcaatagggcagccattctcaaagtgtggtctgtgggttcttgtagagtcccaagaactttttaggaggcacttgaggctaaaactctttcacaataatacccagctgttatttgccattttcactgcatgagtgatgcaaaagcaaggatgaataaatggctggtaccttattacaaatcaaggcaccgcaccaaactgtattagtaattactgtattcttcactaccatacacttgcactaaaaagtttcattaacaattttatgtgatgaaatgggaagtccaccaaagtttgatggttgtctcctggaaaagcacatgtgcatttgtgtgagttgcaagctgaactggccattttattcataaagcaccatttttatttaaaagaccaactagcagacaagctatggttattcagacttggatatttggcaaacatgttctccaaaaggaacaatgtggttgttgtctcgaggaaaaaactgacagcatttgttataaatcacaactttgagccttcaagtataaatgagaatgcatacaggaaaacatgtatttgccaccattagcttgacaacttcctagtactgaaagaattttcaaatgatatcacagtggtgatattgatgattgtaatttttttaatattgtgtaagaaaatgtgtccacatttggaagtactatataattcagtgaaccagtattttccaaacaaccactgtatgaaattcacatatgggaaaagaagatccactcaaaatgcaagacagactagtggattataatgtaacagagtacaaaatgtttattgatatggcttcagattccgcattgcaactagcctttaagaaactaccacttgtcaagttttggtagagtatctgagaagaaaattcacaattatttgaaaaggtgactaaaatactctttccttttctgaattacatagctaaatattttatatttactttcaccaaacatacagcaatggcatgaatacagaagcagatatgagaatccaacagtcttccattaaggagacattaaagagatttgcaaaaaatgaaaacactacccttctcactagtctttttgttttggaaaatatggtaatttttattaaaatatttatgttggccaggcacggtggctcatgcctttaatcccagcactttgggaagctgaggcgggaggatcacttgaggtcaggagttcaagaccagcctggccaacatggtgaaaacccgtctgtactaaaaatacaaaaattagctgggcatggtggtgggcacctataatcccagctactcaggaggctgaggcaggagaatcacttgaacccgggaggtggaggttgcagtgagctgagattgcgccactatactctagcctggatgacacattgagactccatctcaataaaataataaaataaaatgtttatgttaatgtaatgaatttgacagtaatttttagttaatgaataaatattttttaatttctcaattttaattttcaatatggtaaatatcaatagatatgacttacataaaccaaatcttatggggctttcagtcatttagttttaagagtgcgaaggcgtcctgaaaccacaaagtttgagaaccgctgctgtagcgaaatccacctaagccattacattagggactatcttcaaagaaatgagagaagaaagccatgtggatgaattctttctcatcctccaggtggtaactgagagactctaaaccagcatgatggctgcaggccaagagtcttatttgtgggtgctgcatttgaattccagtcccttactatgaaaacctaaccatgaacccacagatggttcagcagagccactgaacaaagtataactaaaatgcaacttatctgaataaggccccatgggaagtggatgcttttctttctgtaagacagaaccccacagaatcacaggaaaggatatttcaacaatggccagttaccaataaagagagcaatttcataaaggctaagatgggggagagaactataacatgttcaactttcccactataaaaagaggacataaaagaccttattcaaaaaatatgacgtatttcaggcggggcatggaggcttacacctgtaatcccagcactttgggaggccaaggtgggcggatcacctgaggtcaggagttcaagaccagcctgactaacatggcaaaaccccatctctactaagaatacaaaaattagccgggtgtggtggtgggcgcctgtaatcccaactactcaagagactgaggcaggagaattgctcgaacccgggaggtggaggttgcagtgaaccgagattgtgccattacactccagcctgggagacagagcaagactccatctcaaaaaaaaaaaaaaaaaaaaaaaaaaaaaacagatttatttcttaagagagatatggagagatatgtgtgggtgtgcgtgtgtgtgtgtatgacttgactccattttatgtcagttatagaattaagtgggaaggaaaagaggagagaagggaaggaaagaggaaagagacttgaggaaaataggtagtggagtagagggaagaggtgccgagggggaatgagagaagcaaattctgagaagaggaacagtccacacaggacttacgggaaccttagacaggagtgaggctggcttctcccttataagtgggaagaggctgtggaccagagagcttaagtggtttgatcagtgctaggactttaagatgaattttctgcattctaagcagggacaatacattacataaaagaaggaaaaaatacataaagagaagagcaagaaaggcagcaaagggagatagtttaggagaaagtgatacaagggatgagagagaccaataccccctacacacacacagccccatacacacacacacacacacacacacacacacacacacacacacacacaccatgcagcaagttctaaggtgggtattaatctaactaaacaatatttgtcacaccctgacaccgccacgcacaaagtttagagaccgcgtttagagtttagaggcccagtacttccccatctcctatgcatagaaattacctggggatcttgttaaaaagcaggtgctgatcccattatcttgggtgggtctgagattctgcatttcttaatgaagtcctgcatgaagctgctgcatttcaaggaccaccctgggaacaggaaggcactatgccagccatcctcagtgtggtccctggatcagcagcatctgcatcacctgggaacttgctagaaatgcccatttttgggccccacttcaggcctactgaatcagaaaccatggggatagggcccgtaatctgtgctttaacaacccctcaaggggattctggcatgttaaagtttgggaccattgccctgggccattttgcctcccatcatcttgttatttaaacaaatgtgacaaatcttcatgttcaagtcattcacttttcacggggctaaccaaaatgtctattaagaattatcagcattccagtgacgattttcaaatattcttaagattttaaactgacactgagatcacaggctcaaacacgatgagcgatttagaaagtgcttcctaggatggaggcggtggctcacgcctgtaatcccagcactttgggaggtcaaggcgggcagattacctgaggtcaggagttcaagaccagcctggccaacatggttaaaccctctctctactaaaaatataaaaaaaatagctgggtgtggtggtgggcacctgtgatcccagctactcaggaggggagggaggagaatcgcttgaacctgggaggcggaggttgcagagccgagatcgagccattgcactccagcctgggtgacaggagcaaaactctgtctcaaaagaaagaaagaaagacagtgcttcctgaagcctcttttattgagttcaccatggctctaattgattcagacatgcacacatgggactgaactaaaatattcccaaaatcgacactcagaggataaaaaaaaaaaaccttcatacttttttgttagaataaaatatcccctttagcttattcccacttgcacactttaagctcctagacctggccatagatccctcaggacctatgttcaatctaggagcctttgaatctggccccctgttttaatagaataagggtaggggccctgcagcttcagcagtcacccaagcacaagactcagcagtccctctggtcttcccagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccgggtgagtgttgattacagatgtctttgataatatgggcatgctcatttttctttggagtagaatattagaaattgcatgctggtccttcggaatctgaagacagaacaaaacttagtttatctgttctgcggtgaagtagcagatgaaagctgctattacatgcaccttcactcttgcctctttccttctccaaggacttgggctttgaggggttttgtggtgtttgctttagaggaaagcagcaggtgagggcagaaaatgttggtctatttaaggaagaggctgatactggatgggccgaccaattatacctctctgggctgcagagtggctgctacagaggaagctcaggagccattgactcacttaatgtggagaattatcatgtaccattcagtacttaccggacatccaccaggtctaggtcatagcattgatcactttgcaaatataagcatacctctgcacctgctttcccaaagtttcccaaagatgtatatggcaggtatgaatctcatttcacaaactcaggcatatgagagagaccttgcttttattttttgttattaaacttaacctctaattccagtcctttttcagtgggctggggaaaaatgtgttcagtcactcttggggtgccctcaccactgcctcaggaatatgtcacattttcagaaccttacacagcactacacgggggactcacagcctccctggaggatttattcagaaacaagtcccagtccttaaagattcaggatacatagacttttctacctcccctttggctaccttgggtgtctgtttctctttttctagtcttgggtggtggagtggaaggcctttccttcctcaaaaaatttggtctataccagcaaaactccttccttttatcttttctgtgaaaccctcaaagttttcctaaggacttaggtttttggaaaacaaaatccaggaagtattacaagctctttttcttttcttgccctatttttttttttttttttttttgagacggagtctcactgtgtcgcccaggctggagtgcagtggcgtgatctcggctcactgcaagctccgcctcccggattcacgccattctcctgcctcagcctccctagtagctgttcttgccctattttctgtctctcctgagccatggagtgcagagccagcttgaatgggggagagaggtgggaaaaaaacagagggaaaaaaaattaaataatattctgaaaatattcagcaaagaaccatgatgcacccccaaatgtttgaactattagagcagaggtacaaataattatgggagccttgaagcaataggggagagaggagatgggtcgtggaagagttggtgctggagctgagctttgaaggtttctaaacaaaattttcatgaagacattccagctgaaggaaacctcatgagcagagattttgaggtggaaaaacacagaacactttggagcagttctttgtaaccttccaacctttgtctcatcacagcactcacaacaaatagggtaaacagaggcaaagggctccaaagctctgcacacctgtaacccactcctggtacacacgacagcaggatgactgaggggcatcagaccagaattggttacatagtttgaccagaatcagattcttcaagaactgttatttatggatcatgttggggcatggaaatgatccatgaaattatccatcacaatgcggtaattcctccacaatatctcactacttccaccacaccagtaaagtgcaatgtgggcacttggctcaccaatttattacctgcttttcctctcaatacccagatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacgtgagtgtctgtaaacacctttttatttcatgtctctctctgagtaaaaacgagatccaaatgataaatgttctgatcttcccagacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactggtgagtaatttctttgattcatattttttgaagccatccttagttaatttttcaagcttttgatgggcgttggccatctgaatggtgcaataatcaaaggatcttcggagagtcagatgatttggggatgaaaagcaaagggtacaacatcttccattgccagtcacagtgcatgacaaggcctgtgattatggctgaagctacactgagctcttgcttatttgggagaatgtggaacacaaggagatgccctacctttgtccccagggaacccccaatccaggtgtactttgaagagaaaccatatcagtagccactcagggaatgctacgttggagaaatgggtaaagcagtgttcctgcgttcttccccaaactcaggctccccttcacctcctttaatttccagaatgacctggggagtaaggacatggtaacactgtcatgccatgatgcctaatatcaagtctgtctgttcaaccttcacctgacttgacttggaacagatgctagaagtagaagcaaggctgggtgcggtggctcacacctgtaatcccagcactttgggaggccaaggcaggtggatcacctgaggtcaggagttcggggccagcctggccaacatgatgaaaccctctctctagtaaaaatacaaaaaaattagccagtcatggtagtgggtgcctgtaatcccagctactcaggaggctgaggcaggacaattgcttgcacctgggaggaggaggttgcggtgagctgagatctcgccactgcacttcagcctgggcaaaaagagcaaaactccgtctcaaaaaaaaaaaaaaaagagtctagcatctgaatctgagacctgtagatgcttaaaaatcatctaatgcaatggcgtccaaacttctgtcatttctgtctcacaatcacaatccttgccatgtctgcaaacttaatatttttcttgaaattagttcatgttacattaattttaaagggaagactaataccacaatttctattagtttgctatggctgctccagtatcacagactggggggcttacacaatagaaatgtactttcccacagttctagaggattgaagtccgaagtcaaggtgtcatcaggattggttagtctgaggacgctgagagagaatctggcccatgtctctctctcctagcttctatggtttgctagcagaaatctttgttgttttttatttgtagaagcatcaccctgatccctgccttaatcttcatatggcattctccccatgtgcttgtgtgtctccaaatttcttctgtttataaggataccagtcatattagatcaggggcttgccctactccagcatgacctcatcttgagtaattacccctgcatcttgtttacatcttatttccaaataaggtcatattctgaggtactaggggttagaaattcaatatgtgaattttaggaggacacagttcaatccatgctctattgtaaatgaaaaaccagtatcacttttcacaagtagaaggtaaaggtaaaagaaaaatgcaatgaaaccaaccagcatctataaatgctgatgaaaagctgtggccccacaagctctgaacctgacacttgctttctttatggaaaagggcgatgggaaaggactagcagggagttaaagatctataaacatgagtaacttctacactgtgggattcactacagtgagtagagaatcattcacctcccaggctggtcatgttgcacatcccacatttgagaaatctgcctaaattgtcccaaagaagattagacatgcccaaatcataccagtggttaatggcaaagacattaactagagcctatgttctccaaccacccccaaagttactttattttaacattctgtttgttgtttatttgttttgttttgcttccctctgcatttctagatcgagacaaccagtctatcctcatcacgtgagtaacacctctttgtaccatcatgacttggaaaccagtgccctcccttccactctcctttatcccgtttacttttaaattggcagcggagaatccggggctgggaagactgtgaacaccaagcgtgtcatccagtattttgcaacaattgcagttaccggggacaagaagaaggagacacagccaggcaaaatgcaggtgagcagccccacctgcatccggaggcttactggaataagtatactttaaagcgtggatgagcaccaagtgtatgcagggtatgcgctcagtagaaacggcaaataggaaaaattctttctttcctctctgtatcctcacacagaacgtgtctgccatcaaatgtatggggtttttccatgccaaacaattctctaattctctgcagacaccaactgggtgtcctacaattcaattcaattctgatactaactacctagagaaagcatcaaatcacacaagttaagggctcagtcctgcaaaactgaccccactttggataccagggaccagtccgggcctcctgaacttctaagcaagcagctattaattgggaggagctcacgacccccgtctcaggtttggtaattacctagagtgcttcacagaactcagagaaacactttgcttacatttgccagtttgttataaaggctgttacaaaggatgcagaggaaaagccaagtggaaaagatgtctagggcaaggtatgggggaggggcagggtctctgcaggtgacatcctcccagtacctctaggtgttcatcaacctggaacctctctgaagccttctgtgtagggtttttatagaggttgcattacatgagcatgattaattaaatcactggccattgatgattgactcaacctccagcccttctttccttcccaggggtcaggaatagggctgaaagttccaactctctaatcacgcggttggttccctggcagccagcccccatcctgagctgtccaggaccccgaagccaccaatcatctcattagcacacaaaaagacatttatcacttcagatattccaagggttttaggagctgcgtaccaggaaactggaaaaagaccaaaatataccattcctattacatcacagtatcacatggagcaaagcaggaagtggttccaccagaatggacttgagttctagcaccagctccatcacctacagttgagggaccttgaccaactccacatcctcctctggagaaggaatgtttacaccagtggttttcaaactggagtacacatcagaatcaacaggagagattcttaacaaagggcggcagaacccaggcccagaattcctgattgtgtagatctagggtgggacctcatagtttgcatctttttttcctttttattttggagagacagggtctcactctgtcacccaggctggagtacagtggcacaccatcatagctcactgtgacttcaaactcctgggctcaagcgatcatccttcagccttccaagtagctaagactacaggaaccaccatgcctggctagtttttttttaattttttgtagagatggagtctcactatctttcctaggctggtatcagaccgttggcctcaagtaatcctcctgcctcagccttccaaagtgctaattacgagtgtgaactaccatacctggcatttctcatatattcccaggtagtgttcatgctgctggtccagggaccacactttgagaaccactaggtttgacagtagtttctaaattgctctggacccagaaggataaagcagtcatggaggtgaaggtgaaaactctgctttctgtagtggatttctgaataatcattctcataagtttttgctacataaaaaacctttttgagaaccactgttgttattgtatcatcccctgggtcgcttgctttgctcacattctatttctccttctgaagacaaatatctatattaggtgggtcatattacatgcaataacagaggtgcatgttataaaaatccatgatttataatgaaatgttatcagaaaggcagtctggatgttctgatggagggagtaatattcctgcctagaacctggcatgaccagaagtcacttcaatgctatgctaataagaacctgtctaagatggtaccttgaagacgcctcaggtctggtgggggtgggggcgtgggtgctgcactgaccaccaggtggagctggtcgacatctctacctgaacctgcccagagtacccaccgttttagtcatcaaggggctactttagaaaaccatccaaagtcctctttttcctcttcttgtttattattagggaaccctagaggatcagatcatccaggccaacccactgctggaggcctttggaaatgccaagactgtgaggaatgacaactcctcaagatttgtaagatccggcccaattttcaagtatcctcccaaaagcataccctctcctgaaatgctggatatgaaaaactgccccataaactggaatatatgggggcctttttctacccccaagtgattgagatcaatctacccacctggaatattgtgatacactttgaggaaggtgttggcttggtcctggcagagggaggatttgccgtcctaccctaactaggcaatgtcacctcacagcatcctgaagtcactcacatgattcaaatcccacaattagagatcaactttatgctaaaatgggtctctctgtgtggaaacattttaaaatgttaacgtccattaagccatatctattggtctagccacggaaaccttagtgtgaattaagttagcagatttgacctcttccaactcagtagggactgggagcagggaaaacctagtgaaggcagaagagctcaaaaatttgaaatagtctgggcgcggtggctcacgcctgtaatcccagcactttgggaggctgaggggggcggatcacttgagaccaggagtttgagacgagcctgaccagcatgacgaaaccccatctctactaaaaatacaaaaaattagctgggcatggtggcacatgcctgtaatcccagctacttgggaggctgaggcaggagaatcgcttgaacccgggaggtggaggttgcagggagccgaagttgcaacactgcactccagcctgggcaacagagggcaactctgtctcaaaaaaaagaaaaaaatattggaatagattcatactgaagatattgaaggatatatgccatccttcaactttttacttaggtttggcttaatcaaaaagacatttacttcccatcggaaataaacacacatccagccctctatttcatttcactggccagtggagcaagtactcagaggcaaagccatcatttgtgcctatggttgcaaaagtacattaaaacttcacacatcttaatagttggatagtctcaaacttgtatttcgtcgcctgaaagataaaatggttatcaatgaggaagtaggtaatccatcaaggaccatggctctgagccttgacttttgtttccttggatatgttctttgtaccctgtgcactgccagtttgcacctgtatcctccccagtgcccaaataaactcctcttccttgtggaagatctgggcacatgttacatggcagaggtatgttacccatgcctggaccaagttagttattgcactggcctgacaccagcttaaagtgaaagacaataccttcaggcactccctcttctcattcccatttacttagttcatgggcctctactcttagccctgacccagaagtcacaatcattctaattattttgtcctctttccaccctccaaatatttgcaggctagggatgacttccattgtcttctgttaagccgctaaatatactgaagacacagcacttacagtgcacatgtgcctttactgatccttcactaacttttcctggggttcattcagaaaatattgaggctagtactaagtaccatccacatttcagacactgtgggtgaaaaagcaagaaaacattttttgtcctcgaatttgcgcacagtgtcgttgaggaccaattaagcagataatgtatgaagcaggtgcatacacacaaacacgcatatgaaattttacctcccactccccagaaagtgggccacctagaccctgagttgttcttttggcagccagggagccaggcctgagcctgagcccgggcctctgagccagatttgtctgtagtcagccatatgtgaaactcaggcaagaaatctcagaagtagcatctattaagatacaagcaaaaaaaaaaaaaaaaaaaaaagtcagacagaacaatccaaccagttacaattaaaaggtgttatgaagatttaagaatccaggtataagagaacaggatgaaaaccaggcaggcagtcaagaatggagtagtcccaagaagagagctggagaaggagcctgtgggcatcccctgagttgtgggaagagggacaggtgcttgggtagagctacctgagtccttgctgacccagcttgggagcactgggcacccggtggagaggtgcccatgttctggcatcccttccttctgagccaaggagaggtcatggtggccaatatcaatgacagtgaagaattgttggcgacagatgtaagcatgccatttatttgtttgtttacggacagaattattgagtttatgaactgagagacatgttagtgagctaatgggaaaactgaaatccagggatactaagtgattagactcaagatctcagacatcaagggctcagagaatcagcacagattggcccctccctactcagctcctcctcacagcattccaaaatgcaaatccagaaggttcaccaaagcaggccttcagttctgttctctagcatttttgcatttataatttatctgtggcagcacctatctaaggccagccacaaaaccatataaatcaaataaccgtaacatttgtccacctgttattggacaggggaagttcattcggattcattttggagccacaggaaagctggcatcggcagacatcgaaacttgtgagtccaaacactctataaatccgttggtgttttggccacaaaagcatctcttgggagcctgaaatcacgttatttttgttaccttagatctgttagaaaaatccagagtgacgtttcaattatccagtgagagaagctatcatattttctaccaaattatgtcaaacaagaagccagaactaattggtaagctcttggaatacctttcttatgttccaaatcggtgacgttgggaaaaaaaagcaacccagagtaagttatgcataagccattaaagggatatctgtgtttcacagacctgcttctgatctccaccaaccccttcgacttccccttcgtgagccaaggagaggtcacggtagccagtatcgatgacagtgaagaactgctggcgacagatgtaagcatgccatttatttgtctgtttatgcacagaattattgagtttatgaactgagagacacgttagtgagctaatgggaaagctgaaatccagggatactaagtgattagactcaagatctcagagatcaagagctcagagaattagcacagattggcccctccctactcagctccacctcacagcattccaaaatggaaatccagaaggttcaccaaagcaggccttcagttctgttctctaacattttaactggaatgcatttttgcatttataagatctttaacctaacattcgttgaaagttttcatgttgcaaaaccatctacatggttcttcaagaaaatttagaaaatataaaaaagtataaagcagaaaaccaagcccactctgtaatagcctctccatttttctttctgcctttcactttaggctcaccttagacactcagctcctcagtacacctgtcaggcctgtggtgtttattttggggaagtacctgtaggattaataatcttaataacaataataaccaaatatattgagcacttacatgtgccaggcactgagataagtggctttacctgcattgtctcattatagtctcaaaattatgtcattattgtctccattttacaaatgtggaagctgattcttaaaatatatataattttctggaagacacaattcgtcaatgacagagtctttcccttccttccttccttccttccttccttccttccttccttccttccttctttccttccttcctctctctctctttctttcttctcttcttttcttttctttcttttttcagacagagtctcgctctgtcgcccaggctggagtgcaatggcatgatctcagctcacggcaacctccgcctcctgggttcaagagattctcttgcctcagcctcccaagtagctggaactacaaggcatgcaccaccatgcctggctaattttgtgtgtgtgtatttttagtagaattggggtttcaccatgttggccaggctggtctcaaactcctgatctctggtgatccacccagctcagcctcccaaagtgctgggattacaagcatgagccactgcaccaggcccaatgacagagtatttaaacacaggtctgcctaactacagagcttacatttttaattaaagtataccgtctgtgagcaattcatctccacccttgttggctccacccatacaaaagcttcaagagcttgcgaaaaggggtcttgtccatcatcctagagacactgccccatgaccagcttcttagccttcatttggtgacatttccagctgataataattgttttaacacaaatagaaaaattttcatgatcaaataaacttgttatcttaggtctaatagtgttaaaagaaaaatttgagacaaattaaatttagcagagtttatttgtgcaaagaatgattcatgagttggaccacactcagcacctggagaggctcagagagctccacccagcaacatggcaggcagtatttataggcagaaaaaggaagtgacatacagaaacagcttgattaggtacaggtctgcctttgccttatctgcaggtggtgtgatgaagcatttgtgttatatgcacaatggcccatcagtttggcagcctgtgattggctgaagctcagctgctgtgattggctgagactcagctgctgtgattggctgaagctcagctgctgtgattggctgaagctcagctgctgtgactggctgagactcagctatttgttacaagaatatactcttaggttgcagtttgtttacatactaatttaggttatagtttgctatgtatggaggcagttttagaccaaatttaatttaagttgttatatatttttaatgaggtttccccagtcttcactaacttgtaagcacagaaagggccaggctaatgactgctacaaggcccccatccactgagaaaggcccacctaaggaattctaaaagtcaccttacctaagtcatgtcctcaccaagatgccttctgccagatgcggctgttgctccttcctctcacggagcctttttttggttttttgttttttgttttttttgagatggagtctcgctctgtccccaggctggagtgcagtggtgcgatctcggctcactgcaacttctgcctcccaggttcaagcaattctctgcctcagcctcccaagtagctgggatgacaggcacctgtcaccacgctcggctaatttttgtatttttagtagagaaggggtttccccatgttggccaggctggtcttgaactcctagccttgtgatccacccacctcggccttccaaagtgctgggattacagatgtgagctaccgcgcctggcctcacggagcttttatagcctgcctggtatagtctccctttttatgaactcaaagtcaactgattggtaacttcataatgggagtgacatcccatcatatacccaggttccacctgcacccctttggagatgacattctccaaaagggtccccaggcagtgacgctttcacctgctccttttagtgtttttgaaagagttctttctcttttaacctacaacgacccttccctaggacagagatatgcaaccctgaaatgggatatggattcaagggatggccatcatggcctcggaatctctcctccccatatatcccagctcctggcataggctcattctccactaaagggggtgccactccaagaatgcttgactctccaatatcatcctgctggtgttggcctattgggtctatcctacgtgctcaccaaacacgtccaaacatgtttcaatcctaccaatggacactctacaggctcaggctgcaaaccctactgcataatcaatatgtgtaccccagagaaggatttctttttgttgaaacctttgtggtggaagacaggcaacatgattataaaaccaaaccagcaatgaccctaggttttgaagggacgaagacctaactccagtcccagtcttatcacaccctccctgtatgacaggctacttaccaactagaccctcaattcttcatccagaaatctggaaaaacctgcacagctaaaggggcttcatggggatttaataacatacagatgatgcctacccaatgtctagcacatagaaagagctctgcaaaagcttgcccctttctcatttgggaaatgatgatgccatctttgatgatcttcccttccagatctaatattccataatgcatattgtcttgagtctgaacaatgctggaactcctggattacaatgccaaactcttaagccattaaacattatttcccagtcattctccatgacattcccagctctcagtatcatacaatggttcccaatcgcctcatccagaaaactgctcccccaaatctatgtacagtgagaaaagatcataatcagttctctttttttttttttttttttttttttttgagatggagtctcactctgtctcccaggctggagtgcaatggtacaatcttggctcactccaacctccgcctcccaggttcaagtgattctcctgcctcagcatcctgagtagctgggactacaggtgccagccaccatgcctggctaattttttgtatttttagtagagatggagcgtcaccatgttggccaggatggtctcaaactcctgacctcgtaatctgcctgccctggcctctcaaagtgctgggattacaggcgtgagccaccgcgcccgactgtaatcagttcttatttgatggaaggaaacagacaattcacatctttttcccatagtctccacccacccacacaaacacgtgaaacaaatggtttctaatttaccacatccccacctgtcatccacttatttgggcaaatgctgtctcatatgctatacaaaaaagaggtaaggtctttgccaagaaaaggctgcatatggatccctgattcctgctatgacagttgtcctttttttctttccagaatgccattgacatcctgggcttcagctcagaggagaaagtcgggatctacaaactgacgggagccgtgatgcattatgggaacatgaagttcaagcagaagcagcgtgaggagcaggcggagccagacggcaccgaaggtaactgcatctgggaaagggatgcgattgggtccatctatgttcatgtgcgggcgaggccgtgtgagataaactgcattcatttcaagagctgttcttccaaaactgcataaatcaaatctgggtttcctgaagctcattgtagcatgcactaggaagtctgctcactcagtcaaggactcccagagtagtgaattcttgaaaaacaaaaagcatcattcttgtaaatgaataatcaccacgcactccactatctttcaccatctaaatgtgcctgttttttttaaggtggacttttttgagacaatattgttaggtgaacttctcttctctccaccagaatgcagtcttaattactcaggcctaaaatgaggcctttggtaaagtgggagccaagttttgttcctcccatcgcctccaccccagcgtctgttgaacttgaccctgaaccaagaatggtgaacggttcttcctccccataactctcacctagctgatcctactgccaccctctgccccatccctaagaggcctggaactagagcacagggcagcaggaagggctgagcagtgactgactccccaccatacgtcctgctcattagacttcttagctctcacgatgcttcttacaagttccttgaattaaagcctggcaacatggatcgttcttgataattctgccttttgattacagccccacagtatgtgaagcagtgcgctttaaactctcaagtaataaaaaggaagtgcagccataaattaaagggtgggaaaatctacataaccttatcagtgtcccataaatgcttaccaaccttctatcctaggcctgcctgggataattctccctttttgttaactcaaagtcaactgattggtcaccgcatcatgggagttgtacaggttccactgcactcaagtaaaggaggttatacaaggcatgtacaccagggggcacaccttgggtgccatcctagaatcctgcccatcacagtggaggggactccaagtcttcacacaggaaacacttctgactggggcaatcagggaaggcttcctgatagaaggggcactgacttggactttgagggatgaataggattctgaaaaattgggggagagatcagttcaagcagaagaaatgtcatgagcaggctgggcacagcagctcacgcctgtaatcccagcactttgggaggccgaggtgggtggatcatctgaggttataggtcaagaccagtctggccaacatggtaaaaccccttctttactaaaaatacaaattagctgggcataatggtgcctgcctgtattcccagctactcgggagactgaggcaggagaatcacttgatcccgggaggtggaggttgcagtgagccaagattgtaccactgcacttcagcctgggtgaaaatcgtgaaactccatgaaataaagagaaagaaagaaagagaaagagagagagagggggagaagggaagggaagggaaaggaagggaagggaagggaagggagaaggaagggagaaggaagggaagggaagggaagggagaaggaaggaagggtcatgtgcaaaggggcagaggatgaactgtgatggggatggaggcacagtgagtggtccactttggctacagaacaggatataagcagtggatttgtaagaaatgagaattttaaagtaacaatttttgcatcagtttgggaagatcttgagtgtcaggatgaatggtttagaatatatggcaggccacggaagccgctgtccaagtagcaggggaagtacatgcagacaacctgaaattaatctgtcagcagccaggctcaccaaaagtgggaaaacttgagaagaaaaaaaaaagagtatcaggctcctcagcaacagtggactgcattgatacacgtattgatatacctcagtagggtcccaggccctcttccagccctagcagctgtgtgtgtgcagtgcttaggagcagaaagtggaggactataatcaaggccagtgctccaatgatatcaatgacgataccaacccaagctaatatttgctgggcgctcactagtcaccaggcatgcttcacgacaaccgtataacatgagtattgtcactgtctcccattttacagacaaaactgaggcacaaagaagcaaaaccaaaacctaaacctaaacctaaacctagagcagtccgactctagagcccaggctcttggccactataactgctggaagcagtggagaggccaggcattttgagagtgaaataagcaggacttggtgcctgtctgaacaaaggaatgtcaggggcaagagagagaaggatgtatcacccctttcaagtttaaatgacaagaagaagaataatggtaccatctacctgaatgggcaaagcaagaaaaggagataattcgaggagagagtaaagcacgcatctggcctctgattaagtacttaacatagactgccctagatttttattaactcatctccccacccagcaatgaagcaagggtcccaaccaagaagttgtccctgggggctgggcaaggtggctcacacctgtaatcccagcactttgggaggtgggcagatcacaaggtcaggagatcaagaccatcctggccaacatggtgaaaccccatctctactaaaataaaaaaaaattagccgggcgtggtggtgggtgcctgtaatcccagctactcgggaggtgaggcaggagaatggcgtgaacccaggaggcggagcttgcagtgagctgagatcgcgccactgcactccagcctgggcaacattgcgaaactctgtctccaaaaaaaaaaaaaaaaaaaaaagaagtagtccctggggagcagcatttctctgcctttttgatgagctcaatgcaggccaccaggtccttctcaaagtcaatgaacgtctgctgaaatatatgaaaatatataacccatgaactgtaggaaacagccaaaagtcaagtgcttttgaccatctccaaacatttgaagggagggtcaagttttgtacttctctttcaactatgagcatggtactttgcttaaattaggaaggtgcctcatgtatattgtcaactgtccaagtggtggctcctttactcatataacattttaacgtattgtcagactccaacataactatgtaattaattaattttttttttgagtcggagtcttgctcttgtcacccaggctggagttcaatggcacgatcttggctcactgcaacctctgcctcctaggttcaagtgattctccttcctcagcctcccaagtagctgggactacaggcgcttgccacaatgcttggctaatttttgtatttttagtagagacagggccatattggccaggctgatctcgaactcctgacctcaggtgatccacccgccttagcctcccaaaacgctgggattacaggcatgaaccaccgtgcctggcctgtaatcaacattcttttatgaaatcgaaatatcagtaggtcaaaattggccacggagtatcttattgttaaaactgcatctaggaggcaaattggaagttcctgagaaccatgggcccctggatatgggattaaagcttcagtgaacaagtccagacctggtacagatatgacaacatgaaaacatttaagaaaattacagaaaacacttctgggagaagccaggggctgactggacactttagcagctactgtttttgcatgatgccatttttttctcttccttcagtggctgacaaagccggatacctgatgggactgaattctgcagaaatgctgaagggcctgtgctgtccaagggtgaaggttggcaatgaatatgtcactaaagggcaaaatgtccagcaggtaatggagatgctctgaatccagttgattgagatcttttgctatttgagccattatcttaaagctccttcagttgcaggtatcagaaatgcacatgaaatcagcttttcacattaagaggaagttcatttttaggcttcagaggcaactgaaggaatgcaaatcattaagtgcccattggacgccatgaggacctggaattagaaagtgaagagccctctggagccaggcagcctccctccagctcctctgggattcatgggctgttgagtctctcctctgttgtgtccttgctaggcagataagtttcctggacctctcttgcccgtggccaccccatagctcccaagtttatatctctgtgtttccagcctcaccctgagactgagaccagtgtcttttgatccctattccaaattcttaggagagatactcaattaatccaatctggatcaagtgttcacctctggtctaattaagtgtggccaggggctggagtcatgtgctataaccatgttgttagaaaaatatctttgtgaataggatagttctcaaagaaaggtgaacagcatgagctgggcaaacacctcataaaatatttaatattgcattgaatgatctgaaattgccaatattcaactgcttttgattttctttttttcttttgttttttttttttttttttttgagacagagtctcgctatgtcaccaggctggagtgcagtggcacgatcttggctcactgcaacctccacctcccaagttcaagtgattctcctgcctcagcctcccgaatagctgggactacaggcgcctgccaccacacctggctaatttttgtatttttagtagagacggggtttcaccatgttggccaggatggtcttgaactcctgacctcgtgatccgcccgccttggcctcccaaagtgctgggattacaggtgtgagccaccacgcctagccaacagcttttgattttcgagtcaatttcatatgtttcaacttaatgcagccatagaaacactaactcaagggttgagtgggtgatcctttttcaaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatgtgagttgtgaccttctactttcttgtctgctttgctgaatctccaatgtattttccaagctcactcaaattctttggtatttgaatcacccagttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaaggtagagagatactgctgcctgggacagctcctccttattgggggccctccccttcttgctctgattcttttctgctcacagattggggcccctagcccccaggctgcaagccttcagatagataactgaatgcctatttgcaaagagaatgaatgtcctaaatctgttctgacacttaaagaggtttacgggtcattaaaatccaagggctcagttatctccaagaatgtgatggaaccccagtaaggactgtggcatttcttacctatttgacttacccaaagacccaaggaggcggaaccatggagcagtgtggctcttggagggatgttaatatgaaaacaggaatagatattaacttttttttttttttttttttttgagacggagtcttgctctgtcacccaggctggagtgcagtggtgcagtctcggctcactgcaacctccacctcccaggttcaagcgatcctcctgcctccacctcctgaatagttgggactacaggtgcccgccaccacgcccagataattttttttttcttttttttgtagagacggggtttcaccatgttggccaggctggtctcaaactcctgaccttgtgatccacccacctcagcctcccaaagtactgggattacagacgtgaaccaccacgcccggccgacattaactttttaaaaaggaattcccataatatttgagcactgctcatgttggaatgagtatatcttcctaaggtggctactgagaaattgggacattattgttcaaaatattactcacattactttatggctatatatgaaactttacttttttgtacacctattgaaaaaagtatgctaggtttatacacacataattttatcctatattcttttgttcagcaaatattaattaagcacatactctatgcctagcactttctggtcatcccccaaacagaccaagagtcttgctctcaccgagcgtacatgccagcattcctggtaccagagtgaaagcaccaaagaaggttttttggcttctccagaccatgaagcatgggtatgcactattatatgtagactctgttatcctctttccagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaatgagactgtggtggggctgtaccagaagtcttcgctgaagcttctctccttccttttttccaactatgctggtgcagagacaggtaaaattctatcatttctttccctctgtgggatgttctatgtaatgactcctaacccagagctgcttgtgaagaaccagtaatcagacatgagcttcagctgagtatgatgtttctctttcagctccatttttcttcctcctgctcttattcttcctcttctgtaagagactgggctctatggaggtaaacaggacctctcagtggccaagatagtcaacatcacattgtttaatagttttctactgaggtataattcacatataataaaattcacccttaaatctatttagtggttttggccaggcatggtggctcaggcctgtaatcccagctctttgggaggccaaggcgggggccgatcacttgaggtcaggagtttgagaccagcctggccaacatggtgaaaccccatctctactaaaaatacaaaaattagccgagtgtggtggcacatacctgtagtcccagatactcaggcagctgaggccggagaattgctttaacctaggaagcagaggttacagtgaatggagtttgcatcactgccctccagcctgggtgacagagtgagactctattaaaaaaaaaaaaatttagtggtttttaggatattcacaatgttgtgtgaccatcaccactgtggaatttgagaacatttttcgcacccctgtaacccatgagcagattttttttttttttttgagacagagtcttgctctgtctccaggctggagtgcagtggtgcaatctcggctcactgcaggctctgcctcctgggttcaagcgattcccctgcctcaggctcccaagtagctgggactacaggcgcacgccaccacgcccggctaattttttgtatttttagtagagacagggttccatcatggtggccaggatggtctcgatctcctgaccttgtgatccacccgcctcgacctcccaaagtgctgggattataggcatgagccatcatgcctgtccccatgagcagatttctatccctagcctctggcaaccactcatcaactttctgtccctgtagatttgcctatctgggcatttcatgtgaatggaattatatactggatgctcttttgtgtctggcttctttctctcaggttactgttctcaaggtctggccctgttgtagcatgtatcaggactttgttctttcttatggacaaataatagttcattgtatgaatatatcacattttgtctgcacattcatcagccgatgaactttttggctactgtgcatgatgttgctatgaacatttgtatagaagtttatatgtgaacatatattggcaattcttttgggtatacacggtatatatatacggtacctaggagtagagttgctgggtcatatgataactgtgttcaaaattttgagtaacttctgaactcttttccagagtggttacacaggggccaggcgtggtggctcacacctgtaatcccaacactttgggacgctgaggcagaaggatcatttgaggccaggagttcaagaccagtgtgggcaacatagagatcctgtctctaaaacaaaataaaataagataaaataaaataattagccaaaagtggtggtgcacacctgtagtccagctacttgggagcctgagctgggaggatcacatgagattgggtggctgaaattgcagcgagccatgattgggccactgtactccagcccggatgacagagtgagaccctatctcaaacaaataaataagtaacacaagccagtaacactttttaagattaccagtaaatatacttttaaatagtagccaacatagagttttaacattatatgccattttaaatgcatacatttaataaattaataaaatatatgaaatataattattcattagataatgagatcattttttaaaaatgaaagcctaatgtcctctgggccagggaatgtaataaataggaaatgggcacatgcgtaaacttcaatgatgaaaatcattttctttgaatctaatcacaatgtctctgtaactacattgcataacctcgcctagagataacatcaactctaacataagaccctgtgtggatgcggatttgggaaagcgactttcctgccttcccttccccaatccaaacacacagtcatgctagaccccggggacaaagtgggatgaagggaaaggaacatgggagagactgggacatgacattttcccccaaggctgcatcttgattaagtatcagagaaaattgagtcattcagaaaaagcagactccaaattaagatggcaaattgggttgtttcctgtaggaaagaaaaagaaatcaacttataaaatattgttgagaaaattccgttttattactttcagttacttactctttagagataagcagggattaaagaatgaaaggaggtaaattcatgaaagaaactacaaacattgccaggcacggtggctcacgcctgtaatcccagcactttgagaggccaaggtgggcggatcccttgaggtcaggagttcaagaccagcctggccaatatggtgaaactctctactaaacatctctactaaaaatacaaaaattagccaggcatggtgacgctcgcctgtagtcccagatacttggggggctgaggcaggagaattgcttaaacctgggaaacgaaggttgcagtgagccaagattgcaccattgcactccagcctgggcatcgcagcgagactccatcttaaaacaaacaaacaacaacaacaaaaagaatgaaaaaaaaaaaagaaactacaaacattaagagggacatctcaatcttgcaaattattcagtttgctttcagctctgatttctaaaggaaaggactccccttttctactgagagtttaagttatactcccagttaaatgctatccacaccccattcccaccccattcccacaatgataaagctgagggttcttaatcctgggtagtttgggggcattttaaaaacaaacaggccaggcacggtggctcatgcctataatcccaggactttgggaggacaaagtcaggagttcgagactagcctggccaacatggtgaaacctcatctctactaaaaatacaaaaattagccaggcatggtagcacacgcctgtagtctcagctacttgggaggctgaggcaagagaatggcttgaacccgggaggtggaggttgcagtgagttgagatggtgccattgcactccagcctggacaacagagcaacactccatctaaaacaaacaaacaaaacctcaagtctcttatgtcaaaaggaaaccagaactcggggctgggaacgggtggttcaggaagcccactgctgggtcctctgggatgcatctaacacgctcttctgtgtctgtctccaggtgactccggaggaagcaagaagggcgggaagaagaagggctcctctttccagaccgtgtcggccgtgttcagggttggtgttttggcagcttccatattcacttgtttttctccccagtgaaatggcatttgctaaatgtgcttgttttggtttatgtcccaggaaaatttaaacaaattgatgactaacttaaggagcacccaccctcactttgtacgatgtctgattcccaatgagaccaagactcctggtgagtaccagcagatcttgccaagtatttgaacagaacaggacgccctgagataaatgcaaaattctgtgggtgtgcgtttggaaagagtgatggtctgtatcacttctgaaagtagtctctgaaatagggttgccagatttagcagataaaaataccggatgtacccaacacaaagaaatgataaatgtttgaggtgacagatatcccaattatgcagatatgatctttgcacatttcacgcttgtatcaaaatatcatgtgtaccccataaatatgttcaactattatgtaaccacaaaaatgctaaaaaccaaatgccatattaaatgttattaaatttcaatttcagttaaacaatgaaaaatgtctaagtgtgacctatgcaatatttggaatatacttcctctaaaaaagtattcattgtttatctgaaattcacattcagcagggcatctgtatcttatctggcacccctactatgaaatcatattcaaaatattgtgtgtatgtatataggcacatcagagccacagctttcataagataaaggctctgtttaccccaaagttaaataccactacatttggcaaataatcatcttgggtatcccataatcaaaatagcatcaataacaactgtttgaagccatactgcatgtcaatcactttgttatattacctcgaatccttgcaacagttctctgcaagatacgcgtattgatctccagtttataaatgagaaaactgagaatcagagactatatataaatacagaaccctgtgcaatacagactatatataaatatagaaccctgtgcaatagaggactcctttaactgtcacttcatcctgatttgcgaatattcttggagtctagctttttcagtgtcatttgtcacaaaaaggaaaacaaactgtcacacggagctgtggctatggggtagctaactcaccagctgagctgttctatgcccaacacgggcctcccagctcaggattaaacattctgcctctgcaacattatgagtgaacagaggtatacgttgtcggggggttgggggggaaaagttcacctattaccacgtgatcctaagcagagtatttgagcactttctgcctcagctttcttgtccataaaacaaggataggccgggcacagtggctcacgcctgtaatcccagcactttgggaggccgagtcgggtggatcccgaggtcaggagatcgagaccatcctggctaacatggtgaaaccccgtctctactaaaaatgcaaacaaattagctgggcgtggtggcaggcgcctgtagtcccagctattcgggaggctgaggcaggagaatggcgtgaacccgggagacggagcttgcagtgagccgagatcgtgccactgcattccagcctgggcgacagagcgaaactccgtctcaaaaaaaacaaacaaacaaaaaaaaaaaaaaacaaggataaaagtggcattttaatctattatttacttctttaataagcactcataaagtggttactcactttgcaaatattagctcatttaacccaccttagagggttgtcgtgagggttcaatgagtaagtgcaagtcaagcatttacaacagggctgagcacattgtgaacacccagcaaatgttggatgctaattattattattattattatcactcagaactagaaagtttaaatccccaatagccaggtgtgttatagttagtgaaactgcatcttccatgaaagttaggttctaaagtctaagtcaaaagcaataaccaactacatcattgtgatatgcattatctggggcatcctgcagcctcctgaccaatgagccggcttctccagtgttgggaagagtggtttctttggttaagaatcacacgaaatcactggcttgtatgtaggtcttggaaaatatccatttctgttactgtcgtcattgagtacatgcttgcataaatcaaacatgcttgtggcctgactcctctctaagcagatggcctgcaagatggtgggggatggcttcaaactgtgcctctgggaggaatgcttttggtaatccactggcttacttttttttcttttttgagacagactctcgctctgtcgccaggccggagtgtagtggcacgatctcggctcactgcaacctccaactccctggttcaagctattctcctgcctcagccttcctgagtagctgggactacaggcacacatcatcatgcccagctaatttttgtacttttagtagagatggggtttcaccatgttagccaggatggtctcgatctcctgacctcgtgatatgcccacctcagccttccaaagtgctgggattacaggcgtgagccaccgcgcccggccctacattttctttgggaaggtaaatgttgctgaaatgtctgtcctttcctgttgcatttgcttctccttagctctggcacctacctctctgttttcatgtcaatttctgggaatagcccaacactgatacagaagcctggtgacaccttagaaagcacctagtgtgccctctttattttctagaagactagagactatggagatttccatgccttaccccagggcacctagagcaggggctgggagtcacgatccatgatcaaatctcaagtccctccccacccacaggcacatacggggcttgctagttgttctcctgaatcctctagggcttcatgggcacaggtcctctgctcgcctgctgaacaagggcccctcgggagcaggctccagcctctactcctctcgttctcctcttgcagcaaacctggagcctgctaagtctgtgctgctgactcaccaaaagctggcttgctgctgtttttaaatgtaggttttattattgttaagggatggtgaggccaacagaccagaagatggttaccattaaaaagacagtcacggccgggcatggtggctcacgcctgtaatcccaacattttgggaggctgaggtgggtggatcacctgaggtcaggagtttgagaccagcctaacatggcgaaaccctgtctcaactaaaaatacaaaaattagcctggcgtggtggtgcatgcctgtaatcccagctacttgggaggctgaagcagaattgcttgtacccaggaggcggtgggtgcagtgagccgagactgcaccactgcactccagcctcagtgacagagggagactccttctcaaaaaaaaaaaaagacacagtgctcaagaggagggggcctgccacagagggccacgaggggaagcaccagagctaggtttggggttgggggagtaaggagaaatcacaggccagagccttgagggtcattcccatgggatggagcaggcgaggtagcatgaacaggccaagcaggttcagcattgccaagtttgaatggtttcagcaggcttcaaaatgtagggactttctcaagttggccggtacccggggccctgaggtgaccaggacagggaagtattggcccagagtgtaagagccctgtgagagcctgataaaggtaggggtcgggggttaagggctttggatggctggtttgcatgtgaaagacgtgcttgcaggaggcttttttgccatctcctggaatggctagccccgggaagggcagtctctcctgagccagcgaggaggccccatgatgccggatcatcataagatacagcatatttcaaaagcatggctaataccactgcccacagaggccaagatggctggagaaaggagtgggatggaagtgatacacttggagaaataaagaggaaaaacccttcagcggctggagcagaaggatgagagaatagctcaggggaatttttagaagttttacgcattggtacaaaagcaaaggaggccctttacgtggacctgatagaaaacatctcaggccgggtttaaggaaaaacaaagcaagccctaagagaactcagctcaggattctgagtctgcacaaaccagaggggccctgtgagagagaagagtggcgtctcggctctgctacagctttgcaaagcccttcacctctctgggcctcagtctcccccagtgccccgccaccccataggatgcctctgcgggaattagaaaagatctcccagtccaagtcggacacgacccctaacaggatggacagcctggcaagcatggtggcatctctggcctccccactgtaaaatgatggtcctttcagctttcttctggctctagaagcttcaattctcttgtaactatgcctttttctctctgctcccggtgcttaagaagaaagaggcctcagccacatggttaaagcaagtgttaatcatgcctgctttcaccattttaacctttgtactcatcttttctctctctctctttttttttcaagacagggtctcactctgtcgctcaggctggagtgcagtggcgccatctcagctcactgcaacctctgcctccccagtttaagcaatcctcctgcctcagcctcccgagtaactgggatttacagggacgcaccaccacacccagctacgttttcatatttttagtagagaagaggtttcaccatgttggccagggtggtctcgaactcctgacctcaggcgatccgcccacctcggcctcccaaagtgctgggattacaagcgtgagccatcgcaccgggcctgtactcatcttaactcatgtaatcctcaaccacctgatgaagcagatactacaggttgattatccctttatctgaaatgcttgggaccacgagtgttgtgaattttaaatttctgtggatattggaatatttgtatgtgcctaatgagctatcttggggatgggaccaagtctaaacacaaaattcatctgtttcatatgggtcttatacacatagccctaaggtaattttatacaatattttaaataattttgtacgtgaaacagttttggctgcgacctgcctcatgaggtcagtcgtggaattctccacttgtggcatcaggttggagctcaaaagttttcaggttttgagttttctgaatcgggatgctcaacctacattattatccttattttacaaataaagaaattgaggcagagacaggccaagtccgcgaagctagtaaacagcatagctgggatcttaaccactcagaatcatcatctgagagctcatgggagtcgaattagaccattgctaaggttctctccacatcggcggttctatgaattttttaattattgtatttatttatttatttatttatttgagactgagtcttgctctgtcacccaggttggagtgcagtggcacaatctcggctcactgcaacctccgcctcctgggttcaagcgattctcttgacgcagcctcccgagtagctgagactacaggcacctgccaccacgcccggctaatttttgtatttttagtagagatggagtttcaccatgttggccaggctggtcttgaactcctgacctcaggtgatccacccacctcgacctcccaagtgcggtgattacaggcatgagccactgcacctggccagttctctgaatgtctgagacattttctccttgctctcaaccatgttttctctagagaatcaccacctgataggactttcagaaatgattaaatgccccatgtctgcactgttcaatagggtggccaccgttacatgaaatgtttacatttacatgaaaagttttaaaatgttaattaatttttaattttaatgaatttaaatgtaaatagccacatgtggctggtcactacggtatctgacagtgcagctctaccaaagccttaaaaatcatctaattgtatagtgatgtctccccacagctaccagggaaccacgtgggcattctagaagcttccctaaggttaagtcaaagccagccttggccccaccactcccaccccggcaacttagggagcccacaaagagaagccatcaggttgccgtagcccctgtcctctaacccctcacgcagacctgagacagaattttctccatcctagtttgatttgtgcctgacccaggctggttaccacgagcacccacattacctccccaaaggggcttgcccctctagctcctctccttccagccaagctccatttctcccccaattcctatagcaggggctgagtggtcagcagatgaccgccgccctaccttcaacccccttctgggtcccctcccacggcctcttctttttttttttttgaggtgcagtttcactcttcttgcctagactggagtgcagtggctcaatctcagctcactgcaacccccgcctcctgtgttcaagtgattctgctgcctcagcctcccaagtagctgggattacaagtgtgtgccaccacatctggctaatttttgtatttttctgtagagactgggtttcaccatgttggccaggctggtctcgagctcctgacctcaggcgatacacccacctcggcctcccaaagtgctgggattataggcatgagccaccgcgcccagccggcctcctcttctttgctgggttactcttctgcagccacagcctgcagatttttccatccccatctttgtgtagatgcaagaagacatctcgggttatcccatgggaagcccaagtgcaccctgtactcactctgcagcttttgcagccttgctgcagagtcagggctgaggacagaaagcacaatgctttggctcttactgccacggttatggggtgctagcatctccccaagagggtgggattatttcactgcgggacctgcaggcaggctctagccacccccagccctctaccttggagctggcactgactctcccactcactgactctcccactcaagtgtggatgtgttggagggtctcatggtgcctcagaccatcaacaacaaatgaaggggtcacaggcacacccccgggacgttctctctccaggtgtgatggaccactacttggtcatgcaccagctgcgctgtaatggggtcctcgagggcatccggatttgcaggaagggattccccagccggatcctctatgctgacttcaagcagcggtaggttccctctctcctgtgcatctctctccttccgagggcaccttttgcatttccctaagacatttcttgacctgggtatttggtgagctcccaagtcccccagagtttccacagacttcatctcttgctagaggaactgatcccatgcccacagtgagtgggccagcccaagtggttccaaattcagatcccagaccctctagcctgattgtgactctagaccaggatgtctcaacttctgtactatggacactcaggctagatcatcctttattgtggaggctgtgctgggtgtgggaggattttagcagtaaccctgccctctactcaagagatgtggtagcaaaccacacccctccccactgagctgtgacaatcaaaactctctagacattgccaaatcacacccagctgaggcccgcagctctagactaactctctcctctgagccaccattgggttgcacaagtccgggccttgtccaggatggaggacaggagaggaccttccagaagtaggagaaccacggcctacaggtcacggttgatttcaaggcctcttttaagccagagaagaaccatttcctctgaaagcaaacttcccgccatgcactcagctgggctcccttctttcatgcttctctcccacccaccttgcttctctcccaagggggctgattcaagcccccttgctagaatcagtccctagctattcccatctcccagaccagctgtacagtattccacttcctcctaaggcttgagcaggagaagattctagaaggctggtctcagctatgaagcctttcggggattggaatccatttgggaaatgtcctctctccttaggtaccggatcctcaatgccagtgctatccctgaagggcagttcattgacagcaaaaatgcctcagagaagctcctcaactccatcgatgtggaccgggagcagttcaggttcggcaacaccaaggtgagcacaggcaaggctgggactcccctagtaaccccacagccctgggctgcttgttagctgatcagaaaaagggtccccttctccttttggtccacctgaccgtccttgcccagtcgcccaggtaaggggagctctgtgtctaggtagacagagcttgtctccctgttggtttgtaagtggctgaaagcttagattggaagcctgagccccaccatgcagcaaggataggaaaagccaatggggaactctagtgtcccagaggtaagaaagagctgaagagagaggagaacatagagaggactccagggacactgaggccttgaggagaatgactataaacaataaaatcagctaccaagcggggcgcagtggttcatgcctttaatcccatgcttttgggaggctgaagtaggatttcttgaggccaggagatggaggctgcagtgcgattgatcatactactgcactccagcctgggcaacaaagtgaagccctgtctcaaaaaaacaaaaacaaagacaaactagctgccatttattgagcacgtgagtatcagccctgtgagaagcctcctgcacatacttcactgactcctcactaaccagcgaggtgggagtgatggtgataagggtggcacttactcatcaggttcttgggaggtcgagaaacttactcaaggtcacacatggatagatagtaagtggcaaaggtcagcttcaaatcctggcctgcctccaaagatccacatctcagaaacgggcaggctgggggtctccagcaaggaagagcctgctggccccagagggtgcttagtttccctggaatgttatggagggagtgggcaaagtgggcctgagcgtgggaccaaccttcccagatggacagaagaagagggtgaagccaacgcatctgtgaatctctctgatctgggcacaattgcgtcccatggtttctttctggactcatctttgtttcctgtatgtgagctctgtcagaactgatctctgtgggttggtggggcctggaacacacgttgtttttgtcgttgttgttgttgttttgtttgtttgttttgttttgagacagagtcttgctctgtcacccaggctggagtgcaatggtgcaatctctgctcactgcaacctccacctcccaggctcaagtgatgctcctgcctcagcctcctgagtatctgggattacaggtccccaccaccacgcccggataatttttgtatttttagtagagatagggtttcaccatgttggccaggctggtctcgaactcctgacctcaaatgatcacctgcctcggcctcccaaagagctgggattacaggcatgagccaccatgaccagcttggaacagactctggaccaggctgcctcactgcccaggaggagccactgaggagaccagagccaccgagaagcaagtcctggaaacagaattgctgcccctgccgtgctctgagagttgagcctcagagttgagcagaaacaggccccctcaagggcccggctgaacgcctgctggggaaaaagatcaaggctcctctgtcttttaatgcaggtgtttttcaaagctgggctcctgggacttttggaggagatgagagatgagaagctggtgacgctgatgacaagcacgcaggcggtgtgcagggggtacctgatgcgggtggagttcaagaagatgatggagaggaggtgacacagaccctcacctccaccttatcctgccctctctgcttagcagctgattgtcacttcctgcttttagtcttgggatttccatgtgcttgctctctttccttcatttgtttaacccacatctactgagcggcaatcctgggctgggtgctctgcatggcgctggggagacagaaatgaaccctccctcacagggtcacaaaggagtgggaagcagacgcatgtatggctggttttaatgcctgtgacaagctcaatgttcgagttatagtcgggggatagggaactggcaagaataagcccccagcctgattagggggttggagttggcatgaaggtgtcagcaagaagaaagcactttcttttttcctttttttttttttttagacagagtcttgctctgtcatccaggctggagtgcagtggcacaatctcggctcactgcaatctccagcttccaggttcaagcgattctcccgcctcagcctccctagtagctgggattacaggcatgcaccaccacgcccggctattttgttttttgtttgtttgttttgttttgttttagagatggggtttcaccatgttggccaggctggtcttgaactcctgacctcaggtgatccgcccgccttggcctcccacattgctgggattacaggcgtaagccactgcgcccagctgacgaaagcactttctgaagcaagctctacacaacctgagagtgggtggtctgggaggaagcccgacaagcaggtggctgtcattggaatagagagcaagaggcaggtagtggaggtccctatgtgtcacattcagaaacccaggctgcaccctgtcattgatggagagctgtagaaggtgtgtgcagagacaaggggtaggattgcatcactctggcagctaggagagtgaacacaaaggctatgacggggcaaggccacagtgtggtagaagtccaagtaagggatgacaaggacctgaagtaggacatagttgatgggtgagagaggagggcatggattaaaggaatgtttaagtctttttcctttgataattcaagagaaggaatagcagcattgatgactagtcacctgcagggattggagggagaggggagtgtgggagggagcctgttctccctggttccctgatcccctgtgtggctctaactgtcagagccataatgaaccgccaccatgtatgcgtcaggaatcactcccaggcatcgagcttggtgaagcacatggaagccagcacggagatgaaaagaatctcaagaagggaaagagaagccagtgttcaggaatccataagctatgtaaatataaagctgtggagggtgaaggggaggagatcatgtgggtgacactgggatgaaaacagcagtagaaattaggaatacaggctggttgtggtggctcacgcttgtaaccctagcactttgggaggccaaggcgggcagatcacctgaggtcaggagttcaagaccagcctgaccaacatggtgaaacccagtctttactaaaaatacaaaaattagccaggcgtggtggcgcatacctgtaatcccagctacttgggaggctgagccagaagaattgcttgaacctaggaggcggaggttgcagtgagccgagattgcaccattgcactctagcttgggcaacagagcaagactccatctcaaaaaaaaaaaaaaacgaatagaaaagaaagaaattgggaagacagatcaactctaccagggcaagagactgggaaatgaccaaggacaagtcctgggtttctccagcaggaagaggaaccccatatggcaaaatacagtgaaacagggaaaatgtggatggaatttaaggcagagaaagtttcaaaagttaagagctgattaatacatcaaacatgggagaaagacccaatagaataggaatgaaagctattccttgcattgagcattaggaggtcacggacgccctcaggcagggcactctcagtagggtggtgggaagggcagccaggtgaccaggagcccgcaggtagctccacgccctctcctaccttccaacctgtgcacgtacctctgtttcctctgcccctcatttgcagacctactctggatccagaggatctgccaagcttggctgcacctccttcccacctaaccgagaaagacggaggatggggtccgtcggggacaggtggggggtgcagagaccagaccttgctggatttattaatttgagtcctaatgggtgtacagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgtaagtaccttctacttgagaacgcaaaacacagactctggaggacagaaaagggggaggaacattgagggcgccatcaggtgtctattcgagagacagtggtgccacccagtggtcatgtggagtattgcagcaccaccttgctcgtaaaaggatgcctggtcccgggcttagcaaagcagtgaatgccggaaattatgtctgcaaagagaatttgtgctctccctgatttctccccgtcatcgcagagttagatatattttgctgtgggcatgagggatatatatgtgtcatatgtatatgcaccacagcttttaaaaatcaataaaaataaaaataatcaaaattaaataacccaattcaaagtagcaagagtaattttctatatattatttacaataatatgtaaaaagtgctttaggccgggcgtggtagctcacgcctgtaagcccaacactttgggaggctgaggtgggaggatcgcttgagcccaggagttcaagaccagcctgggtatcatggcaaaaccccatctctgtaaaaaaatttttaaaaactagcaggcggccgggcgcggtggctcacgcctgtaatcccagcactttgggaggccgaggcgggaggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcgcgccactgcactccagcctgggcgacagagcgagactccgtctcaaaaaaaaaaaaaaaaaaaaaaaaaaaaaaaaaaaaaactagtaggcatggtggtgcatgtctctagtccaagatactcagaaggctgaggtgggaggatcacctgagcccaggtagtcgaggttgcagtgagctgagaacatgccactgcactccagcctgggcaacacagtgagaccccgatctcaaaaaaaaaaagtgctttaaagatacatagttttatcaaagaaatggggcagtataggctggacacggtggctcacacctgtaatcccagcactgtgggagaccgaggcgggcagatcacaaggtcaggagattaaggccatcttggctaacatggtgaaactccgtctctactaaaaatacaaaaaaaaaaaattagccaggtgtggtggcacacgctggtagtgccagctactcaggaggctgaggcaggagaatcacttgaacccaggaggtggaggttgcagtgagccgagatcgtgccactgcactccagcctgacaacagagcaagactccgtctcaaaaaaaaagaaaaaagaaagaaagaaagaaaaagaaaagaaatggggcagtataattgtctctttcacagagtgaaggcatttataattttccctttttaataaatccccaaatacttttaccttttgtttttatacagagcattttccgctccccttttcactttcccaatcactatagtgagttaataggagcactttcccaggtacagcggacaagagaacagctcttggaacaagataactgggtttctatcccagatgctccacctgatagctgtgtgaccttggatgagctacatatcctctttgtgcttctgttatctcgtctgtaaaatgggcatagtcagagtactcacctcatccagctattgaaaaatcagagtggttaatgcctgtaaaatgcctggcacacagctcatgtttatagatgttcagcaaacattagcatgcaggcttgccagtctcctcccatgcattaccctgcagtgtgtgtcttaaaatactcttatatgggccgggcgtggtggctcacgcctgtaatcccagcactttgggaggccgaggcgggcggatcatgagatcaagagatcgaaaccatcctggccaacatggtgaaaccccctctcttctaaaaataccaaaattagctgggcgtggtggtgggcacctgtagtcccagctactcaggaggctgaggcaggagaatcacttgaacccaggaggcagaggttgcagtgagccgagatcgcgccactgcactccagcctggcaacagagtgagactccgtctcaataaataaacaaatatataaataaatattcttatatgggaagatatagcccgatttagaacagaagtagctgatcttggtctgtccaagagactcactgcagcatcttctgggacatatgtattcaatcacgaattcttgggtgtttttaattttctgttctgtggttcgaggagacacagctaaggagacataggcagaacttttctgttgaaaggaccaggcctggtggctcatgcctataatcccaacacttttagaagccaaggcaggaggatcacttgagctcagaagctcgagaccagcctgggcaacatagtgataccttatctctagaaaataaataaatccatatatttaaaaataaatttaatgaaagttaaaagatagtaatgttttgaaactattttgtcagcttgagataacatagagtagatgagtcattttccaactggtggtagcaggaagagtgagataaccagctgttcaaatgtggcaaatttctagaggcttcattctttaaaatgaacttgtaatttcacaaactcctctgtttgaaattattataagtgaggccaggcatggtggctcacacttgtagtcccagcactttgggaggctgaggcaggaggatcacttgaggctcaaagtttgagacaagctgggaaacacatggaggccccatctgtacacacaccaaaaaagaagccagtcatggtggcacataccttgtagttccagctacttgggaggctgaggtgggaggatcacttgagcacaggagtgtgaggatgcagtgggctacactcacaccactgcactttagcttgggcaacagagcaagcccttgtctctaaagaaataaatgaacaaattattatatgcaaatttctataagcaatgttcttgctagttaaaaaaaaaaaaaaaaaaaaaaaaaaaacatgtatatggaccaggtgcagtgactcatgcctgtaatcccagcactttgggaggccgaggcggaaggatcacctgaggtcaggcgtttggagaccagcctggccaacatggtgaaatcccatctctacaaaaaaatacaaagattagccaggcatggtagcacatgcctgtaatcccagcaactcgggaggctgaggcagggaatcgctagaacctgggaggcagaggttgcagtgagcaaagatcatgccgctacactccagcctgggccacagagagaaactccatctaaaaagaaaaaatgtgtttatgggtgatatctaagtttatgtacacgtgtgtgtgcagtgtgtgcacatgtgcatgcatgtgtgtgcatgacccatttcttggcttaggtgtagataataagcttttagagggtgataccctttctttgtagcattttcaaagaggccaatcaaaacataaaatgacctggttctttcaggaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtgagcaaacccaagggactcccacagtgtcttaacaggcttcactctctctctctgtaaggaggagaaagggtggcgtaggagtccagtcaatataacattgcccagaaatgagaggctggcgtcaaggtgaagggtagttaagtcccaacaagttctgtcctctggtgtcttttctacccatagactcttcttcttcttcttcttcttcttcttcttcttcttcttcttctttttttttttttttttttttttttgtgagatggagtcttgctctgttgcccaggcagatctcgctacagtggtgccatctcagctcactgcaacctccgcctcccaggttcaagcaattctcctgcctcagcctcccaagtagctgggattacaggcacacaccaccatgcccagctaattttttgtatttttagtagagacggagtttcaccatgttggccaagctggtctcgaactccttacctcaggtgatccacccacctcggcctctcaaagtgcttggattacaggtgtgagcccggccccataggctcttctcaaccctccctggctgtatcacaaacttctagcatttctttgagaggaaggactgtttcatattcttcttcagttcccatagcaccaagcacagggattgcaaacaagaaggcctacaggggtcaggcagatagtgaaggaggcagaagactggataacaccaaggattgactgagaggagcaggtaccggcaggacagagactgatgcagcctttgggaaagttatttggaattactcagtcaaattaagaatccagataccctacgacccagcaattctgctcctgggtgtatagatcaaggaattcttccacctgtccataaggcgacatgtcctagggtgtttgtagtggcattgcttgcgggagacagctggaggcagtgccagggtccaccacggggaaaacggagaactaaaatgtagtagataacacagcagggagcactacgtagccattaggagcaatggcgtgtgcacaccaaatattaaatacctactgctaaatggtggaaaaatgtaagaaaatgaaatatagggccaggtgcggtggcttatgcctgtaatcccagcactttgggaggccaaggtgggcagaccacgaggtcaggagatcgagaccatcctggctaacatggtgaaaccccgtctctactaaaaatacaaaaaattagccgggcgtggtggcggacgcctgtagtcccagctactcaggaggctgaggccggagaatggcgtgaacccgggaggcggagcttgcagtgagctgagactgcgccactgcactccagcctgggcgacagagtgagactccgtctcaaaaaaaaaaaaaaaaaaaaacaactgtaacattgtaaatgataacattgtaaaccactatgtggactaaagaaaatatggccagattcagcccatagattaggagttagcaacttctgatctggaagcctgttggatgtggaaaaaggtttcacttacttccttcaagttccgtgttgggtgccctcctcctgcttcctgataacacagcactcccgttctgaattttctttctttctttctgtctttatttttgagacggagtctcgctctgtcaccaggctagagtgcagtggtgcaatctcagctcactgcaacctctgcctcctgttttcaagcgattctcctgtttcagcctcctgagtagctgggactacaggtgcccaccaccatgcctggctaattttttttttttgtatttttagtagagacgaggtttcacgatgttagtcaggatggtctcgatctcctgacctcatgatccgtccgcctcggcctcccaaagtgctgggattacaggcgtgagccaccgcgcccggcgtgaattttcttgcgtaggacctcacgcctctcctccccttcctgcctcattctaaaccctattcagccaacctaacaaacacatttccacagacatattatgagcgaatatagattgatgttttacccttcagaggtagcacatttgcattttaaaagcgcccttccttgtaaaatataatgccctccttaaatgaataatcctaatgggagaatttgaggcaccatgatagaccgttaaggaagataaagaactgagagtctgtcaattctaggaggtaaaaaagtagtagccaaaaagaaaagggaaaaaggaaaaatgagcaaagaagcaatagcttttgttgatggaagcttctggcataatcgtttccatattaaatcggtgttaatattgtcccaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatgtgaggatattttactactatgctttagcatttatcacttgtggaagcacagacaagagacagtctaactaggacacagggcttgagaggtcagactctggaatcagcatccctaaattcagatctcagccccaccctgaccctgaaggagtctgggatactgagcaagctgcttacccttgcaaagcctcagtttgtgccttgtgaaatggcgatgtaaatagctccatctcagagggttttcacagaaagctcagcacacagaaagtgttcagtaaaacatagctgctactattgctatcatcaccatcatcattattattagcatccacttgtaggtcctttgggttccaaaacctccaatcctgttgtaacgttactaaagatgagttccatttgtggccatgaaaattactatttctgcccccgtcacatgacattattgttcttgatgtaagagccacgtttgaagttttcaggttttactcactattgtggctagagattttctagataactttaatgtttctgagcccagggtaggtgtgctcctcctctacacccttttcctgttcctatgtatgcatgtgtgtatgtgcacacacatacacacacacgaattccttgcctcccatggttgcataatgttagcaggcaaggcgtgatggtgtgtagcacagaccttcacagtgctgtccacagaagcccccatttgtattgtctgtgcaagagtgtgcacccatgggtaccatacccctacagggaacatagtctgggccaggccaggtgggaatcagctgagagaggcaccaggaggcccctgagggatccagccccaccctgggtagtcttttctggaagacagaagagaggggaggtaggggcaagacttgcttcctcctggggccagaggcttgcagccagcaccctacaggagccccaggaagccccaggccacgtgtatggctacactggataaacggggcaaacacttccccagcaggggcttaattttctacctgtgtgtcttctcagcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagtagatatttcttttaccacctctgtgtctcagcctaaaagccaactttcaccccctccaagaggcttgtatttcatgttctttatttttttttaatctatttgcaggaaggagtttgaactcagtcagttacaagccaaaatagatgacgaacaagtccacagtttgcagtttcaaaagaagattaaagaactgcaagtaaaagcatcaaaaccttcccaatcatgacaatccctttgcaagagcgcccctcctcactccttcccccttgtttctttagctgcttctttccttcctcctgctaaagctagagaagatgtcctgtcatttcctttagtttttgaaaataatattttaatgttctgaataacccataaacatacttccttgcaaaggctcaaaataggcccagtaaagctaaatattattgttaagggtgctttgatcgccatccctaagcccagtgccctccccgtcttctgagaattaattgccaatttcactgggatgtgcatctttctgcctcttttgctatgtgtttttgtacacatttaagactccccaaaaaatatatagtacacatgcagaaaaggttcttgtttcttcatattcttagcatatcacactgagagtatcactctgcaatttgctcctttcttttggcaacatgatctgcagagctatccatgatagacgtggatttgtgtctacctgctccatagacttctagaacaagtctccatcacaatcgatttgtgcattctcttatccatggacacttaggttgtttccaagttttttcaccaatttaatgttataatgtattcttcttttttttttttgagaccgagtcttgctctgtcacccaggctggagcacagtggcacaatctcagctcactgcaacctccacctcccaggttcaagctattctcctgcctcggcctcccgagtagctgggactacaggcgcccgccaccacacccggctaatttttgtatttttagtagaggcggagtttcaccatgttggccaggctggtttcaaactcctgacctcaaatgacccacccacctcatgctgcctacccgcaattcctcaacacccagcccctctcaaagggggctgccccctcctccacaataacattcctgatagagtaatcctttcaggcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaaggtacctgactggcccttctgctcttggagaatgcaaggcagccgacggccacctgcccctgggcacgtgtaatttgatgcctccaaaccactgcatgttctacactgaaaccctcttccctatttctgcctgtttctagttcctcaaatttactcacgtcctttgtcttatccatttgtgcttctgtaacaaaatattttagactgggtaatttataaacaacagaaatttatcactcacaattttggaggctgggaagtccaagatcaaagtgccagcaaattcggtgtctgtcggaggcctgttcctcacagatggtgccttctcattgcatcctcatgtggtagaaggggtgaacaagttctctcaggcctctattataagaacactaatcccattcataagggctccacccccacgaccttatcacctcccaaaagccccaccccccaacaccactggactggaaattatgaattttggggggacacaaactttcagaccaaagcatcaagatcacttgattcaagcacaattggatgatctggcaccactgtttcgctcttgttccccaggctggattgcagtggcgccatctcagctcactgcaacctctacctcccaggttcaagcaattctcctgcctcagcctcccaagtagctgggattacaggcacacgccaccaggcctggctaatttttgtatttttggtagagttggggtttcaccatgttggccaggctggtcttgaactcctggcctcaggtgatccacccacctcagcctcccaaagtgctgggattacaggcatgagccactgtgcctggccgattggggctctttaagaaaaaagtatacaaacttataaaaattaggcatgaaagttgatatttaaaatgagacaaaaaagtcgcaggttaccttgaagactcaagttcttttctcctgaggcctctttgggccatttgccagaaatgccttctagaatattctgcttgtgatggctcctcttcccttgaaccttctgcagctcccagactctctgtggcccatgcaaatgcgggccctgaagcttatttcacaagcttcatagtgaacccacctctgtgcatggcctcaaagcaaagaattcctcgtggagcatgtgtgctcctcgatttaacacgtgccctccttgcagggtgctctgagctgtactaggagctgtttggctagactggaagaagcagtggtgaccctagaagcgaggctgtgggcctctcaccgagggtttcccggaaggtcagggcatctgtccagaaaaggaagggagatatgaatcagagaactagagtggtctctccagcgccccctgctgccagtgtttagggtctgcgtccacgcagccctgtgcctccttgattgcttcttcactccgcgactgcagcctctggctccggctgatgactccttttctctttctttcctgctttcccatgtgtttgccctttttcccttggttttctttcttcctctaagaacttggttctgtaaatgttcccctcccacacctctctctcggcgagccaggccagcctgcaggggtagctgggtaggaagggcctccagcatcccccatacactatgcctataaacagcccccactccagcctccctatctccagaattgccgtgtgctgctctctgttctcaattttaacatccaggggaagcagcacgtcatgtctcttaacgctttttcagttgtcccctttgacgattctccttgcaagctgccatcgcgtttcaactctccctgctttgattccttcatgtttgcgtgtcatcttctcaaagagatcctaagctcctccaggacgcccgtggaattagtgtccctgcttcctccactgccatctcatacttaccattctaaagaaaaacatatgctctatacattttattttctattttatggagcagcaggaggagagaaaggtcaacacacacaagggttttgaacaaacttcacaaaaatacaggccaactggaagccagagaggtgaatctcttcatacggcctgcaccatggggaaccttctgtgttattgaatgaaatgcttaacactgtcatctgaatatattgcttgcaaatattcacaggcttgtattgcttgcaattattcacgaatcacttatattacaagaggatcccaaagatccacttaaaagtgacatcttctcaaagggttgtttacaaatcattaaatacttatctacctgatgttccaagtgattggtgattgagctgcattcacaaatctgaaataattatgatttttttttttgagacggagtttcactcttgccgccaaggctagagtgcaatggcatgatctcggctcactgcaacctccgcctcccgagttcaagcgattctcctgcctcagcctcccgagtagctgggattacaggcatgcaccaccacgcctggctaatttctgtatttttagtagagataaggtttcaccatgttggtcaggctagtctcaaactcctgacctcaggtgatccaccctcctcggcctcccaaagtgctgggattataggcgtgagccactgcgcctggccgattatgatttttttgaaactgaacttttttttgttctgtacttttatttttattttacctgacaagaaactaaatgattacactgttcagttcaatgctgggcactaggaatccatttcttcccattcatgttgactttctgtttgttaaagagtaacatagaaagaacgtgccggacggtagaagatcaatttagtgaaatcaaagccaaggacgagcaacagacacagttgatccatgatctgaacatgcagaaagcaagactgcagacccaaaatggtgagaatgggcagggctctgggtccagccgggccatgggagagggtggtcagtaacactgacgtgggggccacatctgtttggtaggggagctgagccaccgagtggaagagaaggagtctctgatttcacagctgaccaaaagcaagcaggccctcacccagcagctggaggagcttaagaggcaaatggaagaagaaaccaaggtaaagatatagagtcagattgaacctgagaagccaggctatatgaccacttcacccgtgaagctggtcagagcagtgctacatcaagaaatctgctgcagctgggcacggtgactcacacctgtaatcccagcactttgggaggccaaggcagatggatcacgagatcaggagttcaagaccagcctggccaagatggcgaaaccccgtctccactaaaaatacaaaaaaaaattagctgggtgtactggcaggtgcccgtaatcccagctactcgggaggctgaggcagacaattccttgaacccagggggcggaggtggcagtgagctgagatcacgccactgcactccagcctggaagacagagcgagactccattaaagaaagaaagaaagaaacctgttgcttctcctgtctgccttgcagcatggtgggaacctgtcctttaaggttagaggaccttggcactggatctccttcttcaggaatagaaaaccgtacctatggtggtccatcccctggcctcctctgtcccccgcagggtggtctgagaaactcccctttccagccagggcacctcctccccatcactgcacacacttgatcattctgcccagcaattcatcctggccacctgaaatccccctcctctttcttcttcattattcctgatgtgtcacctcctataccacctgattttaagctcccctcctccaagaaggctccatggttttgggagcacccttgagacagtcgcataaacatgaacatcatcaccttcttgatttcaatgtctagatattgtgtttataatacatgtctccccacagatctataaactcatggagggcaagaatagtttgtccccactgtacctactgtgcctagcagaacagtgcacacagtaggtacttggtgctgccaattcatattcaagtatcagaataggggactaagagtccaaaaaactgcatgaatggaattccgaggttgctgtacgctggctaagacttatagggcaatcttttggaattttcccaagctccacctttttcttctgaaaaaggacaagcgccatatttgtctcccatctttctgttgtatggtaaagatctttggtagatgaggggaaaggggaagtggtgagaacccaagcctgaacaagtactgagaagagccactgcaggagcgggctgtcctttggcaagaatacagcaacagctgagttttccttcttaggcaaagtgtgtcatttattgcctttttttttttttttgagatggagtttcactcttgttgcccaggctggagtgcaatggctcgatcttggctcaccacaacctctgcctcctgggttcaagtgattctcctgcctcagcctcccaagtagctgggattacgtgcatgtgccaccatgcccggttttgtatttttagtagtgacagggtttctccatgttgatcaggctggtctcaaactcctggcctcaggtgatccgcccatctcggcctcccaaactgctaggattacaggcatgagccaccacgcttggtctattgcatttttaaaaagatgaaaatgtacaaattactgaagtgggctgacagaactctctctttgatggtggcaccagagggcgtcttgtggccattatagtcggagctaaactgttgcccttacatccctccaatgggagggagtgagggatggaggcctctaggcatgtcttctctgcctaggaggaggaagtccagccgtggaaacagcgaagctcacatcagcaatccccagtgtggggacatagcccagtggtgacatcaaaagatgctttcaggcttctcctggtcacagcattccataccattgcatcaagtagtgagaaaattattccctttttaattgttccaatccttctgattatatcaaggaaaaggcctcagtgtgaaccacacttccttagcatttgcttatttaccctattaagaaatagagggtagaccccaggcatggagtcccagcaggcaacagtacctagctagacatgataacattgctttatttccattgcacttatggttaccttctgtttatggcaaatgtcaatggttttccacttactttcctgtgacagtttactcttttgttaaatatatttaaatataattaaggagtccacttgaaaaaaaattaaataaaccaggtgatatgctgatatggcaaaattggtgaagacagcatagggataattcaagttgggggaaagcgatttaaatgaaaatacctgaacttggaaaagggtcaaatgtttttgcaatttgtcactgctgtcattcccaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagtaggggctccagggtggcaatagcagagggggcccgaggacacaagccaagggaccaggagtcttcatatcttgagagattctttcctgcccacgcctttgtggtttctgaaacactcggattgtaccccccaccctctgggggtctccctgtccttcttctcgggaactgtccattccacctagctccctggaggtgctccttagggacctgctttgccaccaagcattttgagaatctctcggtgacacttggatcctccccactcaccaaatcctaggtcttggtctcatcaaacaccagtcccttccacgctattcatttctcttcccatctgacagttacctactgaaatattccacctttgcgaaggggaaaaaaaaaatctggttttcgtaggaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttccccagccgctttctttgtgaagatggcatgaggataattcaagttggggaaatgctatttacatgaaaatacctgaatttggaaaagggacaaatgttttgcagtggcagtggtgaaaacaacagtttcacgcttagatgtgtgagatacctgcacatcctagaaggcccccagttggagcatcatttcccagtttcagggacttgaggtgtcttcttgactactgtgacagtccctccaaaggcaattttatttttagtgaaagctaattccgttccactgagattataatgtctgtgagaatgcagcagagggtctgcagggatatcacagtttggggtccctgatctagaacagtgctcctcctccttcttcagtccctaaggatggaagggcaaaacgttggtgttactgacagcccttgtttgcatgaactcttctgagtcacccctgctttctgcttctcccatgtccctttgtcatctcccaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaaggtgagctgtctccaccactggtgtgtgctatgtccccctctcctcctgccaaccccttccccatttggccacagccatctccagacacctccttcccactgccccacacgatcctcacccatcatgcctcacattgactcagtttgccccaaggcccagacctttttaatgtaaggcacggcagcagctaagtctcatttttgagaactgaaggaacagtgggttgctgagcccactgctccgttagagaagacccttcagtgattctgtctctaggtggctttgtattcttgcacatgccactgaatcccttaggacctcagatttctgatctacaaaatcagaagaccacacccaacactttccaaagccccttctggttctgcagactatgattctatgcgttttccccacagttgttttctctggtcttctctatgaccgttttgtatatggtacttttgaagttttaagtttctattctttacttgtggttcctgtctgcctagtgcaggtgaggcaacacatccctgtcttgccaacacctcatctgaacggctgccctgtattctctcctgtataaatgtcatgaatgaatcgcccatccctgaattgcctggcaaatgcctatactataaactggagcctgttgaaacagcctaaatcaagcctgtcctttgcagaagagatttccgacttaactgagcagattgcagaaactggcaagaatcttcaggaagcggaaaagaccaagaagctagtggagcaggaaaagtcagatctgcaggtcgccttagaagaagtggaggtaagtgtctaggatatgacattcagaaattcaggaggacagggaactgaaagaggctgcccttcaccaccccatggggcctttcctgccaggagaccctgagtctccattgggagtaacattcagccatcccaggggctgaaacatccacgggctgctactttatctcctaggcgttctctggcacagttcccctttgaaaataaataaatgtgttcattatgttcttcaatgtcttcctctcaggaagcagaaaatcaatcacctaacatcctgagagcagcgcagaatctctcagttatgtttaacatagaggcacagacaatcatttttggctatcaagaatcctgtataatccaaacacacccagcatctcctgatgcagtaatcggtggtggtcaggatggctggtggtttctagggaaatacgaaccgacacaggataacaggagagcagttgccctgtcattttagagaataggttgactcctgatttatggtcactattataatagataccctcaataaaattttcactaattaagaaagatactctatctcaagtcataaaataatttgttcatgagcgatgcaaagttttagtcccagtttcatcactattagggatatttgggagcaagccaaatactcagacctctctgaatattgttctcttcatctataaaatgggtataagaatacctatttgcagccgggcatggtggctcacaactgtaatcctagtactttgggaggccgaggcaggcagatcacctggaaggtcaggagttcgagaccagcctaggcaacatggtgaaaccctgtctttaccaaaaatacgaaaattagccaggcacagtggtgggcacctgtaatcccaactactcgggaggctgaggcaggagaatcgcttgaacccagggggtggaggttgcattgagccgagattgtgccactgcactccagcctgggcaacagaatgagactctgtccaaaaaaaaaaaaaaacacaaaacctatttgggctctgggcaccatggctcacacctgtaatcccaacactttaggaggccaaggagagaggatcactggagcccaggagttcaggaccagcctgggcaacacagaccctgtctctaccaaaaaaaaaaaaaaatttaaatttaatttttttaaaaaaacgcatacccatttgatcgtatggggatgaaaatacccattcatgaaggtggatgtccacggcactctcaatcactcctttgctttcgtcagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggtgagcacggtggccgcctctgcgtacctggacgggccccagcctgccaggcggctctggcctcactctgggtctcccctgcaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccaggtgcgtcggccctcactcctccgctgaaggtccaccctggggcagatagcgcctcctgcaccgtgcagctgcttccgctatccctccactcagggcccacgccgtgggaaggagcacccggtttctcccagactagtggtcaagacaaattttcttttaagcttgcttcttggaataactgactcttgattgacagatttctgagctttctctcatccaaacattaaacatcttgcacgttgtggggaaatcagagcaacgaaggattaattattacgtaaggcacctggaagtactatttaagtggaaaccttagaatattaagattttatttcaaaataattatttttgacccggctcagcgccacacctataatcccagcactttgggaggccaaggtgggaggtttgctttagcccaggagttgaagctgcaatgaactatgatcatgccactgcactccagcctgggcaacagagggagaccctgccaaaaaaataaacaaacaaacaacaacaacaaaaacacaaaataattatttttataaaagtttttaaaactcctttgtttaaaaaaatagaaaaaacaagtaaatacatggaagaaaaaagtcaagcatattattaacattctggggtctctcattcttaggcccattgtgaattatataaatattatatttttgcctctaatcccaggaatttgggattgtttgatctcaggagtctgagaccagcgtgggcaatatggcaaaaccttgtctctacaaaaaaaaaaaaaaaaaaaaaagttttaattaaaaataaatacatatatatatagtcaaagtatgagcaatcttttgcaacctcttttttgaatttaacaatcatgaacatattttgacatcttttttttttttttttgagacagagcagagtctctttctgtcgccaggctggagtgcagtggtgcgatctcagttcactgcaatctctgcctcctaggttcaagcgattctcctgcctcagcctcctgagtagctgggattacaggtgcttgtcaccacacccagctaatttttgtatttttgtagagacggggtttcaccatgttggccaggattgtctcgatctcctgacttcaggtgatccgcccgcctcagcctcccaaagctctgggattacaggcatgagccactgtgcccagcttcgacatctttaaatagtcttctatatgatttttaatgacagaaaagtaggctattctacttgtatattatggccctttcatttaatcagtcttctgtggttattttagattgttctcaataaaaattttacttttagaaagactattttgatgaacttcctcataactaaattttcatatacttctatgattactataatcttaatatttctagaagtaaataaatttctaaaaatgaaatttcaaggtccaaacagcaaaagtatttgtaatataaattgttctttaacaaggttgtcccaatttttatttccactggggaaacgtgtgagagttctcttctataaattctcaaatactctagctcttattttaaaaatcttcaccaattttattgctgaaacatacctcactgagtttttagtattttttttattgctaatgaggtggaacattttatcacatttgttggccatttgaatttcttctagtattttacccatttgtagtttttgccctttttttaattgatttgccttatttgtatgttaagaaagggaatattttcttctgtaatgtacattgcaaatgttttccagtttgtcgtcaccccttacaattctatttatggcatattttgattatttaaattatttttcatttcatatagtatgtctatcatcatttccttgttccaagactttttactgaataatctatccatcctcaaatatttgaaattctacttttatcatttactgaattctttcatgtacaattcttgggtctgtttcaggactttctgttcagttaagaataaagaaagaatgtacagtactgtacccagcaggtcacccatgtgaaaaataagaaatggaacaggatcacaatttacttccctccccagccaaccctctcccaatttttttaagcgccccaatagaacccacacccctgatatctaattcttcttgtagaacacaagcctgataaataccaagaaaaaactggaggctgacatagctcagtgccaggcagaggtggagaactcgatccaggagtccaggaacgcagaggagaaggccaagaaggccatcacggatgtgagctctgttcttccttttcagagatggggtttggaactgagaaagtggggcctctgagccagggtgtggcaagtatgtttcatctcttatgacaacaatcggttagtggtggcttcccagacagatgtaatgaggtacagtctcagcagtggcaaagtgggaggggaggctgtggggaatcagcaatgactggccccagtcagacaggggaggctcagcaccatgatcccagccttcgcctcttctgcaagctctgggtagggatgggcggacagggcctctgatgtgtcctgtgaacttaaccaggctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtagagtttttgagaggactgttactctgaaagtgacagcctcggacagaaccacagtccagaaactgagatggtgggaaaaggccactgaatgaatagattgcaaattcagtttcaggactgcttgaaaaattccctgtgagcttcatttctcacctctttctgtttcacctgttcctatgccccaaaacacacacacacacacacacacacacacacacacacacacacacacacatctattttggtatgctcacacctcagtaaatgtaatataatgatgtatgttaatgttcacattccatttgctatgcagattcagatgcacgcacatacatggaaaaaactattaacatatactctacagtcataaaattactcattttgatgcatttacattttggaccaagcttcactttgatcaacacggcccatcctacataaaatctgcagtttccgttttctcccaatctcaggtttccttccctccccagcttttctcatctgtcagtgcaggctgcaattctggcacaggtatgtctcttgctccagccccaaaagagggcgatcggggcttcttcctttagcttgatgcaccagcaaagttcaaccccccgacacctggacatccctgctctttctttatctgggagcgtatcctgcagttattattcagtttctttgctgactgttccctttgtttcctgtctcccttgcttttccttttagacccatgtggtttatttcaatcattttaaaatgggctccactagtggttgacattttggaggagggctctgcggaggaggctgttcgaatgtctcttgtcccagggagacaggaaatgaaagagagggaggaaaggaggatgaggaggaggaaaagagaaggagacaacttttcccagcaggaaagcctccaaatactgtcattctttatgcaaaccacccgaggatatcctccccaggcacatggtcccattaaatgtgaaaggattttttttagggaggtgctaaaaacaacaaggccatagactttttgaataacaaaagtaaacaccagggaagttagaacttcccccaaaattctttaatgtttattttcaattatccccagtcctattccactacaatgagtttaggcctgttcttctcatggatccctcctatgggaaaaggattagatctcatgacaccttctgccatactttgattcctgggttggcggggagccctcggccaccctccccctcccatggtgaggcaccttgactgtcctcccatcccctgcccggttatgtgacttccataaaccttacagaagcctagaaagaattcccaggaaaacaaatgttttgtagaacctgatggaagacatttcctgggtccaggaggtggagggtggggaggttttgggaacagcacccagagtaagcctgtccgattagtagttttcaaggctgatctagtgagtctccaagcccagagttggccctgctctgcagccactgggattcccagtggagtggagcatgcagctggctgctgcccctccctggcttcaatctctggattgtggagttgggaccacagttggtgacttatgtcctcagtggctgccctttcccctcaagacttcaagaaaggcagaagcaactatgaaattaacaacacctgtgtagtgctttgtcattctaacaatactttcacatactttcatttgatctccacatttgaggtaggctgggcaggaaatattatctccatcctaaatatacagaaactcatgctcagtggtggcgactgacttgctttgggtctatcaagtgggcctggagagtgctttgactactcctggcccaggttctcttcgtgatccctgctgccttacttgatctgtaagttcaagttacttgatctgctgtaagttcaatgaacagttgggcaggtttcacctgcaaggacaagtcaggttagcttttgctgcccttgccaaacgacctggctccacaaaagggagcatctaagcaaatcctgacccaccagctatgctctgtgcacctgaggctgcctctgcccagtaagggcatcttattctcacttgctcaaagcacctgcattgtcaataaaatgtggctcctaagacctaggaggagacatcttggcaaaatcccattaggggatcgttttttgttctaactttaagttctggggtacatgtgcagaacgtgcaggtttattacataggtataaacgtgctatgttggtttgctgcacccatcaacccatcatttacattaggtattactcctaatgctatccctcccctagccccctgccccctgacaggtcccagtgtatgatcttccctttactgtgaccatgtgttctcattgttcaactcccacttatgagtgagaatatgtggtgtttggttttctgttccttagtttgctgagaatgatggtttccagcttcatccatgtccctgaaaaggacatgaactcatccttttttatggctgcatagtattccatgatgtatatgtgccatattttctttatccagtctatcatttatgggcatttgggttggttccaaggctttgctattgtgaacggtgcctcagtaaacatatatgtgcatgtgtcttcatagaatgatttataatcctttgggaatatacccaatattgggattactgggtcaaatggtatttctagttctacatccttgaggaattgccacactgtcttccacaatggttgaactaatttacactcccaccaacagtgtaaaagtgttcctatttctccacatcctctccagcatctgttgtttcctgactttttaatgaccattaggggatcttgagttcactctagaatgattggcccatgagtccatgagagaagcctgggagaggagatttgaattctgtgttcctttcatcctactcaggtgcgggagctggaaaatgagcttgatgtggaacagaagaggggagctgaagccctgaagggagcccacaagtacgaacgcaaagtcaaggagatgacttaccaggtaggggtcccaaaaacctcctcagtgaatgctgtatggaccaagccccatcagaagtgaccataggtttgcgggcccctgccacgtgtactctgtttgcaggctgaggaggaccacaagaatatccttaggctccaggacctggtggacaagctgcaggccaaagtgaagtcttacaagaggcaggctgaggaggcggtaagcacaggaggtccccggcagtgcccacagacagacagtccctggggcatcctgggtgtccccgccatcctggttggtaaagtcccctgagcctcaggcctgagtttgtatttgcaggctataaacacagagacaactgccctcttcctctcctggtccatgttaagccttcacgaccttcaccatctctgtgccctcttgcctcaccctacttggccagccccctccatccccttcatcctgcccaccgtgactcacttgacaccccctagagcatgttagcctactctgctggcgttggatcaccctgactctcccgaaccaccccagtctaccctcaaagccattcctgctcccatgacctgacctgagatacctcatcctaattcccaccatcccaccacagcccaccctcctaggcatctccagccttcctcagccctccctaactccctccactccatcccatcctttttcatccaccctttgatcaaataggtgaaatcaataggaaagaaatggaatgggctaaaatcagtgtttcccaaagtgtcttctgaggacactggttctgagggatgttaatagcaggaaggtggggctgccatggggaggagcttatccttttatagaaaagagatcgtttgggaaaatctgagttaaacaaagttaccctggttgctttacttcaaggatatctcagattttgtagatgttgtagagtttgatatgtcatcaactctacaaagtggaagaagggttccagaatataccatttctcactcttcattgactttagaaccttcttattgtatgcagagcatccctcagggctactgttctgaggaccaaaatttaggggagtctgccctggacaaatgactgagcttctcccattgctctttttcctcccttccctggagcctggttggttcaatcctgacctcagggaagcagatttgaactggttcaatattgagagcaattcacgcacatgggatgagtacagtcccagcaggatcggcaggctagagggtgcccaggaggacattttagtcaggaatccttgacattcccccaaatagaccagtacagtggcctggccttagacagatggtgctgggcagaggcacaggacgagggagacttgggccattggtctctataccttcaggtgccttgggagagctctggacttaggtctcccccgaagatctctatggagcagataccatatagaagagattcaagggaacatgtggaggtcctagaagggacagtagcacctgcaaggtgatccgaggcagtacacatggtcgtgagctgggagccttgtcctcacacgctggagaaagcttccctgccctctctgccatcagggaatccagggccctggttgcttaactcctcagaggccttcagagacagggcacctcataatcagactgagaggctctacagcgtcataccccctctgtctcctgtgcaggaggagcaggccaacacgcagctgtccagatgccggagagtccagcatgagctagaggaggccgcggagagggcggacatcgctgagtcccaggtcaacaagctgagggccaagagccgagacgtgggcagccaggtaagagcaggtacctgagatataggggccagctaagaacagatattgaatatgggggccaggtaagagcgaatgcctgagtgtgggaggccagataagggcaggtacctgagatgtggggaccaggtaagagcaggtacctgagatgtagggggccagggaagagcaagtacctgagtatggcttcttcccaagaaatcccaagccccgggggagtcccatggaccacccagggagagcttggaagatgactgttgatcctctccttcctgctgctggttgcacactcccaaatgctactgtttgagcaaagactcctgtggttccaggctcttgaaagaatgagcagtgaggcacgacactgtcatccctgtctgtccctgttgctacagatgctgcccatgaagcccctgttttgcagggcgtttgtcctgtcgccagtagctagattgatttgcttttacaatgttcaaagggaaacaacgccattccttaatattcctctgaagttccagattttccagctgcttcacttcaagatgatgttcagtctcccatttagttgactcatttcctatgtacaattatttttttctcccacagaagatggaagaatgaggctcacctgatgctcgttgccatgggacacctccgagagagtggagggaaaatgtgtgagaaataaattctcctaaatactcggattcccggctctgctgtgtttattatcatggtccattcctcttctatgaagctgatatttagattcttgctgctctatcgtaaatataaaataaggaatgtgaaagtggaggatctttgctccaagtagaaaacatggaaatccaacccatggccaggtaaatcactagcttccacaaacatttaaaaataaagaccctatatcactctacatctctcagaatagctattatcagaaagacaaaagtgttggtgaggacgtggagaaaagggaactcttgtgcactgctggtgggaatgcaaattggtacaacctaatagcagtttttcaaaaacttaaaaatggaactaccatatgatccagccatcccactactgggcatatatccaaaggaaattgaatcaggatcttgaagagatatctacacttccatgtttattgcatcactcttcacaatagccacaatgtggaaacaaactaaatgtccatcaatggataaatggataaagaaaatgtgtatatacatatatatgtatatatatatacacgtatatatctcgtatatatgtatatatatacacgtatatatccatatatacgtatatatatgtatatatctcgtatatatgtatatatcaccacaatgtgcatatatatgcaaatgtacatatatatgcaaatttgaatatatatattcatatactattgggaatactattgggccataaaaaagaaggaaatcctgcaatttgtgacaacataggtgaacttgggggacattatgctaagtgaaataagccagatgcagaaagacaaacactgcatgacctcacttctatgtggaatctaagatagtcaaactcatagaggcaaagagtagaataatggttgccagaggctgggagtaggaggaagtgggaagatgtttatcaaagggtacacattttcagttatacaagatgaatacattctggagatctacagcaccaggcctatctatagttaataatgtatgcatgtattaaaacatcaatttgtgtaccttaaatatatacaattccttttgtcaattatacttcaataaagctgaaaacatccaaaaggaaggaagaagagaaggaaggaaagaaaataaagattctttcagataactgtagtacattttcctcctaggaactcataattcttgcaatttacttcctcattttctctctgaatttacagatagggacactggggcccagatggattaagcactgtgactatagttgtctagggcagagtggaaattacaccctggagatcctagacttgcaggctgccaagcaactctgcttttccatcccatcccttttaaaggctttgtcgtacaattctctcatgcccacccacagttccccttaacatctgagaaggtagtaggtactgtcaaactcattcactcctaggaagacagatgctttagaaaaggttggataggggctcaggtaccaccttgctcctccttccagctagggtaactcctccccacctgcatggagcctcctcagggtgttcagggccaaaaggaaaagggagcagctgggtccaaagagatgttaactttccaagtccaggacgagactggacccaggcaccattctccctccccaatgggaaagaaaactactgctagtttcacatctctctctcggatcttaaggatctcatccattctgattatgttgatttgcttaccctgaaggggcacagtaaaatggaataaggacacttatgggtggattaggagccaagtctaaatgtgagcctcatcctgaccacttaatagctgtagctgtgtggccttgggttgatcacatatattctctgaacctgagtttcctcattggtcaaactgacctgtgtggacagaagcacaggctttaggttctggcaaacctagatggaatcccagtgctgtcacataccaactgtgtggtcatgggcaagttattctcattg

SEQ ID NO: 14006 - DNA, 30272 bp, Human
tacataatctcccatatgtgatataataatataatttctgatacctatatatataaaatctaatttaattcatacaaccccgtaaggtgaaggcagtatttgattttcaccacatttatgtttttaatagataaggaaatgcaaggttatagaagcctataatatttcctaatctgaggaaagtagagagcgagcagcttttacacagactgcttaaagacagtttccaaaataattctccttatttagattggagccattcttcccactcatatctaatcacaaagaaccatacaaatacaaaagccttcgcattaatctcctgtgttttctatgtagacaatcctttaagaggcaagtctaagggaaatgtgtactccctcacccagtgctgcttctcttctctccttgtccaagctctgcaaggttctctgatccactcctggtggcccataataggggtcccactagaatattatggtcttgtttcagagctttcaaaatctgagtgatcagtctatctgtaattgatcagagttttaactattatgtaaagagtcctcactatctgtaatcctataactcatcctatgtatcttggtctcattcatattttcttctttcatctttcaacttcaaatacagtaaatataatacatacttattatgtctgcaagtcagatgttaagttccaaaagaagtaaaaataaatgagttgtgaaaatctgagagaaaaaatagaacaagtttccttctggcctagagcctagcactttgggtaagtcgctagacttcggtgagttattttcatggagattttgtttttaacgcctgatgacctatttcatagaattttatcaaaataaatttttaaagtataaaagattcaatctatcaatgtgtcaaagataaattctaagtcaacagaattataaaaacagtgatctcattaattggtaatttaagccagctaatgatagttgaaaatatctcaccagagctcagttagggtcacacttagagtaggtatatttcctgccatattcagtaacagctgtgtatgtagcaaaaccatcaaaagccaatttatgagtattatgggcatatgtgatggcccatccatcttttcaatccacagggagaatatcgtggataccatgactttcctcccaccttaaataaaaatatgcggttcccacctcattagagctatagctagtcatgagagtctgcccatgaactaggaatgcatgtttgtgtctccttccattatgcagaggaaacatgcatggaacatcacacagcatcctgttgttccttcagtgaaaacatacaagctggagatatccatggaaagtcctccagaaaaagaacagaagtgtttatatctattctaaatcccttatgcctcccccagtggtccatcaccactgcctaatctgagaattcactttcaccttcatatttagactttcagactttaaaagaatctatcgccagtctttctaaaatccagactgtggctaggaatgttgtcttaaaatccatcgctcactgcttccaatcatagtgtcaggtctaaaattcattccagactccttaatggctctaagaaccaacaaattaattaatcctaaattcctcacatcagactcattctgttggaccaattttataggcagaggagtaagtgggaatctggctttgaattctgtgatgaatgatgcaacagccaaactggagaaacagtgttagaagccctgaatccccatcccctatcaaatgcctataaagaaccctagatcatcctctgttaaattatttatgggtgtcaagaaatatttctaattatatccattcacagccacagtcagtgaatattgtgcaaagagattgccaaaaacggttttgccaagtaggttcccagctaggacagctgaggtggctgctgtgtttgcagaatggtctctataaaagtggagctgagatgcctctttcccatccttcctcaaaattcttgaaggtatgtatatgtggaagaacacttacttttacattcctgatgatgatgatttttcatttaagggatgtctactgcttcccaaattttaattattctttccaacattcttaaggacgacattgtagacaatatagttactagtattttgtgattaaatggggaaaaaaaagcatcccacattctcttttttctttcaacagtagttgtctgctttgagcctgccaccttcttcatctgataatacaagaggtaagaataatttattattacactctaaagaacaaaggaatctctatattgctacatcttaatgagctaccattttatttcctagtttagtattgggaataggatatcggggcagctgttctttaaaaatgccttctcataaaattttgacttttcaggccacttaatcaaacaaaacttaatgaaacttctctttcacatgttgttagaactacagaaagaatgcagccatcatatgtaatatttaatgtgaactactactccaacttaacccataaagatatatcagagagaccgcatgataaaatcaaggtgtgtttatctggaagtcgatatttctaggtgccaatccaggcttttcactgattctatttgcctgggtcaagccagttagcctttatgtatcttgaaatacagtgtgttgcaagtggaattaacaaaactgcatttagcggaacaggactcatgtcccagtaccgccacttatcacccaccactatgacactgaatgaccctgaacctttctaggccttagtttcctcatcagtaaacgaggaggctggattctattgactgctaaggtccttccagctcttgccaactgtgattgacgtcagtggttttcaaggactcctccacagaatcaaaacatttaatggaaccctgctaatggagaatcaaaactaatggaatcctgctaattgttcatgtggagacatgtacttttagtatgatgttaaggatatatataatcatgaaaacctattctacacttaagaattattttaaatgagtttatatttaacatagcagctatattcatttagaaaagaacagaaaacactgttcatgtggaaatgttccttccttaaacttgaggcaatgatcactgtgtgggtggattcaagaaccccctgcaacaacctgaggctctatgggggcttgatccccaagttgggaaacaattaatctataataagacaggagatgggaagggtagcaatcatctttctgtgtttcctggatacactgcattatagtaacctccacgtggtagtgtgttgttaattcaagttgcctggtgtaaaaacaaacacagaaacaaaatataatgtaatataaataacatttcttcttcaaagaaaaaaaacctgacattaaatgttccaatatatatcccctgaaaatatgtctaagtttcacagtgtcatcaggacacttttacagataagactgattttgaaaatagagtatgtggaaattccatagctaacattttaagttgagggaaagttaatgctgatgacaaaagatcaagactctggaaagcctacagaaggtggtggctattgctgttgtcgccatcattgctgtcattgtcattggcaaccaagacacttctgctccacagaggtcaccttcttttattctggccactcaccctgtccttgccatcaggacagcaggacttattttattttctcataattaatttgtcagtagggaaaattttttaagttcattttggcttgaaactttatactggctatccatttcagaaaaatatttagaagactggttggtatttttaaaaagaggagaagaaagaacgagattataaacctaagaaaataagaatcagattttaaaatatgttaggttgaaatccaactaaaaacaaagagaaatacagatcaacacatacaatcactataaaattttattaaaaattaagaagttccttttctccaagaatcttttaaagttgtttttggtttagatactacttctgactttcaaacaatttcaaaactaataaaggagattttaattttaacttagggcaaaattatatgttggatattcagctttcattgtagttattttttcctttacttacctaatacctgtcagttaactaggtgtttatttgtaatgattagatctggacttatgtccggaaagaacaggtgtatctgtctacattcaattttagtaaatctgacatccaattttaataatttgggatgagaggaaaatttgcataaagatctgtatttgagtttttaagacaggttcatttatattgtaaagccagtggaaacagttattgtccatttctttgtatcatcacgatgttaagagggggaagttggaaataagaaagaaaagaaaagtagcaagaaaaagaaaaaattctgaacatgcttggagcatcacaaatgttgctgattgaatgttgattcctccacatttctcaactaaggtttacaacatagaggatggaacttaggcttaaagtatcacaaaaattaagctatcaacatagtgctttcaaatcaatgagctgatctctcagctccttgacatagtatacaggagtggtccctaaaggcaggggtgaggaaacaagcatggaaaattaagcacattaatatgaaatcaacagaacaattctccaccccaaccctgaatcatcatttggctctgtttcttcctctaggtatacctagtccagtactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctgtgagtaaaaacacctggagctaattagactctgcctcattttgggttaatttaggtgatatttttttgacctggctttttctgctacttatttgatatgcacttgttttttcttttcttaacagactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacgtgagcaccctttcaacgctatttctcactcactccacattctacacatgttagctaaaataaattaaggggtttcaatacatttggctattgaactgttcttttatgaccaattgtttggttaatgttgtaaactctgatatgttttaaaatgtacatgtggaaaaccatttacttaactgaattagttgaaaaactgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaaaactgaagcattttgtgcagcagcaatgatggaaggaggcaacaaatgaatgaaactttatgagaactaacacagtacttaggtcctgctctacttgcccttaaacagtatttccaagatagataaacaaggtgattgctgatcgaggaaccccgtcctttcccacagacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactggtgagtgagaattacaatttccatagccatttgtaaaatagttgtatactgatatcagaaaaaacatagggctagtattctgagaataactgttcagcacaaacatgataacagaaataataaaattagggaaatatatttagaataaaatgtactagttccaaacatagaagaagttttgcttagatttctatgctaagcactagttccaaaaatagaggaaattttgcttagatttctatgctaaaatccaaattaactaatgctagttccacctcaaaattaattaaatttaggcatcaactctgcatttgaattatagataatacataatctctcctaaaaagtaagttttgaagactcacagtgacaagttatcacaagcacagtacaaaactttaaattggacattgacataattttgtactatgaaccaggtgactggatgggacacaaaattgttattaatctgatattgatagattattctcatggacaaaatggtaaaatgatgcattacatagtctatacattagaaaggtaatgggattattaattagcacatctttgatacttatttttagaaaaaccttatgagaagcaaagcacaaattcatatagttatttttgcaaatggggagttttaaaagacaattttgagtttataagtactgcgttgacctatgtgttaagtgtgtttttctaaatattatctttggcttctcttttacagatcgtgaaaaccagtcaatcttgattacgtatgtagatttcgttactttctttctgttttgatcattgtagtggctactactaccttagattctgaccttttcttctgtttgaacttgatagtggagaatctggtgcagggaagactgtgaacacgaagcgtgtcatccagtactttgcaacaattgcagttactggagagaagaaaaaagaggaacctgcctctggcaaaatgcaggtgggcatgatattcatctaaggacagaataacagattttaaaatctaaccacgtgcacatcaacagtagactgtatacagaaaatgtagtacgtatacaccatggaatactatgcagccttaaaaaagatcaaaatcatattttttgcagcaacatgaggaggccattgtcctaagagaattaatgcaggaacagaaaaccaaatacagcatgttctcttataagtgagagctagacattgagcatgaatgggcataaagatgggaagaatagacactggagactactagatggggaagggtaggagggaggcaagagccaaaaaactacctattgggtactatctatgctcattacctggatgacaggatcatccataccctaaatctcagtatcatgcaatatacccatgtacaaacttgcacatgtatcccctgaatccaaaataaaggttaatttttttaactgactgtggtgcttcaaaatcatagcagccaattgcaagtgatgccagaatttggaaaataactcttggaagagctcatgagaatgagatgaatagggcaatgtattggcaagtataataggcaaaaattctcacaatcattttttaggtgcttttctgggcctgggggatgcagaaatcaagaccacatcactggagtgtcccactccccttcccgatttaccttctttttaactcattttagaaagcctttcccaaagttacagaatactgtgcaggggcaatggggaagggaaagaggtcaatgggaaattatttactgcaacttttttctttgtctgtcttattcatttctcttaaggggacccttgaagatcaaatcatcagtgctaaccccctactggaagccttcggcaatgccaagaccgtgaggaatgacaactcctctcgctttgtaagtctcttgatcttcattttcttgaggatcagcactgattcttgtgtgcatgtggtgtcaatattttttccacctgtttggtccacagctaaagaaatagtttctgattttaatgtgtataataatccctccttttcttttttaagggtaaattcatcaggatccattttggtgccacaggcaaactggcttctgcagatattgaaacatgtaagttaataaatattagtgattgagaatctttttctttgtgggtacatattagaaaatcttgtacttatttctgttgtgtgaaattttcaaacacttaatttttcactgtggcatcttcttttaaatgagcttaatctgacttccagatctgctagagaagtcccgagttacttttcagctaaaggctgaaagaagctaccacatattttatcaaatcctgtccaataagaaaccagagctcattggtaagacacatctttgatttatttctaccaaagaataacagcccttctaagaagcctctctgaaatgtttttgatgaccaaagcaatgctgtctatatactgttcttttccatgtgttcagaaatgcttctgatcaccaccaacccatatgacttcgcatttgtcagccaaggggaaattactgtgcccagcattgatgaccaggaagagctgatggccacagatgtaagtaataggtacaaagtagtaaaaagtaaattcattttccagtgtacaacactctcctctattagggtggaaagcagtggcagaaagactataaataggtaatacaaccctttgggctttcttacttttggaaaaaaattgtaggatatttcaataccctccccctacatgtgttaaaaagctttcactgcctgtaataaatgttgggtctttagtattccttagctagtaggctcctttcattctatctttcttattagtcatttttggttgatatttatgctccaatattaatgtttctctgctattttatgccacacctcacacccaagattctgggaaggagctgcaatattattacaactaaacatggaactcccactgttcttctacagtcacatgtaaacataagccttattttgaataaacctctgtgggccaatgatatatccctctctactccctaagcagcattagaagaagtgggttgtctacttcaaaaacactcattttggggactccataagcctttatatttatttttgaaacaacgcactctctccccaccatcacctcttttttaaggattattgctttttggcttactttctttatatgtaaactttatgtatatttcatgctttcttttgatttctgaataatcttccttatttttaactttaatatcagtgggactatcccaatacccccaagttagagttgacagtgcttgcaaaactgctttttctattaaaatattattttcaagaagtcaataattcatttgtgtggctttatattataaatatcagctttaactctctataacttattattatctttgtatgtccaaaagtgatagggagttaagaaacacaccctggtctgcgaggttaaaaaaatgtagcagtcttgctctaagacttccgtaataatgtctagtttctgtaaataggtagagttagtgagctggaagtggaagtcaataatctggggaaagagtcttaggtaagaatggtaaataaacatattttcctctgcctgctctgaatcctgcccccatttataagccttttcaaagcctatgtgggcaactaaaaaggtaatcaaaattcgatagagaaaaaagacacagaaatattatactaaatggcaaaattccttcttttcataaatgtctcttctctgcatgagaaataaataactaggtaaagtttgctaccccaggcatctcgtggtcgctgagctgtggcttgctatcagagaggcatgtggagaaagactcacaaccattgctgttctcctcataccctctttccaactttatcactcatgcccattagcaggggaaggtagactgggattatgcattaggataggacaaataggagaagaaggagcaacagagagactcgtgagactggagaaaagaaacaaaaatagccaaaagaccaagaggagcatgtgcctgagaagcaaaggggggctggggtggagaaaaggggcaaagcactggccttggcatcaaaagtcatggctcttagtcctggttcagtgagtgtggacaagtcacatcatatgctgtgaccaaatggactcatgactcaaatggaaagactgatgcatacctcttcgtgttgccatgtggatcaaaaggtaaagcatatgagtaccttttgaagatggcaaagtgctagtcaaatataaggcaaggcgtgatgagaaaaaagtgggagacagccccggtgttctgagggattcttccatggtgctaattggggatgagcaaattcaactcttttgacagagtgctgtggacatcctgggtttcactgctgatgaaaaggtggccatttacaagctcactggagccgtgatgcattatgggaacatgaaattcaagcaaaagcaaagggaagagcaggcagagccagatggcacggaaggtaccaccccctgttggtatcttccacttgacaaagctgacatagtgaacttttcagaggcagggaccgtgtttttactttctctgacctagctcgtgaagggcaaaagtattacgagaaggaaattacacactgcctgacgttttacattatttagcagatttgtgatttctgctcattccattattcattggcttttcataagctcatatttgctatttgactaaaacatattttatttcaggataatctgtgtgcccacaggcactgaaagaaacagagatctgaatatttctgtcactactcctctaggttagggtttctcaaattatttttatctgtggtctacttttgccaggttaaatatcacagacagcatcgattccccaacctccaatttatcatcacaagaaatgactaaaattagtgcaagtggtggcaatgcttttgaggcaatatgaacaaatgaaaaggtttcaatgacatttgcacatcttactttttgagtgaaaccttttttctttgtcatcatcatttacattttaaattgtgtaagccatggtcagtttcaccattctcaccttgttcacacagttgctgacaaagctgcttatctgacaagtctgaactctgctgacctgctcaaatctctctgctatcccagagtcaaggtcggcaatgagttcgtaaccaaaggccagactgtgcagcaggtaaacatgacttaaattgtctgatttatttgaaccgcaagtgactcaggagttcatcactgttttcaatttaaaaaactaaactatcacttctgttgaaggtgtacaacgcagtgggtgctctggccaaagccatctacgagaagatgttcctgtggatggtcacccgcatcaaccagcagctggacaccaagcagcccaggcagtacttcatcggggtcttggacattgctggctttgagatctttgatgtgagtagtgaactgacagaaaattagccagtgcaaatcctcttgttagagcatacaaaatcacatttacaaaatgtaccttacaaaatatacaaatgtaattcctactgaaaggagtctttgaaaagatatgaaaagtaaataggtataaataggaaaagagaaaattctattcttttgagtctagaagtctcaaaagttgatccctgagaggttaaaatagtcaaaatctatcctggatccaagcagatgagcatgagaacacctttttaaaattactctaaggaaatatttcagagtcctcatttaacagtattttgcctagtatgcatgatctcatgcagttacttggaaaataagtattcaaagaatcaattctactttgtttagaactatataataggaaaacaatctgaaggtttataatttaataaaccaaaatgccttaaattcagaagaaaatactaatagatactctgtagatagaatacttgttatgcgtaatttcctatatttatcttgttctgtagttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaaggttcatatgacttttctagctttcaaaacatgaaaaccaaattgcttgcctccctgtgcttaatcacactccctgttctcaaagaacaagcagtgctgtttcctgacacactcgtatattctgattggttgtgaggtatgttccaagtgatctgttattaataagtagagcagtttgtagaaaaatgtttatcactcacacacatatggattcgcatttatccctctaaaaacttaattctccctcacttttcttcctacactatttcatgcatatgggagaaagggatgaaattacagctattcctctgggttgtgtaattaaccctggtgtacccatgacagtgtattgtgcatttatcatcatccctcatgtgtaacaaggcaggctatgtcaacacgtcttaaagattggaaggttagtccttcaactgttgcagtcattaagtctttccccgttcatgataactactgaataaacaccaaacctctgtatcacttacctagaaaatgggccctgaattccccattactaagggggtgaagcaatagttacatcagatctagatatgttaacactcatcaagcaatcgttaaacacttccaaaagtatcttgggagcttgtcatatacttattgatatcaataaagtgtatgtgtgaaccctaccctaagcagtgggaaaggaagcgtaaatgcaattgccacctaggaaaacttaaaatactcaggttaaaattcacaaaaatatgaaagataagagtttaaaagcagactaggtctgcacaatttggggaaaagatacgttaatctggtgatataatatctctactattcatgaaaactttatggtcttcagaaaaggcatttattttattctctagtatttcagtttctgtatcaccaaaatagtcttaggggtacaatttgtgaatttgttaaatcatcaatgttgaattttctttcagtctttcctatcaaatacattaagaaaaaagccaaactcttagaaagcaaaaccaaattactatcacttaactccacagtggtagagaatataggttaaagtacagaattttaatgatacaatataagatgcaatttcctcctaggaatggatcatttttagtccttacacataatctctcttcccttcatacttctgtcacctctagattcgaggtaaaggaagttatattgtcagtaggaaagaaagtagtcagatatatacatttatggaataaagaattcaattttgaagtgatgttttcagaatctgattttatacactgaacataaagtgtgccaaatagttcagatgtattttttttaactgagtctttctagcaagtatatttcccatatgttctgggtacataatgactgcttcacatgtcatgcctatttaatttatcattcaaagtcttcttttgaaacattgtattttcagttttccatcaattacatggagcataactttctgagggactcatcattatcatcccttttttcctattcttagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcaggtcatgtttaatagcactaatatgttacaagagtcacaaaatagatatacactgttcaacagagacaaatgtagttacagcaaaacctgacacaaaaacactggccaatacatgcctaatgaaagaaagtgtatttaataactgtgatacagtcttacagtcacagactttcagagctaagtgacactatggagcatttagcccacagcctgatttcactcatgagaaaacaagaatctcagagaggttaagtgatttgctcaggatcataaaactcatttctatcattttaatagtattggttctttcaaggttctccagctaggctggagataaggaaatcctttgtcagggccctagtgcttggggaactgaagttctgttctcttaagtgttctaagaccagatgtgcaagtaacaccatggaagcacaggcaaatgggagccaggatttccctgcaggtgagcagaggctcacctacctgggaccaagtgtgcaactctgcctgttgtccaagtgaggcctgcactaacaaggcattactactctgtctccttggcccttccttcagagaacagacattgctgacttggagtaggggagtcccatcccctacccacatctaccccttacactcacaattcttttgttgttggttttttcatgaatgactataaagtcagccaaatcttagactttcttaatctacaattgagggaggagagatatggaaagaataggaatgatgcaagtgaatgagtgcaaatttaaattctaaagggaattttggcagtcctgatgtttatggatagtacttaaaaggcagttgcaaataactttatttttcccattttgttttttagagggtggtggtggaaagaaaggtggcaaaaagaagggttcttctttccagacagtgtcagctcttttcagggtacagtatattcttgaattacagataaatactttcattaaaaaactaaaccatcaaaacagaaaattttttaaaagatatttatggtgaaagtgaataaagtagtacagtatactttttagtatactactaaaggttttgtaaactttttaaatggcttaggaaaaaaaattagcacaaaaaaacaaactacatatctcttcacatcaatctttatgatacgtgaaccattgcccctgagccctacatccaagagatctggtattgtacaaatttcacatgaaatcaaatgctcttttaaaaataaccactgtattcaattacatctccttcatgtgacaaaaatcgcaatacaaagtttctctgactggtggtgcttgagaataacaaactgaaattaactgattttgtgtaatctgtaatttcctacctgtgctccacttatatgattcctctctgttatgataatttgtttttccttgagacagctcattaaaatgtgaaatgaaagacaaatattgatagggactctcatgtcgatgcaactagaaatgattttaaaacttttcatatggttccacaggagaatttgaataagctgatgaccaacttgaggagcactcacccccactttgtgcggtgcatcatccccaatgaaactaaaactcctggtaagacatttctgatatccagacaagctccagtgtgtgtgcgatagaccacgaagtatggcatgtggattcattctcttaggtgccatggagcatgagcttgtcctgcatcagctgaggtgtaacggtgtgctggaaggcatccgcatctgcaggaaaggcttcccaagcagaatcctttatgcagacttcaaacagaggtttgtgtctcattatttttcccttccaatgtcttagtctacacaaaatcactatataattccaacatttttaaacttttccttgaaaaatgacatgcaattatttgaaaattgatcataaaagaaagaagcttaggtttatattatcataagtttttcatcatatcttccgaagttttaaataaagcactgactttttaaatggcattttgttcaccaaaacttaatctatcatcttttcaatgatagctaccaaatgttctactgtttttttcagtgaagaaaaaccacatttttatattctttttattctgacagatacaaggttctaaatgcgagtgctatcccagagggtcagttcattgacagcaagaaggcttctgagaaacttctagggtctattgaaattgaccacacccagtacaaattcggtcataccaaggtatcaccagtccaaatttctatctgtcataattctatcacttttagactttcctgtaagtggaaataacatatttaacttgttctttcataaggttttcttcaaagctggcctgctgggaactctagaggaaatgcgagatgaaaagctagctcaactcatcacgcgcactcaagccatatgcagagggttcctgatgagagtggagttcagaaagatgatggagaggaggtgagagcccacacacaagtcttcctgctccacactttcataaatgaatccactgcagtcattacttttgttgagtgatgatcactttccacattattctccatttgcatctttttttcttttcctacagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgtaagtattatacattgcagttcagccacatcttattacttttaacgttttaaaatgaatggtttccactgaaacatttgttctgattgtttgctgttcaaaaacaccaagactcgggcataaagaagcaatagatgcaaagtcacatatcatgctgcacacgttcatatgtgcattcacacacagtttggtcatcagtgagcaaattcataaaaatatcaatagacattttcctttatttatggaactttctctcagatcagattattctttctttagtgtatttttgtgcataaaatagaagttatgttgtttttatcagggcagagaaatggctaagttaatcccctcttaaatgtgagaaaactgagtcctacaatgaacaagcgatttttccaaagttgcaaaggttagtaaagtggcagatttttgccaaagggctagttttcctgatttggcctgccacacatgaatatctgaaggaaatttgttattatacttgatcagtagataacagtattaacattttgtctgtttcattttaaaagttagcaactggtatacatgttgaccaaacaggtagtcactgaaatttccaccttataataaattattgtgtgcttatagatatagctcagacaaatgaaaatgcttaatttctccctttaggaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtacaaatcatgatccattttagaatatttataagcaccttgatactgaagtattttaattaaaaatttaatcttaagatgattgaatataaaaaataccactgtcataactatttcatctctttagtcttcaccacctcaatctacttacttgacctttacctcctattttttcagccattataggcctgggttagctcctggttctcattttccatcttacgctgacattatcctaagatactacagcatcatgtttttcatcaagataatacgttgtcattgacattctggtcatctgttctaatctaaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatgtaagtgtgaaaaagaaaatgtttccccttgcaatgaaataaacaattgtgacatgaaaccagcactgatagtcataagcctttaacgcttggtctgtgaataaagttcttgtgctatttgttgtatctttaaatttttttcttatgtatctttgaaggctactagcatagggttcagtgcttaagagctgaaataaataaaatgcatcataaatttagcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagtaagtatggtataattcagctataacctgcttgttgtatgtcaatgcaaatgaaacatacgctaaaaagatctccaaaatgttacatcatgacatatggaaaaaaataatgacatctttgacctttttatttaattaaactaatacaattattaatctgtaaaacattgtactactcactccttcaacaccagcagtataaaaaaagtcttagattatacatagaaaagaagattggtaagagaagtgattataagctaatgtgttgctcttctaataggaaagagtttgaaatgagcaatctgcaaggcaagattgaagatgaacaagcccttgcaatacagctacaaaagaagatcaaagaattacaggtaagttataacctccaccttttctgggcattacaggaaacaaaactgacataaattcacattaatgttgacatatcacaaccaggcccgcattgaggagctggaggaggaaatcgaggcagagcgggcctcccgggccaaagcagagaagcagcgctctgacctctcccgggagctggaggagatcagtgagaggctggaagaagccggtggggccacttcagcccagattgagatgaacaagaagcgggaggctgagttccagaaaatgcgcagggacctggaagagtccaccctgcagcacgaagccacggcagctgctcttcggaagaagcacgcagatagtgtggctgagcttggggagcagattgacagccttcagcgggtcaagcagaagctggagaaggaaaagagtgagctgaagatggagatcaatgaccttgctagtaacatggagactgtctccaaagccaaggtcttcattaacttgtgcccttttcatctttatttgcaacaattcaaaatgaccaagtttatatatgactatttttagccaaattacacaaacattagatggcatctgaagcttaaacttactcctagtacacattattgtattgaatcacttaagttctcttaacttctttgtagaaaacactttaacctttgatactattaccatgaaaaaaaatgtaattacaaaaaaggtttatctaaaaaccatactctaaatgatgcagaatttaaatgatgttcacactttcaaagagaatataattttgataatcatgtgttcattatttagccaaattaaatgcctctactactttatagccaccatgcaagattgatagaaaagtaaataaaaatcagcccctttccacaggtagttacagatctctaaatcccagcctctagaataaaaatgtattgtctcttcctgttttctacctctcaccccaggcaaactttgagaaaatgtgccgcaccctagaggaccagcttagtgaaataaaaacaaaggaagaagagcaacaacgcttaataaatgagttgtcagcccagaaggcacgtttacacacagaatcaggtcagtaaataaatagcatcaaccttcggagaggtgacgaatgaaagacaagcctttacctacctatcaaatacaagtaatttctcaagctctgtacattcatttatcatgtcttacttattcctccatctttttattatgagacagtaaaatgcaatgattctaagcgacaattggggaaaagaattaagctccctgggctcaggagattttttgtgactcagcattactcaaaagttctcgaattctaaaatatcaaagaaaactcatacattttttaaaaagcaagaaataaccttctcaacatcactgaaaatcttgaggggttttttcatcatatgaaataagagggttacaatgttattccattctttaaattattgtttacctagacaacagaactaaatcattgatgttttgtcttccacaggtgagttttcacgacagctagatgaaaaagatgctatggtttctcagctatcccgaggcaaacaagcatttacacaacagattgaagaattaaagaggcagctagaagaggagactaaggtgagaattctccagctgatactttcaatcacttgaaccgtgcaacataacacactattgaactttgcatagagaatttcaatgatcagaagataaacttatatcacatagtttttggttggtctaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagtatgtgcttttagtgcaggggagcaggaagaaataaaagtaaaggcagtgaaggaaaaatagaagaaagagaatattccgggcttggggacacatgaaagacttcagcttattttattataggttggtggattccaccatattcttcttcttaaagcccagtgtatgtccactggagaatggaatgagaccagatccctccacccattcttgtccagaagcatcttaaatttctttccaccaagatggattattaattatcagaatattatttatgaattaaatagaattagtatcttttaatagaaggaaaaattgagacattgagactctctggtaaattattatgagtattacaattaacaataatcagtttttcctcagatggagtattgaatgtttatattaaggttgtcatatgctgtcattatttcaactaacaacctatatcaatggatgtattcactaattacacgtactgtttgcggactacaagtcatgagatttacagatttacacatagaaggaaaaaaagcattatactcctagtgaaagaagcctttctaaatttaatttatctcagtagttgttagaattaaacaggatgaaagagtttgtagcaagcatttccagagagagttctagataagagtgtgggctgggaaaggtcatgaattacataggttggtgaagagtagtagacaagattttagaggaaatttgggaaatgcaataatgcagtaatatttattatcaaaggccaccaaatccagaaagttactgattcattgtatgaccttgaacatatcactctgggccgcagtttcctcatttgcaaaataaacagaaccatactagaaaatgcttaaagatactactcaatgctaccattccttggtgatatgcttcctgttcatggttgccatttcttcctcaaagtaaataaaactcagcccttttccacaagtagttacagatctctaaatcccaggtttcaaaagagaaatgtactgtctcttcctgttttctacttctcaccccaggcaaagttcaagaaaatgtgccacactatagagggccagcttagtgaaataaaaacaaagaaagaggagcaaattttcacattgctcactcagctctagtgctaacttatattctctttctctcatacacacacatacacacacacacgtgcttcgtaaatatgtttggcaatacctgagatggataaaaataagaactcaacagggaaaacagaattctaagagagtgaaaatgtttagaaaaattcaacaacttgtagacaactcttggggaaatatgctttcctagtcagcagctttataaagggcactgtggtgactctgagtctgctcttggtcactcatactgacccaattttcaggaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggtggtccacagtaccagctccccttgggggaaactgacatcattcttggtttcaaaggcttattttctatatacttccaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacgtgagtcactgtaatcattctatttcaaaaatggtagggagacatcttttcaatttttctttctacttaactgaaatttggtactttattattacagaggagatttctgacctgacagagcaaattgcagagggtggaaagcatatccatgaactggagaaagtaaagaaacaacttgatcatgagaagagtgaactacagacttccctagaggaagcagaggtacatttttcatttgcttagctctgcattataaataaattgaaaattaatagcaactgagatctctatcatgttgcaaatctttagggaataacacaagtaattcagtgaaaaatactgaattgtaccttgagaatgcagagctaataggctacattaagacgtatgatagtttatgggttttttaatgccttcttggggaaattatcataatgtgaaagaaataaaaagctctttaggtaacctaaataaatgttgcttttattaaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggtatgctggggtaaatacacatagtgttgtacagtctcagtgctactgtgtaactcaaattttaatgttttacgaggactatgtgtcataaatcacctaagcaacatggtaatcagttcaaagttcaaagttatacacacacaactgaaaaagagcttaattctggaaggcccaggacagagtttgctttgttatctgcagagaagcactgtggtgaggggtagggagatagaggaagtgatgaaagagtttggctacatgccactgcttaaatcacttcattaatctggacttcatttgcttaatatgtaaaatagcaccactggactcgctgaagtctaaggatactttcctgatccaaaattttgtagagctagccatggtattttttaatgattcagggtctaaaataataaaacatcatgttcttttgagtagaactgcaaccctcagctacaaagaatttattattaaaggtacttgccgattgctcctatctaatcatactctaagtcattaagatcaaagagtgtacatgaccataagtttgcatttgctttaagtgcagcatgagtaagaggctttttctctttctgtgtaggacactcagctacatttggatgatgccatcagaggccaagatgaccttaaggaacaactggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcaggtgaggttcaagactatggtttagaaaatgtactccctgaagctgaagataatttgagaagataagcttgtttataaagtaaaaagtaatcttcgtcccttcctggagctctggaaaatgtacagggtgctgtaaggatttactgggacctagctggttcacgagtatatttatgggctggcataatcatgttgagttgaaataatctggaattctagaaacttttatttaaaaagcacagaagaccatctacaaataaacatacacacaacatttgtagctgtcttgtcttatgcaactctaagctacaaaaagataggcaaataaaatagaggagaaaaacaaaaagccactaaataatatttacgtatcacatatgcacagaatgctaacctcatgggatacaaagagaagctctttagttcaaattcatggaggccattattaatactagttagcatttgttgtatatagtgaatttgttaaataaatggtggtatatcctcacaatggctaatatgtaaccactgtagtatgaatttattgccatgggaagatgtttatattatagtaagttaaaaaagcaacttaaaaataatataggctgtgtgatcttttttcccgtataaacatataggaaacatccagaaagataaataaaagtttatcctttatctctggtgagagcacagtaattattttttgtttcttgtctgctaatttgtatgttctactatcttttacaataaatatatagtactgtatacttcagaaagttgcactatataaacataactattatagaagtgttaaaattgcatgctttatataattttaaaatcaaattaatatgcaacatttttcttattaacagtatctgaagttgactattccaaacaccatcaacttgccaaaaacagaagggattcttggctcatttttatcccaacaagactactattttttttttttttttttttttttttgagaaggggtctcactctgtcacccaggctggagtgcagtggtgcgatctcggctcacagcaagctccaactcccatgttcacgccattctcctgcctcagcctcccgagtagctgggactacaggcgcccaccaccacactcgactaattttttgtatttttagtagagacggggtttcaccgtgttagccaggatggtctcgatctcctgaccccgtgatctgcccacctcggcctcccaaagtgctgggattacaggcatgagccactgcgcccagccaacaagacaactatttatgcatttataaatatggagtcaaccaacatgagttaatagctaaaaattactgattcattttaaatgagctgtggtgtggtgctccatggtacagcactttgagttttgtgggctgtgtttcatgcttacaaatggcaatggtaatagttgaatatgtttgacatcaaaaattaaatttagaagtttgattaaagagctatatatagaaaggagaaaaggcataaacttagaattatcttctaatttggtttttattctaaacatttcttatgatcaataatttttgcctgtgtacactaggtaaaatgacaatgtgagttgttataagtaaatgtgcttctcttctctttcattaatttgaaacagaacaccagcctgatcaacaccaagaagaagctggaaacagacatttcccaaatccagggagagatggaggacatcgtccaggaagcccgcaatgcagaggagaaggccaagaaggccatcactgatgtaagcaagatgagcatttgtcttactgacacatgcatgctgcctgctatcatcagaattcattattttcaaaatttatttgctaactaggctgccatgatggctgaggagctgaagaaggaacaggacaccagcgcccacctggagcggatgaagaagaacatggagcagaccgtgaaggatctgcagctccgtctggatgaggctgagcagctggcgctgaagggtgggaagaagcagatccagaaactggaggccagggtaggtctccacaacttcactcaattccttgtggccagttacagccaaactggtaaacgtctttgttcccttccaggtgagagagcttgaaagtgaggtggaaagtgaacagaagcacaatgttgaggctgtcaagggtcttcgcaaacatgagagaagagtgaaggaactcacttaccaggtgaccagtgttttcatatcttccaggcctatagttttcaagaaaatcatgagttgttttaaaataatggcaccatctacttgcacctctttcagactgaggaggaccgcaagaatattctcaggctgcaggacttggtggacaaattgcaaaccaaagtcaaagcttacaagagacaagctgaagaggctgtgagtatctccacagtggaaatgaaaggttcagatgcacatccaggttttttggggcctaaagtttatagaatttagggggttttctttaaattgggaatacataattaggtatgaacatgaatatttagaatgagaaaaatgaaccataaattactggagccttatagatttgagtttatttcttctgagacctctttaagcaattttccagacatgttaacatacaaatgtttcttagttgcaatccacttccctccctatctagaacattctacaacccccagcactcatatggacctgtgcaaatgagagtatgaattctaagcttcatttaacttcatgataaatccatcttgggactttttttttcaattcggctgcagttatctttttcattctgttaattctgaaaccttccttagggttcttggcaccaaatgccactactgcacctattttttaaagtttcttttttagaaacaagattgaattcagatccctgctactttgttcttccagttatcactgcagcctcttcagtttgccagaaagagagtcaagtgagagagagacttgaggagggtcataagcacattcatttacataggcgagtttgtgggatgccttgctctcaaataactatgttactaaataataaagcctttttctcttctttttttttttttcgaggcagagttttgctcttgttgcccaggctggagtgcaatggcacaatctcagctcactgcaatctctgcctcctgggtccaagagattctcctgcctcagcctcctgagtagctggaattacaggcatccaccactacgctgggctaattttagtaaagatgggggtttcaccatgttggccaggctggtctcgaattcctgacctcaggtgatccacccgcctcagtctcccagagtgctgggattacaggtgtgagccaccatgcctggacaacggagcctttttctttctcattcatgaggcaaatcctgaagtaacaaaagcaataacaatcaggaaatgtccaattttcttgttatctcaaatgcatctctgttctcaggaggaacaatccaatgtcaaccttgccaagttccgcaagctccagcacgagctggaggaggccgaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaaatctttagataattttgcatctaaaaatacatttgtctcttaattataagctctttagtgctattagaactaattcctttattcaacatttgtggagttcctaatatgtgcaatcagagataataacaaaaatgaatgtaggcagtgaacccaactttaatggaaggtaaatgaaataaggtgctctgagaagacatgaaggtgacaaacgcactctcaattccattcaaccaattttactgagtatcaactatatgtctggtacagaaatggacacgaaagatgtgacagttatccctgtctttgagaagttcaatccagtgtggaagacggcagttcaaaaagatatacgctgtatgtatgtgcaacatacatactctgacatgagtgtgaaaaacaaatgtggcaataacatagagtgagctgctaactttggaaatccagaaaggcttctcaaaggagactatgagctgattcctaaaagaggaccagacagttatcaggtgaaagagaaaaaaaattatgatcattctaagaaaagaaaacaagcatgagatttcagcatagttttagcacaggcttcatgagcaaaggggagcagatgaggccagatatggaagataaggcctgattgtgaagggtatgtcctcatatgtagtgctaaggaacaaggacacacatcaaattggtccaatttcttgaagaggagaattgacacaattatggcagcagtatggaggaatgagtaaggtgggaaagatcaaagccttcaaagactgtttaggaggctattaaaatggtcaaaattagagatgatggtgatggaaataaacaagaatgcagaaggaaagcacagttctaacacagtataaagaaaagggcttgaaagaatggaagaagttaaacagtttcacagcattcaaacatcccagttactttgtggttacagatttcatttccttttggaagaagttattttcctctgaactttctccttctacaagaaaaacagaactttttagataaatctttctgttgaccttctaattctacatacagttctgcttacttatgaggaatacttcacctaggccatgatgaagatgaagttctgtttactgtaaggtcaacagaaagatttatccaaaaatctaacggtatgtagaattagaaggtcaacagaaagatttatccaaaaagttctgtccatttttgctccagaaaaggagcctgacttttctcagtatcttgcatattttaaggaggaaccataaaggaaatctaattcttaatttcaaaaacagtatttccaaaattttatcatagccattgccatagtgttcttttctttgatattttcttagtttaaaattttgcttcttccaaaaataagagaataccaatttattctttatagtggtgctgtcttttcaaacttagtcttttctaatggaggagctgctttgggaaatctccttccccaatgtgggaatcctaactagtagtgagaagtttgcttcgtaagaggagaattttaaagggctagaaaataattatcaggaatacttcacccaggccatgatgaagactaatgaaatatcctccctagagcaagcatttattatcgctttttaattaagctctgtagagttaatctactgacctcaaaagcactgggcaattgctttattattctgactcctaacttaaataattgcttatgtagagagtcaagagtgtattctattacatatgggtcaattattacgggtttcctgattaaaggagcaagcatatagagtcacagttattctggtcaatattcttcctcatcttcctcacagactagctgatttatagacgtatttccttatctactaaaataaagccacacataataatctaggacagcttatagcactcttcaactttcctttaattgatacgaggtattagtgagatttggtgactgtttctaatctagtgctgctggatctgaga

SEQ ID NO: 14007 - DNA, 5056 bp, Human
atataataaatcttaactgagagtatgctgagtcatgtgattacttctggtgaattactgaattagtgggtggtcatgggattacaagcactattttccttattcccagtgcacttagtgtacaatcctttcacagaattactgtattgcactctacatatttacttgtttaaaagcatatgggccaggtgcgttggcttaagcctgtaatcccagcagtttgggaggccaaggctggcggattgcctgaggttaggagttcaagactagcttggccaacatggtaaaaccctgcctttattaaaaatacaaaaattagctgagtgtgatggcaggcacctgtaatcccagctacttgggaggctgaggcaggagaatctcttgagcccaggaggtggaggttgcaatgagccaagatcgtgccactgcactccagcctgggcaacaagagtgagacttcatctcaaaaacaaataaacaaacaaaaaacaaaaaacaaaaacaacaaaagcatatctagactgtagactacttaaggttttttttttttcttagttcctaatacagtatgtgacacataaatatctgaataggaatcctttctgagagagagaagcataaagcagtccacacatatgtttaaaaaataagcacagcgaatagttctatttgagatattaaaggatggtagagagtagagacacatttaccagtagggtccgcaaaaatgtttttctcaggtcagagttcaatcagtgctatgaagactccacacccacctcaaaatgcaactcattttccgagattaagatccttgtaggtgaaaagaatctgtgtggggatttaggaattcctagtcgattgccttaactacttggcaaatagtgctttctgaattatgtatcaaaagatataaaactccattcctgggctcccaccccaccccacccttggcactcagtttatgtaagcattctccttgcttggcaggttaacttacaactgtcataactggctgcaacagtggtatagcctctaaacaagagaaatttgctttgtttacagatgacatattgattaatgacacttgggtgtccatgaaaatcaaaattgtacatgcagagattgtagtttcacattatttcccggaaatgcttgtaattctggaattaaagaaatactcgggttcattttgttttctttcgtcattgtttaacctaaaaaactgtaacttaaaaaaaagggatcctcaggaaaatagacggggggggagaaaaaaaaaggacctagcagaggatggtttcgatccatcgacctctgggttatgggcccagcacgcttccgctgcgccactctgctgttctgccaggcacacggtctcacagtactcttaactacttacaggagatgcgttcagactacctcgtaatttaagaaaaaacctacgagcagttgcctacttctttggctaccacaggttgccaactcactttggaaaaaggaatcaccagaatcaaacagaaaacaaaactagggatagaaaaataaatatcaatacactggtgggctaggcgcggtagctcacgcctgtagtcactgcactttggaagacccaggcaggcaacatagcgagaccctgtctcaataaaattaaaaaaaggaaaaaaaaaaacccccaccccgaaacctacacactgggtgcagttgtgaggggcagttagatatttaaatggcaattacaaattttaataagcagggaaagaagagaacaaactgggaatagaatcaggcctccgcgcggagggcaataattctaccacgaatcactaacctatcatgccttcgccatcgggaagaaaacccttttggttatgtttcccttggcttggtgatggagagggtgaaatcttgcagttttcaaacacttccgaaggggggtttcggtccgcatgtgctttacagccggcagcagaaagccagtcactgtgaccttggggacaaagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttggcgtttaggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcaggtaacgtttaattactcgtgcttaatctcgcatgtttaggatttgggcataaagtacttaaagccactgttttctgcttgagggaagttggtatgttgaatatgtttagctttcttgtggcattttaacactagatatcagtgagtaagctggattgtgacagtttataattcccgtgggccttcctccttcagtttaagcttgaagcgttcgtaaggttctcaaagactacagaagttggaaacttcgcggagagactgcaagttaccctttccaaaatggcgggaagggctaaaaacaaagaaagctcgcacccagacggcgggccttaaaccaaggcgaatccgtgagcgcaacacatctgcgtgagtaggatcgcagacccaagtccaggcggcgtgcgcgctgctgcttttgacttggtgacaaaactcgtctacaaaaggcagtgtggggtaacaatataaatgttcacttgagagcttgcaagtattgtttccaatagacttaaaatgtgtttttgaatattacgaaaatattaaaaggtagggtaccgcttagtgagcaatatagaaacatcaccataacttattttgttgttgttgagacggagttttgctctttcatccaggctggagtgcagtggcgcgatttcggctcaccgcaacctccgccttacagtttcaagcgattctcctgcctcagcctcctgaatagctggtattacagccgcccgcctaatttttgtgtttttagtagagatggggtttcaccatgttggccaggctggtctcgaactcctgatctcgtgatccacccgcctcgacctcccaaaagtgttgggattacaggcatgaggcactgcgcccggccacgaaaacttaaattcttaaccagcaatgatcgccttttgaaaaagtacacattcaggcatcaggacaatgatttgctagagaccaaacttgtaggagatttggattggctttttttttccttttttgaggcggagtctcaccttcgccatgctggagtgaagtggcgtgatctcggctcactggaacttctgcctcccgagttcaagcgattctactgccttagcctcccaagtgactacaggctcgcgccaccacgcccagctaattttggtatttttaagtataggtggggtttcaccatgttggccagaatggtctccatctcttgagctcgtgatccgcccgcctcggcttcccaaagtgttgggattacaggcgtgagccaccgcgcccggcctggattggcttttcttacggcatcattttacttggcttctatactctgtcctgagcagaagtgacttttatatacttagttgaaatcaggttaatatgcttgtcagtttatacagagacatatgtctggtttatctacgttgaagataataggacaattgctgctttaggatgatagttccattgtaaaatcagatttttcctctttgtggtcagcaagcaaattgtagggttataactttgaaatcgagaaaatcaatggagttagggtttcatcttttttaaagatatgcacttgtacattaatatgaaaagaacgatgttatcagagctaaggcactggtttgtatgaggatataaatttaacaacaaaaattgagcacataacgtatgccaggtactgttcatggctctgagaagtataggagtgaatgacagtgaacaaaacagtattttctgtatgcatggcgtctgttgggtgtgctttcacacgcaaagtaagtgaaactatcagatggtgctaagtgctatcactgaaacaggctaaagacgtgtggagggaggaggtgatgtttaattagttattttttttgagatagggtcttgctctgttgcccaggctgcagtgcagtggcgcgatctcggcacattccacctccgcctcgcttgggttcaagcaattctagtgtctcagcctcccgagtagctgggattacaagcatgcgctaccacacgcagctaatttttgtatttttagtacttatggggttaggctggtcctgaattcctgcctcatgtgatccgcccacctcggcctcccaaagtgctgggattacaggtgtgagccaccgcgcccagtcgagaacgtgataattttaaatgatagagtcatggaaagctttactgatagagcgatggttgcagaaaaaaagac

SEQ ID NO: 14008 - DNA, 5650 bp, Human
tttctgattttatcgtaccactaaactcacaaatgtggccctattcttgtgttcacgactgacatcaccgtcatggtccaagtctgataatagaaatggcattgtcactttcttccctactgcaacagaagcccagctatttgtctcccattttctctacttctaaaatacatttcttcactaagtgagaataatcttttaaagacacaaatcaaaccatgccaccacctttcttgaattattcaatatctttcgttggcttccaggttacagaaaaataacttgtaacaaagtttaaaggtcattcatggctcctctctaccctattttataacatttccccttgtgatcagaatctcaggcacatcatccatctttctatatacaaataaagtcatatagtttgaactcacctctggttacttttaatcaaccaaatgctgtaaaatgcatttgtatcgctacgtgttaagcagtagttgattcttttcatttctgtgtaatattctattctttgactataccgtaatttatcaattctactgttggtaagcatttaagtggctaccggtttgaggtttttatgattattgctgtcataagcatttctatacatgtctttggatacacacatgcatgtgtttctgaatatctaaaaatgtaattgctaggtaatagacttatcaagcatccagcatttgtggatactattaaaggttttccaaaggggttatactattgtacagtgtcaccaacagagtttgagtttctattgatccatatcaccaccaaaatttgaactgtcagtcttatctcttctcttgtctcttttttcctcttttttttccttcccttcccctctcttcgtttcttttctctcctcttctcttctttcctctcttcccttccctttctctttctcttccctatcccttctcctctcctctcccctccttttttctcctctcctctccattatttatttttccttcttctcctccatcccttccatcctctctcttcccctcttccttccttcctttctccatttcttcctcctctttccttcaatccttccttttggatatgctcatgggtgtgtatttgtctgccattgtggcattatttgaattcagaaaagagtgaaaaactactgggatcttcattcctgggtctaattccacatttttttttaagaacacatctgtaaaaatgttctgtactagcatattcccaggaacttcgttaaatttaatctggctgaatatggtaaatctacttttcactttgcattctttctttagtcataccataattttaaacattcaaaatatttgtatataatatttgattttatctgtcattaaaatgttaaccttaaaattcatgtttccagaacctatttcaataactggtaaataaacactattcattttttaaatattcttttaatggatatttatttcaatataataaaaaattagagttttattataggaagaatttaccaaaagaaggaggaagcaagcaagtttaaactgcagcaatagatttgtccattccaacctctcaaaattcccttggagacaaaaatctctagaggcaaagaagaactttatattgagtcaacttgttaaaacatctgcttttagataagttttcttagtataaagtgacagaaacaaataagttaaactctaagatacattccactatattagcctaaaacacttctgcaaaaatgaaactaggaggatatttttagaaacaactgctgaaagagatgcggtggggagatatgtagaggagaacagggtttctgagtcaagacacacatgacagaacagccaatctcagggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcaggttggtatcaaggttataagagaggctcaaggaggcaaatggaaactgggcatgtgtagacagagaagactcttgggtttctgataggcactgactctctgtcccttgggctgttttcctaccctcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgagtccaggagatgcttcacttttctctttttactttctaatcttacattttggttcttttacctacctgctcttctcccacatttttgtcattttactatattttatcatttaatgcttctaaaattttgttaattttttatttaaatattctgcattttttccttcctcacaatcttgctattttaaattatttaatatcctgtctttctctcccaaccccctcccttcatttttccttctctaacaacaactcaaattatgcataccagctctcacctgctaattctgcacttagaataatccttttgtctctccacatgggtatgggagaggctccaactcaaagatgagaggcatagaatactgttttagaggctataaatcattttacaataaggaataattggaattttataaattctgtagtaaatggaatggaaaggaaagtgaatatttgattatgaaagactaggcagttacactggaggtggggcagaagtcgttgctaggagacagcccatcatcacactgattaatcaattaatttgtatctattaatctgtttatagtaattaatttgtatatgctatatacacatacaaaattaaaactaatttggaattaatttgtatatagtattatacagcatatatagcatatatgtacatatatagactacatgctagttaagtacatagaggatgtgtgtgtatagatatatgttatatgtatgcattcatatatgtacttatttatgctgatgggaataacctggggatcagttttgtctaagatttgggcagaaaaaaatgggtgttggctcagtttctcagaagccagtctttatttctctgttaaccatatgcatgtatctgcctacctcttctccgcagctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttcctgattaatttcacttatttcatttttttgtccaggtgtgtaagaaggttcctgaggctctacagatagggagcacttgtttattttacaaagagtacatgggaaaagagaaaagcaagggaaccgtacaaggcattaatgggtgacacttctacctccaaagagcagaaattatcaagaactcttgatacaaagataatactggcactgcagaggttctagggaagacctcaaccctaagacatagcctcaagggtaatgctacgattaaactccaacaattactgagaaaataatgtgctcaattaaaggcataatgattactcaagacaatgttatgttgtctttcttcctccttcctttgcctgcacattgtagcccataatactataccccatcaagtgttcctgctccaagaaatagcttcctcctcttacttgccccagaacatctctgtaaagaatttcctcttatcttcccatatttcagtcaagattcattgctcacgtattacttgtgacctctcttgaccccagccacaataaacttctctatactacccaaaaaatctttccaaaccctcccccacaccattttttatatttttatatttttcttatttatttcatgcacacacacacactccgtgctttataagcaattctgcctattctctaccttcttacatgcctactgtgcctcatattaaattcatcaatgggcagaaagaaaatatttattcaagaaaacagtgaatgaatgaacgaatgagtaaatgagtaaatgaaggaatgattattccttgctttagaacttctggaattagaggacaatattaataataccatcgcacagtgtttctttgttgttaatgctacaacatacaaagaggaagcatgcagtaaacaaccgaacagttatttcctttctgatcataggagtaatatttttttccttgagcaccatttttgccataggtaaaattagaaggatttttagaactttctcagttgtatacatttttaaaaatctgtattatatgcatgttgattaattttaaacttacttgaatacctaaacagaatctgttgtttccttgtgtttgaaagtgctttcacagtaactctgtctgtactgccagaatatactgacaatgtgttatagttaactgttttgatcacaacattttgaattgactggcagcagaagctcttttatatccatgtgttttccttaagtcattatacatagtaggcactgagaactctttatatctgaataagatatttaggaaccactggtttacatatcagaagcagagctactcagggcattttggggaagatcactttcacattcctgagcatagggaagttctcataagagtaagatattaaaaggagatacttgtgtggtattcgaaagacagtaagagagattgtagaccttatgatcttgatagggaaaacaaactacattcctttctccaaaagtcaaaaaaaaagagcaaatatagcttactataccttctattcctacaccattagaagtagtcagtgagtctaggcaagatgttggccctaaaaatccaaataccagagaattcatgagaacatcacctggatgggacatgtgccgagcacacacaattactatatgctaggcattgctatcttcatattgaagatgaggaggtcaagagatgaaaaaagacttggcaccttgttgttatattaaaattatttgttagagtagagcttttgtaagagtctaggagtgtgggagctaaatgatgatacacatggacacaaaaaatagatcaacagacacccaggcctacttgagggttgagggtgggaagagggagacgatgaaaaagaacctattgggtattaagttcatcactgagtgatgaaataatctgtacatcaagacccagtgatatgcaatttacctatataacttgtacatgtacccccaaatttaaaatgaaagttaaa

SEQ ID NO: 14009 - DNA, 24841 bp, Human
ttaacaaggacagccagtgattcttgctaatacacagctgtaagactttatgatgcacattcactgaatcagttaaaagtgttatatcattttggaaaataataaactgtttccaaaacaattataaatccctgtagtctctgaattccttacctctattgcctccagttcccatcttcaggacttcgttggtgggtcaggaggactctgagcacttttgtatccattcgtcagctcaacagggaaagagggggtaggaggaggacctcagcattgccctaatcttgcccatagttccatggaaccagaaagggttaacttttcccactttccttgtacctccctttcttcaaaccctgaattctgtctctgctttcagtgactgccttgactgataaattacaagggtttttttggttgttgcgggattttttgaggcagggtctcagtggcatgatgatggctcactgcagcttcaacttcctcgtctcaagcgattcttctgcctcagcctcctgagttgctgggactattggtgtgcgccaccatgcctggctaattttactttttgtagagacaggatctcctatgttgcccaggctggtcttcaactcctggcctcccaaagtattaggattacaggcatgagctaatgccccagctcatgagggatatttttaagatatagtttctctttaccatttttctccatgtaaccctacctgtgtgtcttcctcctttgctattggaagggttaggactgcaatggcagaaaggcaaaaaaattaagaatattcagcttttaacttaaaaaacacattgcgaatgtctaacaggacctatcaagagttaggcctggctaacctgatcaccaaggcagtcactggaagcagagagggaattcagggtttgaagaaagaggtacaaggaaagtcagaaaagttaactctgcttccatggaatcaggggcaaggctgaggcaatgttaaggtcctcattccaccctccctttacctgttgaactgaacagttccccaaatggatacaaaagtactcagagtccttagtataacaaagtcctgaaggtaggaattggaagcaatagagggaaggacggtgaccacagaaaatattcaaggtctttgggaggtcaacacctctgaaccccctggtggtggggggcccttctggcccatttgcacctttcttgctagtgtagaaaacctgaagttatctcaggctagatatataaccctcactcatgtctgccggagctctcccccagaatatgaatcatatttgtaggtttctttgacaaccaaccactcattgatatgcttggaagactgcacccccacattccttaaaaatacaatggtactcccccaccataggcaagtccccggactctgacacatatcttcaattgaaagcagacccagaaaggaaaaactgcataatacaccatcctttaatatttgcccagaatttccaatactagaaaccccactgcaaagcagaaagactatctggtagcttcaaggaaccatttcaggagattgttgtgtgggcctcagtattcaaggctgccttagaagatcgtgcgatcctctcactcttcttgccccaagtaccagagttaataagccactgaaccaaccagaggggaattatttttggtcccggtttaaagaaaacaaaacaagctgttgattctgccatgacctcttgggtaatgttgtctctatacctgtgataaacagaaaacaactaataaaggtttatcccgccctcaccctcttaaacccgcttcacagacctggctgaaactcacatccaggcgaggcgctcacgtgacccgttctaaacgcgtcatagggacacgtggttctagatacttctccccctcccactcaggggtggattgttgacaaggccgcgggcagtcacgtgatcttacatcatcccacctcctttccctgaaatctctggcccggatgcgtccctctttctccaccccgccgagcctaaactagtgacggggagggagacgggatagtgtttctgtttcgtggtctttgaatccacaacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggtaagggccttcaccttcgcctagatgacggcccctcaaagctgcggggctgcagggcgtggatcccagacaccttcccctttgtgaccctcagagggccggctgtgggcccagcgggactggcggaagccgggtcctagcctcggccctactcccataagctttgccgctcgttctggcgcccgaagaaattttgatactgcttcccctccccacaaaaagtaaaacggtgtcgatcgactggtctagggttccctgctgcccatttcggccagctgcccggcgtctcgcccaggcgatcagacattatccgcccgcccctgcaccctgcggcgcccccttcttgtcccctcaaagtgagctcctgcgggagcttgttcctctccggcagcaccagtcagctttgtttcacggccccgccgtcttctccgaggagccgtgttggggcgaacccctctcccgactcctgccaatcctttccatttgtgccctgagggtggggtccagtgcgtgaggcccggaggttaacccatcccccgaaacccgactctgtccccgcccgcctgaaaggaccttgggaactgacttagagatctgggaccttagagctggccaccccggctgccagtgctttctggaactcagctctggctggtgaagaaagcccctatctatagcctcccgagtctggaaaaatgccttcccttagactggcgctaatctgatactccctgggcctcctttggtaaataaaatagggttttgttaggaggtattggggttgtgagatagaaaatgattattccgttgtttaccttttattggatacttagagacatagaaaaaataagtgagaaaacatcattttgatactctgcacatttttcttaacattttttctggggacacctgccctaattgaacaaaatatctagcataaaaacttagatttgtcgctcaggaagtcacctctcagctattataaagcctatgtgaggcacttggatttggccaacttatttaattcattcgtagcttctcttagccatttaaaggtaggcgtcaagcagtgcagttcttctaaggcttctgttcgtggtggcctaatttgcttgagattgactaaaaaccatttttttaatgtggactagttgcaaattatgatgccccatgaaaaacaactgcatatgtatttgtgtgtgtatataatgtagcatttttaattgaggttacagtctctgaaaggagatgccctttttggtgcaaaagtcatctttctaaagcttgaaatcagcgtatttgattagcactcatgacaaattcagatagtaaactagttcatgtcattgtcgccctggctccttactgtaatgctctgcttaattctgagttgaatgcatggcaccttttgtagtttccagagatctgcaggttacaagaatttgactatgacgaatgttggaaagccttgtgttgagtctcctgatctgagaggtggatttggtgttagtgcagagcctttaaaatagggactggcagaaaacctactaattactttttaaagccattgctgtttgaagcaaaaggaatagagtaaatctgctgcctaatactagtttcctagttaaatttaatgtgttttcagtcattttgtgtttacactgaggtttgctttttttttttttcttgtagccattttgcagaagtagcctggttaggatacacagtctttgcatgtttagagcagcaaaatcaatggttctgtaaaaatattacttgcttttgaggttttaaactttttttggtataagaggacagtctatatacatcaattctttttttttaaatatattttaattatactttaagttctagggtacatgtgcacaacgtgcaggtttgttacatatgtatacacatgtgccatgttggtgtgctgcacccattaactcgtcacttgcattaggtatatctcctaatggtatccctcctttctcctcccgccccacaacaggcccctgtgtgtgatgttccctttcctgtgtccaagtgttctcattgttcaattcccacctatgagtgagaacacgtggtgtttggttttttgtccttgcggtagtttgctgagaatgatggtttccagcttcatccatgtccctacaaaggacatgaactcatccttttttatggctgcatagtattccatggtgtatatgtgccacattttcttaggctagtctatcattgttggacatttgggttggttccaagtctttgctattgtgagtagtgccgcaataaacatacgtgtgcatgtgtctttatagcagcatgatttatattcctttgggtatatacccagtaatgggatggctgggtcaaatggtatttctagttctagatccctgaggaatcgccatactgtcttccacaatggttgaactagtttacagtcccaccaacagtgtaaaagtgttcctatgcatcaattcttgaagagataatattgaaagagggatgattctcaagccctttcaatttttagataatttggagaggtatttaataagtatatatacctggttaatatatttaagtcatatggttcattttagttcacaataacaaggaaatggagttagtctgtgtctcaaaatagatggtatagtgtctgtaggtgtttacgtggcctccttagtggccttaatgttcaactttttaaattaccacgctggatttccaggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaaggaaaaagtttcagcagttatataaagtttatttgctctttgatgttattacatatggttttataatctcttggggttttacttttaaaatactattcaaaactaaatggaatggaataataaaggagaaacaataagttactttatataaaacatatcacgcaaatgctctcattctgttggagctgttaaaaggtttggaaccaaaaatattaagaacttccactgtggcaagaatttaagcgaaaatgattcacagcccagtgtgaaataacagaatgcagccatttgagaagcagttgtaaattttacctactatgtatattgcgtatatgctttttaatttaaaatttccttatgctttttctttggtttttctagacttgatctattttttctttcattcctttgaaactagagttttgcattaaaaagtaaaaggagtatgttgataaacagaattctgacactacagaatcagctacaagagtctacatttaaagactagtggaaaatgagtgaagttcatcctcataaagtacttctgaatttgagttgaatacatggcaccttcaggatattatcctgctgctttgagatcctgaatatgccttgcaagtaataattaaactttatgctccatcctggctaacacggtgaaaccccgtctctactgaaaatacaaaaaaaaattagccgggcgaggtggcgggcgcctgtagtcccagctactcgggaggctgaggcaggagaatggcgtgaaccccagggggcggaggctgcagtgagccgagattgcgccactgcactccagcctgggcgacagcgagactccgtctcaaaaaaaaaaaaaaaaaaaaaaaaaaaacctttatgctgctgcttaggaaagatgaaattgggatgtggggacaaggatctgagcaaacaaatctggctttttggtgacaactatgcttagcctatttgaacaagagttatggctccattggaaagcaggacacttgggtttagcatcataactagagtattgctttacatcatattgctgtaaaatgaaaagatgtcttttcctcttaagaatatacatatgggccaggtgcggtggctcacgcctctaaatcccagcactttgggaggctgcgatgagtggatcacctgaggtcaggagttcgaaaccagcctggccaatatggtgaaaccccgtttctactaaaaatacaaaaattagccaggcatctgtaatcccacctactcgggaggttgaggtaggagaatcacttgaatccaggagaaggaggttgcagtgagctgagatcatgccattgcactccagcctgggggacaagagcaaaactccgtctcaaaaaaaaaaaaaaaaaaaaaaatatatatatatatatatatatatatatatatatatatatatatatatatacacatatgtacaaaatgactggtcagtattaatgaaagtttttttgtgctaaaattatgggcaagtttttttgtttggtttggtaaaaccaccctaaaaagaaagcttagaatgaaagttaatactttatgcctgggtctatgaaaatccagggctaaggtgttactaaactctatcttaaaactccacaaatcatcagaatgagtccctctttttctgttgaagtttatcctttccattcttgaaaatcaagaaaaagcagaatgagaaacttcttttaatcagaaatcttcttgttttcagaccagaagggacaccttttgaagatggtaagtcatactcattatgttttctatagtgttatgaggttactttttagtagaaaattgtaacaccaacatatctacttgaagccattttctatggttaataggccaagttaaaagtaaagctatggaaaatttatacttcataagggacttcttcccacagcagcttggtcacctccattggtaaccaatattaaaggttactttaatattttcctgtataactgtaagcctggatggcagtgtttatgttgagaatagtttaaatttaggtggccttaaagatatctctgaggtgaacaccagaagagtaaatcatgcttttttactttgttatctttgatattgacagggtgttgagctgaaatttttcataaacatacatagctgccagtagtttcaagtactactagcatttaacacccataagtagttatcattttgcataatctttggcatctcaagttgggtattttcatcaggggctaggaaaatgggaaactagttctaataccgaatttataattgaacttatcaaactgattttaaccaggaacttagacttttcccaattgtagtgttggattttaagaaattattaaacatctttgttatcattaacaaaatgacttcagaattaatccatcaaaaatatttatccgagaatactgactgcagcagtttgtaaggacgtaacctgaatgtccagtaggagaaatggttaagcaaattatgatgtatctggattctggaatatgtacctgttaaagaataaggtagatttggacatactgtcttaagaggacaaaaaaactgcacgataatgtttgtcgtagcatcacatttttagcaaatacatatatgcatgtgtgtctatgttaaagggttatatatcaaactgttaccagtgattatctgtggggggggtaaggagttgaaggaggtacttaaggacgttaccttttttctctacatcaagggttctcaagtgtgtgatccataaaccccttggggtcttggagaccctctcgggggacccatacgatcaaatctcatcatactaagactgttgacctttgcattgatggtacaaaaccaatggtggctataactacacctaagtagtttcgtatcttagaacaaatcaaggcattagacagtggcaccaaaccatactaatagtgattatattctttgcattttaaaagatgccagttggccaggggcagtagctcacacctgtatagccagcactttgggaggcttaggcaggtggatcatggatcacttgagcccaggagtttgagaccagcctgggggagcccttctctacaaaaaattagccaggcatggtggtacatgcctttagtcccagctacttgggaggattacctgagcccaagaggtcaaggctgcagtgagccctggtggagccactgagctccagcctgggtgacagagtgagaccttgtctttaaaaaaattaccaatttttcttaatttcttaatttaaagacatttttattagtattaggaagctctggacccttgagtatctatgtgggttttttttgtttgttttttgttttttgtctcgctctctcacccaggctggagtgcagaggcgcaatcttggctcactgaagcctccgcctccgaggttcaagtgattctcgtgcctcagccttccaagtagctgggattacagacatgtgctaccatgcccggctaatttttgtatttttagtagagatggggtttcaccatgttggccaggctggggccttaaactcctgacctcaggtgatctgcccaccttggccacccgaagtgctgaggcatgagccacgcccagccgagtatctgtctttttaatattctgtatgatatgaagtagaatgtatgaacaaagcacttctgcatgtcatagtatgatagttgtctggaagaaaagcacttctacagttgtttgagttgcaatttgaatgactttttcatggaacattttttacttgaaaatacagacaagctgtggttattcaggtttgaatatatggcagacatattctcagaagtaatgtaataagctcggtgtggtggcgggcacctgtaatcccagctactcgggagactgaggcaggagaattgcttgaacctgggaggcagaggttgcagtgcgccaagatcgcaccattgcaccctagcctggacaacagagcaagactccatctcaaaaaaaaaaaaaaaaaacagtggggggatctaagtgggttgttaggttaaggatagcaactgaagatatttgttgctgttgataaaataacagcttcctgatacttactttttgatgagattagtgggtagtgttacctgttgtgatttttttgatagtatataatggaatatggcaacatttggaggatctgtaaactcgagtcacccaatattttgcagatgtcccatgaataataatacaaaaccatgaatgggtaaaacacgtatgtgaagtgaacagattttaatgtaactgagtacaaaaagttgactaataatttcagattctatattgcagcaaacctttaaaagaactaccatttcttctttggtataatatcaaaacagaatagctacagtcacctgaaaaagctattcaaatactactttttttgctgggtgcagtggttcatgcctgtaatcccagcactttgggaggccaaggtgggcagatcacctgaggtcaggagttcaagaccagcctggccaacatggtgaaacgtcgtctctactaaaaatacaaaaatgagccaggcgggatggcacgtgcctgtaatctcagctaccccagaggctgaggcaggagaattgcttgaacccaggagacggaggctgcagtaagctgagatggtgccattgcactccagcctgggcaacagtgagactctgtctcaacaaaaaaaaaaaaaaaaaaggaagaaagaaagaaagtactccttttttcaagtacatatttgtgtgaggccagattttcttcatgtacttaaactaaacggtattgtaatagatggagtgcagaagcagataagagaatccagctatcttctgttaagccagtcattaaagagacagttgcaaatatgtaaaacattgcttacacttatcaccaacttggggagaaatataattttaatttatattctgtgtaatgggtttgcagtttaacctaccttttttttttggagacagagtcttgctcttgtcacccagactagagtgcaatggcgcgatctctgctcacagcaacctccgcctcccaggttcaagcaattctcttgcctcaccctcctgagtagctgagattacaggcacccccatacccagctcatttttgtacttttagtagaggtggagtttgaccacgttggccaggctagtctcaactcctgacctcaggtgatccgcccaccttagcctcccaaagtgctggaattacaggcgtgagccaccccacctggctacagttatttttaatgaagattttctgagttaaagtttttttgtgtgtgtgagacggagtcttgctttgtcacccatgccagagcatagcggcatgatctgggctcactgcaacctccacctcctgggagggtcctttgccatgtggtagtcagaccctctcaaaatcctttaaccaactcccattctaagctataataaactatttgtagttcttcaaatatgcattttaaatcttggtagctagggcctagttgccttccaaaaatatgacagttaacactcccaccaatagcaacatgaatgtgcttgttccccaaccgcttgccaatgctgcgtgttaccattctaacataaatagagtatatttaggatgttttgtatgccgaaccaacgttgacatactaacttttatgtggttgtacaaaaaccagtatgcagttgagaactgatgaagagattaaaaagtcgtgcttgtctttactataattattttgttttctctctaggtacttttaaactagtaatagaattttctgaagaatatccaaataaaccaccaactgttaggtttttatccaaaatgtttcatccaaatggtaagtagcattttatagattttgcagatgatagtggggaaaagagttgtttccctccttttagctctttcaccttactttttactgttagggctcacttgtaggtgttgcttccatgtccatgtgagccacgtattttgttgtggatttttttttttttttttttttttttttttgagacggagtctcgctctgtcgcccaggctggagtgcagtggcgcgatctcggctcactgcaagctccgcctcccgggttcacgccattctcctgcctcagccttgtgagtagctgggactacaggcgtccaccaccacgcctggctaattttttatatttttagtagagacggggtttcaccatgttagccaggatggtctcgatctcctgaccttgtgatctgcccacctcggcctcccaaagtgctgggtttgttgtggatttttggtttgtttcttatttcttcagagacaaagttatactctgtcacccctgctggagtgcagtggtacagtcacagttcactgttacctcaaactcctgggttcaagtaatcctcctgcctcagactcctaactagctgggacgacaggtgtggaccaccatgcccagctaatttttttgtttgttttctttttcttttttgtagacacaaagtctctgtgtgttgcccaggctggtccttgaactcctagcctcaagcagtcctcccactttgacctcccaaagcactgtgattacaggaatgggccattttttccagcctttagctatgtttctgtagctagactcttacaaagcttccaaatttgaggtcaagttgttttaataactcctgaattaaaagtaatacatggtcgggcatggtggctcatacctataaactcagcactttgggaggccaaggtgggcggatcacctgaggtcaggagtttgagaccagcccggccaacatggtgaaaccccatcactactaaaaatacaaaaattagtcaggcatgatggtgggcacctgtaatctcagctactcaggaggctgagacaggagaatcacttgaacctgggagacggaggttgcagtgagctgagctcacaacactgcacttcagcctgggtgacaaaccaagactctgtctccaaaaaaacaaaggtaatatgtaagccaggcacagtggtgcacacctgtagtcccagctactccagaggctaaggcaggagggtggcttgaggccagcctaggtaacatagtaagatcctgtctctactaaaagaaatagataaaagtattatctatttatttgtggaattgtgaaaaataagaaaaatctgttggctaaaattaagcttttcaaaaatacaattttggccaggcgtggtggttcatacctataatcccagcaccttgggaggccaaggtgggaaggttgcttgagaccaggagtcagagaccagcctgggcaacatagcgaggtcccatccctataaaaaacaaaaaaaatatcaaggcatggtggcgcacacctgtagtctcagctacttatggaggctgaggtgagaggatcacttgagcccaggaggtcaaggctgcagtgagccatgactgtgccactgcactctagcctgggcaacagagcaagattctatctcaaaagtacaattttgcatatacaaagttggagtcaatgaccacacacagtggttcatgcctattaattccagcactttggaaggctgaggagggtggattgcttgagcccaggagttcaagaccagcttaggcaacatggtgaaaccctgtctctacaaaaaatacaaaaattagctgggcacagtggtgcgtacctgtattcccagctactagggaggccgaggtgggagaattgctggagcctgggaggttgaggctgtagcaagccatgattgtgccaccgctctccatcctgggtgacaaagcaagaccctatctcaaaaaaaaaaaagaaaattgggatgttatatataaaataaggtgttttttttggtttgtttgtttttgtttttttaatatactgtgaacattttccttaataaatattctgggctgagtgcagtggctcacgcctgtaatcctagcactttgggaggccaaggcaggtggatcatgaggtcaagagatcaagaccatcctggtcaacgtggtgaaacctcatctctaccaaaaatacaaaaattagctgggcatggtggcgcatgcctgtggtcccagctactcgggaggctgaggcgggagaattgcttgaacccgggaggcggaggtttcagtgagccaagatcgcgccactgcactccagcctggcaacagagcaagactccatctcaaaaaaataaatattctgatacatcatttttaatggcaaaatgttctgttacatagatttatcatatttttaaccagtgtccaattgttgatagttttcagttgtttacaattttaaatagcactttgaacattcttaaaaatcttaaaaatttttttgttgttgagaaaaacacttgctgtgtcacacaggctggagtacagtcgtgtgatctcgactcatcgcaaccattacctcccgggttcaagtgattctcttgcctcagcctcctgagtagctgggactgcagatgtgtgccaccatacccagctttttttttttttttttttttttttttgagacagagtcttgctctatcggccaggctggagtgcagtggcatgatctcggctcacggcaacctctgcctgttgggttcaagtgattctcttgcctcagcctcccaaagctgtatatccagctaatttttatatttttagtagagacggggtttcaccatgttggccaggctggttttgaactcctgacctcaggtgatccgcctgccttggcctcccaaatgttgggattacaggtgtgagccaccgtgcccggcctcaaaataaatcttttcagatactaattattattttgattgagttttttgtttgtttttttaattgctgcataacaactagactaagttttttaaacgtggggattactgggtcagaggcttgtgtgtttttaaagcttttaatgtcattttccatttttttccttcagtggaattgttctcattttcacttcatagagtagtttgttactattcttcactaaacgatggctaattcctttgtaataaatttggtcttccttgacatcttgctgtttacatctattacatttatatttctgtattataaattaccatgtgaaagacttctccaaattcttgaagctcctcttcagtctcacagcctttgctcatttaaatgtggcgttccccatcagccaactcactttcaggaagaacattttcagaggtcctcttggtcgtgtctctagtactgcagaatacattatagagctccctacccagaggagagatgtgtttcgtttgtgtctggaatcaaggtgactttccagtaatagatactacctttggcacttcatttctgtgaagttgctttttccttctagctgccttttttgcttttttttttgtccaagacaggtttaattttattttctgtttctctttttggggaagttcccaggtcatttaccatttattccactgtagctttatcttgcttagacttgttattgagtcaaaccaaaccaattatgataagggggtctttaaataaaggtgggaaagactgtagaatgagtaagggatataaatatagggttatcacttaagcaaatttttaagaaaccacagtgtatttggttttcacatctcttcatatttatagcatggtttcccttttattctgctgagtacttttttataatttaactttctggtttatttttttaaaaacatttattgaaatataatttacacaccaagctgttgacccacttaaattgtacaactcaaatggtttttagcataatcataaccatcaccatgaccactttaaaaacaacaaaaagccccataactattatcttagcagtcaactctgtttgtcttaaccctccccgcttcagtcctaggtaagtgttacccctaacgtgttttccctctagatttgactattctggatatttcatataaatggaatcttatactatgtggtcctttgtgactgacttctgtcacccagcataaagttttcaaggctcatctatgttgtgatataatagtatctgtgattcattttttattgttgaataatattccactgtatggatattctgtattttgttcattagttgataagatatttgagttctgatttacttttggattctcagaaatagttactcagaactttaaaattgttttacacttttatgggttttacagagttactaatttttgctttgggcagctaagtttgatgtttctgtgggatggacagtaagttggctttgaagctgagagatagatctaggctaaggccaatgattgggaatactgagcacatggatggtaactgaggccacaggagtcaataggattgcccagtgtgtgtgtaaagggtaagaaggaaaagggcttaggatagagtctggaagaatcacagtgtttaagtgtgatttgctccccactctctgttatggtttgctccatgaaatggtatctgtaacatttaaatgaatttactctttgttttacatagcagttcacttctagaaattttttctacagatagtctcacaattgggcaaatacttaacgttcattgcttgtattttcacagaatcagtctaaaaagggaagaaccctcccagatgttcaggacttttgatacctgttagtcacttgatttttttttttaatgaaaggaatatgtatactcattgcacaaataaatcataaacacaaggaaggataaagaaaataagataggccaggcacggtggcccacgcctgtagtcccagcactttgggaggctgaggcaggtggatcacgaggtcaggacttcgagactagcctggccagcatagtgaaaccccgtctttactaaaaatataaaaaattatccaagcatggtgatgtgtgcctgtaatcccacctacttgggaggctgaggcaggagaattgcttgaacccaggaggcggaggttgcagtgagccgagatcacgccactgcactccagcctgggtgacagagcgagactccatctcaaaaaaaaagaaaaagaaaagaggatcatctgctgggggcgctgtggctcacacctgtaatcccagcactttgggagaccgaggtgggcagatcacctgaggtcaggaattcgagactagcctggccaacatggtaaaaccccatctctactaaaaatacaaaaattagctgggtcgtggttgtacatgcctgtgatcccagctactcgggaggctgaggcaggagtattgcttgaacccaggaggtggaggttgcagtgagccgagttctcaccactgcactccagcctggacaacagactgagaatccatctcaaaaaaagaaaaaaaaaaagggccgggcacagtggctcatgcttgtaatcccagcactttgggaggccgaggcaggtggatcacctgaggtcaggagttcgagaccagcctggccaacatatggcaaaaccccgtctctactaaaaatgcaaaaattagctgggcgtggtggtgggcacctgtaatcccaactacgtgggaggctgaggcagcagaatcccttgaacctgggaggcggagcttgcagtgagttgagattgcaccattgcactccatcctgggcaacaagagcgaaactccatctcaaaaaaaaaaaaggaaaagaaaataagatcatccataaccctactattacaaatatccactacttacattttgacattcggtcttagaaatgttttttgactacatatactttaaatgaatttatataaaactttttaatcaaaataggaaattataaataattaaaaacttatttttaaggtaatagtctgtggatgtcttactctataaacagtagatatgtatcatttctggtgattgtgttgctattgcttatatgaatgtatcagttgtttatttagccagttccctcttttatggaccacaaggtagaattagtttttcacttttttttttttttttttaagatagagtctcgctctgtcgcccaggctggagtgcagtggcgtgatctgagctcactgcaacctctgcctcctgggttcaagcaattcttctgcctcagcctcctgagtagctgggactacacgcatgcactaccatgcctggctaatttttgtatttttagtagagacagggtttcaccatgctggccaggctggtctcgaactcatgacctcatgatccacccgcctcggcctcccaaagtgctgggattatgggtgtgagccactgcgcctggccttctactcttataagtagtattatagtgaacatcctgtaagtaaatctttgtgcatgtccacgtttatttccttaatttctaggagtgtaattgctatgtcaaaaataagcagttttttaaaagctttaagaatatttagaaatacggaatttaaatagattgctaaatgatgtgtgttgaagaaatttaactcaaagcctcctgatcataacatgctgtcttagttcattttctgctacaacagaatagcagggactgataatttgtaaatttgtaaataatagtagtttgtttggctcatggttctggagactgggcagtccaagagcatggcgccagcacctaagcaaggtccttggtgctgtgacatcccatggtggaaggcagaatgacaagtgagcacacaagacataagaaaaggtgccaaactcatccttttatctggagtacactcctgccctgagcactcatgacctaagcacttcttaaaggtcccacttctcaacagtgttacaatggcaattaatttttttttatttaatttttttacttttatttttttgagacaggttcttaccctgtcatccaggctggagtgcagtggtgtgatctcagctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcaggtaagtgtgtgttaggatgtattataatttgtcagtattctgtaggatatagtcagctccttagcacacaggtaaccaatggcagagcttggacaagaatccatgcttttcagctaacttttctctttcagtagtgcctacttgggatccagtctgcagtccctttcctgattgtgtaagttacatgttctcacaggtcaaacctaatttgtgtccatgaagcatagccaagggttgtggaaaagaaaaaatggcttggaaaaaccataggaacctaaagaaactgccaagtgtagataagcattgagtatgttaccccatccaagaaattctattttaaaaaaagaaaggaaaactaatgtaaccatttgtcgaagcagtctggcagaatatttcagaatagatctttgaatgaaaatttaggaggggtggagtgaggggtgtttcggttttgtggatttgagaggagcagaaataatatgttggtttgtgatgttctttttaaagttttttctctcacacttctttaattgttttttttttttttttttttttgagacagtgtcttgctctgttgcccagactggagtgcaatggcacaatcttggctcaccgcaacctctgcctcccgggttcaagtgattatcctgcctcagcctcctgagtagctaggactataggcacatgctaccacgcctggctaagtttttgtatttttagtagagatggggtttcacagtgttagccaggatggtctccatctgacctcatgatccgcccgtctgagcctccgaaagtgttgggattacaggcgtgagctactgcaccaggccagttctggtcatcttacaagcgttgtttttcaaccttcctatctcattctcttcctgctaaatgtatatgttttgttgattaaaggaaataagacttatctcccaaatttactgtcaagacatttgcaaagtaactgcagtaatagagtttaaccttggaaaatgttggttactgagaattattgatatcttaaccaaattaagctgttcatttccttggtttaatgagaacgtctcaatatgcttaagaatattcttttctgatttctttcaaattataggtatttttttcttttcttttttcttttttttttttttgagacggaatttcacccttgttgcccaggctggagtacagtggcgcgatctcagctcaccgcaacctctgcctcccgggttcaagcaattctcctgcctcagccttccgagtagcggattacgggcatgcgccaccacacccggctaattttgtatttttagaaattacggggttttctccatgttggtcaggctggtctcgaactccctacctcaggtgatctgcccgcctcggcctcccacagtgctgggattacaggcgtgagccaccacacccgacctctttttcttttttaatagaaacagggtctccctatgttgcccaggctgggcttgaactgctgggctcaagggatcctcctgccttggcctcccaaagtgttaggattacaggcacaagccactgtacccagctgaaattataggtcttaaggcaattgagaactttatttcagaagcttaagttccttagcagcaggaaaccccatagtatttatcaaatcatttctaaaagtatttagacccaaaattatatgacatgttaatctctgaagtaatttgttgttttgtataacttttctgtaatatattccatatctgacccctgttggtataaagaacaactatgcaaatctgttttttcttctctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaattctgaggtaagtgtatgatcttagggaactttgatacaaatgggaattcactcactggaatcgtggctcccaaaaagatgctttaattgtgtggtgcttttatagtttagctccaaaacaaactatagacattcactccagtaactcctagattaaatatacagtagctatgagggtctgccctcttatttcattaaatgctatttggttactatttcaacatccatttttatccttgacctgtttttgcctttcccagtttaaaacaggaaaatttcaagtattggtagataattataaagaagttacatgttactttacagggaggtcagtgagttctaactccaaaattcaacatatgcataaaactcatagcatccacattccttttcgagaaaatccttaagaaggttcaatctatacataactcctcacttttttctgcagccttggaacagattcctatttctttggttaagtaccagatataaaccttcgatttacaaggttgagtcatacaaaaagtgtttactttaaactctaggtcagtttcataaatgtatggtagggcaagaagctagaactaaaatgtttatgttggtacaaagttatattgatggattcatgttaaaaagtttaaatgcatgtgtgatacaattccctgtaacaataccccagcacagaataatctgtgaaaggcactattctaagcacttttaacatatattatttcatttcaaattcacaaatacggtggctcatgcctgtaatcccagcactttggcaggctgaggtgggcggatcacctgagttcaggagttcaagaccagcctggccaacatggtgaaaccccccgtctctactaataatacaaaaattagccaggcgtggtggcaggtgcctgtaatcccagctactcgggaggctgaggcaggcgaaccacttgaacctgggaggcagaggttgcagtgagccgagacctcaccactgcactccagcctaggcaataagagtgagactctggctcaaaaaaaaaaaaaaagatgataatgaaactagccacagatagacagatgaagtgacttgctcaagatcaaccagccagtaagtcatagaactgggatttgaaccctatgtggtcttacccagaaatgtgctatcttttaagaggttgagattggttttagaaattctgcagaacttcaacatccaaatttgtggaaatacttttaactgatttagttttatacagacttgtgtctactccaatgaaaaggtttccttttttttccgagacaaggtcttgctctgtttcccaggctggagtccagtggctccaggcggctcactgcagtctcaacctcccaggcttaagcggtcctaccacctcaacctcctgagtagctgagactacagatgcatgccaccatgcctggctaatttttttacttttgtagagacaatgtctcactatgttggccaggctggtctcaaagtcctgagctcaactgatcatcctgcctcggcctcccaaagcactgggattacaggcatgagccactgcactcagctgaaagggttttcttgactaccattttccactgactttaggaacattttctggtttctatataaaggactgacttatcaataagccacatttttccccttcctggaaatatccttgagtctgtaggatttctctcctccacccaccccccacaccaagtttcattaatatgaataactttccatgtttcttgtgttcacagaatggcctgggaatttttagttgagccaaaaagatgaatgagctgtgcccattacaaaccttgttggttatctgactgctccacagctctaaattcacactcatgtaggtggaagatagcggagaagtaagttattaaaggtgtggtattattaacagtttgtttaatgctcattaaacaaagttaactgcctacttagtttattcatttagtattctttaagagat

SEQ ID NO: 14010 - DNA, 34408 bp, Human
  misc_feature (1)...(34408): n = A,T,C or G
gccacaaagacctggccaggccccctctctcggggtactcttatggtccccaacccgtggctgggaaccagtctgagaacacttctccttctatgtggtccagcccagatgctctgctgggcaatcccgattgggactagaccaagaaatgcaagatagttgactgtggtgggcatggaatcccagctcacgcaaatcctctgctctgtgaacaggggtctgggggaagctgaggaggaaagacttagcggcgcagagggaaggagggcagagccagcctctacctgtgtcacctgggacagctttcttcaccctctggaattcagttgccctgtgggtgcagtagtgggagcaggggtggtaagcccactctatatgcccttctaaaataatgccctttgccatctgagggctaggagtctgtaactggagatgtcttctgatctgagaagctgagggtggaagaagagacccagctgggggaactggaggagtcttggcagaccctggtaggaaaggagagccagagaatggaaatggaacaaaacggatacttgaaagtatcttgttgaggctgggtgcggtggctcaagcctgtaatcccagcactttgggaggctgaggtgggtggatcatgaagtcaggggtttgagaccagcctggccaacatagtgaaacccggtctctacaaaaaatacaaaaatagccaggtgtggtggtgtgcgcctgtaatcccagctacttgggagtctgaggcaggagagtcacttgaacctgggaggcggaggttgcagtgagcctagactgcgccattgcactccagcctgggagacagagcaagactccatctcaaaaaaaaaaaaaaaaaaaaaaaagaaagtatcttgttgagtgactgaatgaaagagccacagggggaacctaggaagaaagcagggcagggggttcatctacactggaataggggtctcgggtgggggtcagatgacttgtgtctcttccatcatgtgtctcatgagacctagttctgccccagctctgccattgctgcgtaagcttgggaagcttattttgctcctctgggcctcagtgtccccatctataaaatggggcaaataatcctctccttgcaccccaggggctttgagacgtgaaaaggaatgtatctgtcaatatccagagatatccaatctgtgctggatgaccttgaccaaatcacattccctctctgtgccaattcacccctgggccttggtttgtccttctgaaaaacggctgatcatcttggaggatctttccatctcctccatgtcacctcttctcagcagtgctctctgattctctcaggcttccgttaggggtccttctaaatgcactctcagcctcctgtctgccgaccgggcacctgcttgcccaatgaatatcttgctcactagcctggtgcttctgaggtcaggaccacgtcttgctactgtcccctgcacccagtacagtgttagaatgtagtaaatgctcagtatgcttgttcaatgaatgaaggttgactgaatcaaccacagagatgatcagagtctcctttacagatggggaaactgaggcactgagaaatgatctccctgggtgccatggcaaggggaggccgccacccgacatgggcatcgggaaagtggggccgaggccactctttgacaaaagtgactcagcagctggcggctggcgtgggctgtggaatttctaagcatcccctcacatcctgagcgaacgggcgatgggagggagtaagcagagggaaaagaagaaaaacaagaaacttgggggaaaagaaagagagagggggaaaaaaactgaaattgaaaacagacgcacgcgtccaccctccctgccccgccgcccccccttctcccagctgggccaatcagaagccaccctgcagcctttcccccaaagtggcgggggaagtgggggggcatggaagcccatagtggtgtgagctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaaaaaaaaaaaaaaaaaaaagggaagatatttttaacaaaacaagatgagaggaggctgggagactgtgggtgatgtcagggatggaggagccagttttctcctttcccctgctctggggtgagtggcctccacctcatcatccctgctgctcctgccttcatcaaacaatcctcaggggtttctgggtgctgactgggggcctccaaagcacagcacagtcaatggggagtggggagagctgggaagagcgggagaggggaattgggagaaggtaggcagggtacacagaaagcaggggactggggacctcaggaccatagccgctgttccttggcccaagccttgtttctaagaatcagtctggctttaggccagtcagccgccaggcaacctctggggatttaaatggatttgcaaattttctagattcttaagatatccttctaaacccccagcagctagaaaagtttgagggctaggaaagttcgagggtgatgggcggccatggcaaccccctagcggtcatgctgctgggtctgggggctgggacctggctgtcagatctgggggctcctctgtgaagaaggggtcagccactgggccatttcctttggtcccaggcagctgctcaggcctcctcgttgtctccctccttctggactctaccccttctccatgccattctaaagcataaatccaatcacaccacctccctgcccaggatccgcctatggctccccagtgcctggagaaagtcccagctcctaacagaggctgccactgcttgacacttactgcacgccgcaactgtgctgagtgctttatgagactgatctcatgtaatgctcaccagcaaccccagaggcagtgactgtttttacctccgttttatacatgaggaaattgaggctcacgcagccacctaactgtagccacacagctagtaagtggcacagcctggagaggttggaatctccccgtgccccattactccaaacttgggccttttgttcccgccagtcagatcccaaaattcccagaaggaatgcgcaccatcctgcttgtgggcatttgccctccctcttccccctttctggaatgcccttcctcatcacttttctttcagggatattccatacaccacctcttccaggcagccttcctaggttcttcctgtcttccaagtgctagccatgcactttgtgctgaagccatgttacttggccctcccctgttggtgatctgtttatgttctgtttgttcatcagagattgttcaggccccagcagtcagaactgaggccgcactttctgctggggaaaggtttaaggtttccccatcctgtgctcttcccccagtgcccagccctggataggcagtgcggctgaaaaaatgtcctggtgaaagggaggaggagctcactgaagaccttctgctcccaagtgtgagactagaacccaggcctccagccttctcacaggtgcccttccaggacatcgtgtggctactccaggcagcattcctccattgcaagcagggaggagtatctctgcttccctctgtgacctcccaattgcacagaggcctctagtgacaagttctgaagtcatgcagtcctcccctgtctccaagcaggagaccctgaatccacagccttcagggacatacagtccctgaacacctacctcatgcaggcatagagcctggtacttcacacaccttggagtcctcatggcaagtttttgaaatcagtgttattacctactttttgtagatgaggaagctgagatctggagaggctaagtgactttcccagggccatacggtgagttaaggtggtgtttaggctgaagtctgcctgactctaaaggcttacctcgtgctccccgggaagctcccagtcagagggaagaatctccatcctcctgcagagcctgctcctggcttcagcaccttccccagcagaaagtgcagcctcaggtctgactgctccaaggtctgcccgggccctggcttggtcttgagagaggaaagagaccatctggtcagcaccctcctcccagacagcagttatcagcagcccccctcctctgcgggaagaagagctgggacttataattgcccacacatgtggggcaggcagtggaaagcaccgtggatccagagtcaggagacccagtgcttgccctggctcgatttaaatccaccgtgtggccaacctcagaccccccacatcccatctctgggctccttccgcagctgggaggcagtgagcgctgtgggtaaccagcaccaggcttgggcatcagatgactatgcattgaccccgagtcagtttctggctgactgtgtgaccccggggcagcaccttgcctctctgggcctcaatctccttctctgtgagcagcaggaccgtgtgtgggctccatgagacaacagcattggcaaggtgcttaccacagttcctgcacttcacagctggacctctggccactggctgagagaaccactgctctcctggcctcctgcattggaacacttggctgtgaaattaatctgcaacctgcaaaaggctctgcccacagaagggacctggacaccatgtatgttccaaagatccgtgtccatcctccaggcacaggccacagtctgactctgagaccagctgccttctaggctaaaggagggtgctctgggcattggctcagaacaggctgctgctgaatgcagtgggaagggagaaagggatgaaaaggtcttctgaaatgcccgcccatttcttgcatttgattcagaacccagtgggcagtgggttcttggaatgggaatctttttggtgccccctgtcttctgacccagagcgttaggagggaagggaaggggtgttgggccccttcccagggtcagggcttgtagcacctcagctgggaagcagtgtgagcatgatgatataacaggaaccaactcgttcttagcactttctgtgtctacttcaattgtgctttacatctgttacctcaaagttgctgctgtattcctcagcacttggaacatgctgggcattcaggacattcttaataaatatttactggattaatttaaccatcgaggctgggcacggtggctcacacatgttatcccagcactttgggaggccgaggcgggtggatcacccgaggtctggagtttgagaccagcctggccaacatggtgaaaccctgtctctactaaaaatacaaaaattagccagacgtggtggtgcgcacctgtatcccagctactcaggaggctgaggcactagaattgcttgaatccaggaggcggagattgcagtgagcctaagcgacagggcaagactgtctcaaaaaaaataaataaataaataaataaaccgtcacagcaacctcaaaattagatatataaactctccccacttttttttttttttttttttgagatggagtctcactctgttgcccaggctggagtgcaatggtatgatcttggctcaccgcaacctccgcttcccaagctcaagtgattctcctgcctcagcctcccaagtagctgggattacaggcgtgtgcgccaccatgcccagctaatttttatatttttagtacagatggggtttcaccgtgttggccaggctggtctcgaactacctgacctcaagtgatccgcctgcctcagactcccaaagtgctgggattacaggcgtgagccaccgcacccagctaaactctccccattttacaggtgagaaagtgcgcagagtcagttgcctaaagtcccacagctcggaagtggcggagctgggatttgcacctgggtgtttctgactccagatccccttgatgagaggctggatggggcctgggatgcccctggggatccagtgtaaaccctgagaatgtgcctcagctgtgggggccctcagcattccagaggtagtcatcagaccctagaaccctatgggactgtgcacagatcgttcccttctggggcctcagttttcccatcagtcaaacgaggaggttgacccagatgatggtaaatctttcttccagccctaaaacaatttcaggattccaagccatgccagcccagattggcagctgcacaagccttgctgtgtactcagggatcatgcatatttaatttcacaatgaaagggtttttttcttaccctttttctacacattacagaaagaggtcaggatcgatgaccactaatggaaaactttaacctgcaataacaatgaggaactttctgacaattagtgtggccccttaacgtgctcagtttcttgaggagctcagagggctcctacagttcccacatgcccattttcctgagatactgagcagggagggtcggggaggaaggcccactaggggctgtgtgtggatgctgtaaccctttaggtctcttccagtgctgcgttttcaaacctcatatgctctaatttcaagaggaagcaaggctttggcccagatgagtgatgggatccagaggtgagggggggaatggacacagggacctacctctggtgggagtgggtgtgaaattcccatgcttgttgcttccagtgtggaagcccacttcacatccctcctgagccctcaggcccagatcctcaggataaagtcttcctgaacctccaagccttagccccagagcccaccctgcccccgccccctacatccaccagatgcttcctggggtagcccacccccagcctggtgcaggaggctgaaaatcaaagtgtactgctttaaccgcattaaaatcccctcctctcctcaattcagatcagggctatttgatgtctcaggtgcctgaaaccttttatctgccagaggtaccagcttctccgccctgtgatggagagggctgtcccttgggagggtcagggggtctgaaagttcctgaatgtcagagatgaaaaggacttttgggggtcacctgatccaactgctttattgtatggatgggaactaaggtccagagaggggaagggttgcacctaaggtccgtacagatcattggtgatgacgctgagcctgggacctgggctcgcctttgttccaccacaggtgctgggtctttaccatctctctgaaggcctggagagacccagctccacctctgtggttcagggctcagcctccaggtctgtctgggctatgggctgaaaaggagcaaagccgtcccaacaagaaatgggaatcttcctgggtggtttgctggacccccgagcttttggccataccacttcttcattctaatcatagtttcctcttataataaagtggggagaagccaagggagaagtttagtggcccccagaggtccatccagctctgcccttagcccctgagagttcctaccatgcttcttgtgactgttttgccacatcctcattgctgctgctctgttaccttcccttctgagaagtggaaacccaagggcagtgacaccaccagcttcttcacttctgaggctgagcctcagtggttatagggtggggcagggtttccagttagccttagaggggtagggctcagctttctaaacatgtcacagaagccctggcccctcctggcccagagcattgaaggtaaaggtgcaggtttgacctggtggactgtgggtggctcccatctcacctgtatttgtgtccttatcagtgtccaacccagggcctatctgctgaatggatagtgaaataatcactagataaataaatgcatgtagagatgcataaatggattggtgggtgggtggatggatggatggatggatggataaatcgatggagacagacagatggcctcccctttagtccagggcacagagatggcttcatgagtactcatcctcctgagggccccatgcttagaagggcctatgtttggtttaatgctctgcagtcatcattttgaaattgttaataatttttaacaaagagccctgcatttccattttgtgcttgccccacaaattatgtagcttgtcctgccagggagttcaggctgagtttgggacggcttcatccccaacactggccttgcagcctccactgtccccatcctaatccacagcctcccactaaatgccagcctgctggtgtcatcctcctgcatggaggccccctccccacagtgcctggagttacagcattgccctgccaagccagcagctactacccgccatcactatcaacaccttgaaaagttggtggtccagagaaaatcctcacacagcaccgcagacctttcctgaagtctccctgcctccttccctggcctcctgctgcctccttcccaggccatcacctacctgtttgctgaagagccccagtttctagcccaacagatctctccctgccatttctcccagatgcctttcatctctcacagagccctggccatacctttccctggcatcatctgccaaaaaactcaagaaaccctggaggcctagctcaaggccacctccctcaggaagccatacccgctctccccactggagtaatcatatactgttgttagttaccatttactgggcacctatgatgtgccaagtgctgtgcgtcatcatctctggccctcccagaaatggaaaaggaggtctcccatgccatttcccaggaaattgggactcagataagttaaactcagagaactggggcttggacccaggaataagtggcttccagctggaaccactgctcccagcctggcggggctcccatccctgccctggatggcatcaggcgcagcctgttggcttcagagtgccatatgtctgttctgccctcaccagctcatctccatcacctccctggaaggaaagagtcaccattgcctatccatgccagttccctagcctagtgaatcctgtgttattaggaggcagccgagggcccaggactgaagagctgaccctacagagccatttaatctctcatatcgtgtaagcgtttactgagcacctactgtaggcctaattccatattaggaagttgaagagagtccagatcgttgttaggtaggtatcctgatttgtgggaagtcatattaaaggactaagacaaaagttcaggaaagaagtaattgacagacagtggtgattagatgggtctggccttaggttggccaccgaatcgccgagtgtgctaggatgagacactcctcactgagcctcaggacactgaaaagggctgttgctactgattgtaccaataatcagcagctacctcttcctgaggagcgtcttttgggagaggccttcttgcaccgtctcatttatcacatgcatcactttgctgagaagcctagtcccgtggagtcttggctgtgcgcgcaaggccgagtgagtgagtgacttcttctcccttgagtgaatgaataataataatgtggccaccaactttgcagagggctgtgtgccaggccctattctaagcattttgcttgtgttaactccttcaatagccctgacaacccagtgatgagccccaatctacagatgagaaaactgaggcacagaggggtggttaagtgaatgaccgaagacaggggtgggaggacagatgctgagacagtgagagggtcagtgaaacatgggggttctctgccctcctgctctgccgcccaggagggctctgaggggaatctcaatgtttggtaattggcactgataagtgaagggtttactcattagctagctacccctcccctatttgcaggccctgggcctgtgggggaaggctgtgtgctggtgggtcagtgtgaatggcccaaggcctgcctgtcccctgcccacttggctctgagaacccattctatttgcggcccccaccccagcccatggctgctccgggctggcagcagcccggggaacagaaggtttgcttgtctgcgcctgccgcacccccctcctcagtctcagcctgggacccctctcaggggctcctttggctgccaagggcctggcactccctgttgccatggcaccggccggagatgaggctctggggggtggggatggggagggcagcagcaggatggtggaggcctggaactctgcagctacagaggccctggccctctgcaaacagtggaagggggtgctggggcccccacaggggcaggcctggaccctgtgcacagcaggcctgtggcagagccggccacacacctgggctgattgcctggatgctgtatcccgcaggagcactgcccctgccagaccctggctttcctaagcaaaaactctctcctcagccttgtgtgctcaccctcagcctctgcagcgaaattgtggagttctatccctagtcctgggttctatccctagctcgactttaaaattattggtgacccggggcaggcctcccgcatacactgcccctcagtcagagcagaggcgggacccagatccctgaggatcttctcatccctgagatcctggattccgtatggacgccattagagggagaacgtttctctgtggacagatggacagaactgtttctggtcaggagacagacagtctggcatgacgggcaagaattcaggttttggcagttgtggtgatgcgcacctgtagtcccagctactcaggaggctgaggcgggaggatcacttgagcccaggagtttgaggctatagtgagctgtgagctatgatcatgccaccacaccactgtactccagcgtgggcaacagagcgagaccctgtctctaaaaaaaagaaagaatataggctttggagtcaggccggcctgagtttgcattcccgttcctttgcatcttacttattgtgtgaccttgggaaagttaccaaaagtctctgagactcatcattctcctctgtaaaatgggaataatgagtgtacccccctcacagggtggtcgtgaggatgaaacaaaatctccagatcatctcatttagcagagtgcctggctctaaattagtagggacttttgtttgtttccagattgggggggatcagaacaataactagaaagatgtcctgtatttggggagagggtggttggtggatagaagcaagaccaataagcagagaatacagtgagataaactgtactcagtgtaattaacaattctcaatagtctgccctctgaagattctaagctggctaagaatgaaatgggccacaggtgaggtggtgagagccctgtcatgggaggtgtgcaattgcagagaaggtgggggagatgtgaatagagggaatgtactaagactgtagggctctgtgaaaaatggagtgactgtttcccactcaaactgtcagcttcagctttacccagctcaaaagacagcgtgaaagagtgaaaggagaagttgggacaaagaaggcgaaaagataaggctgacgactttattttttaatttatttttttgagacggagtttcactcttgttgcccaggctggagtgcagtggcgcgatctcgggttcaagcaattctcctgactcagcctcccgagaagctgggattacaggctccctccaccacgcctggctaattaacttttatttttttttatttgagcttgttctgtgccaggtactgggctgtcctttttgcggggctccttatctttgcctcctgccacagaggggctgtctcatgggcattgggctgtgtgctctggagcctgtctgcccagtgttaaacactggagacaccactggcaagcttttgggcaaacaatgtaaacagtctgtgcctcagtttccacatctgtaaaatgaggaagcagtactgatgtcatgggattgttctgaggacttggtgagatcattcatataaggagcttagcatagatagtgggtgataagtacagcagacccttgaacaatgagggggctggggacagccaccaactgcaaagttgaaaattcatgtatagcttttgactccccaaaaacttaactgctaatagccagcctactgtgggccttactgataatgtaaagtcaattaacacatattttgtctgttatgtatattatatactatgttcttacaataaagtaagctagatgaaagaaaatcacaaggaagagaaaatacattcagtttatattaagtggaagtagatcactgaaaaagtcttcacccttgtctgcacgttaagtagactgggaaggaggaggaagaggaagggttggccttgctttcaggggtggcagaggcggaagaggtggaggagtggaagggtgggaaggaggtggatgtttcacatgtgtggaacattcacgtgttagtggacctgcacagttcaaacctgtgtagttcaagggtcaactgtactaaatcagaggtagctattattattattgttatttttaaggctgttggaggcccagatggggccggggtgggtggggggactcagggccaggaatccacagggccctgggggtaaccctcaaggcaccgcaggaggcaggaagtgcttgctctgcagccggtgggcaggggtgtgcagcaggcctccctccctcactgacctccttctcaggctgcttcccagccttcctggggacccaggccccctcccttgggcccccagcagccgtgaggcacacactgagcgctttcccacgcactgttccaagtagccagccgcatcgctgcccccacccccaagcacacgcactctgacgggtgagggggtgtttgctgcaggagagcggggctcgggctggggagatcagcccgttctttatcagcctggccccattccagacagatgtttcatcttattttggacttccagaaaataggtcatttctttccattgtgttccctggggaggcctcatggggagaggagcatgcagtgagtgacgagtgtgagggcctggcttgggccctggggagctggaggggcagccgccttcctccctcagttgtgagggagctgtcagggccgggccggaagattctgaaaggctgggcagagaagccagcctttgcctgagggggatggagagcagaggagggccggagaggtcacataggtatttcagaaaggtccctctggctggggtgtgagaacaggtggaggggacagattggaggtgaggagattggcggtgggatagccagaggcagccgagcctgtgctggaggagggggtgcagggggcttagcagccttccagggaaccagcgctattcttccatccagtttggacttccagagcagcgggagcacacgccaggccccatcttagtcgatttctgctgctttgttcaggggactttgtaggtacctggagaaacataaagaggaccccgggcctagaagcagcgtggcacagagaatggctccaacaccgagtgggctgcgccgggctgctctctttctgtagcccttagagtgatcccgaggctggtggggaggttcgtggtgcaggggtggagcactgagccttctccaacaactggaagtggagcgagcataggattgaagggggcgggtgggagcctcggccacttccccagtttctcccctccacctgtaactgtctcctcaccctccgatcctgctctcttctctggctcccaggatggggctccctgatcacatgacccaatcacacccacatctcagcctgcttggggacagccacatggaccagacttgccgccagacccaggctgtgctgctatccctttcctactctttagctgctggcgggaggacttcatccctggctccagatgcctcttgcccccacagactcccaggcctggaactggcagccttctctgagctgagtcatgacatgggtccctccccagcacccccaccccgagcccagcattccagctcagcacagctgccttcccagagtggagccctgagggccacagcatgtcagccctgaaagtgctcccaagacactcttgcccacccttttgcacagataaggaaactgaggctcagagagggtcaggactgtacagtagtcacccttagctgcagtttcactttctgaagtttcagttaccccagatcaactgtggtccaaaaacattaaatggaaaattccagaaataaacaacttacaagctttaaattttgtgctgttctgagtagtgtgatgaaatcttgcactgtcctgtctgtcccgcccaggagtgaatcatccctttgtccatatacgctacccacctgttagtcatcaacaaagtccactactgacatccagccatcaacaccatcatggctcggtggtccaggatcacttggagcagatgacctgatccttctgataatgtctggaggtcagtagtagcctaacgctacttcacaattcttacgccatcacctcacttcctcttatcacgtaggcaccgtgtcattccacgtcttcacaagaagagtgaacgatacagtaagatattttaagagagagaacacagtcacatgacttttattacagtatatttttatcattgttctattttattattattgttgttcatctcttactgtgccttatttataaataaaactttataataggtatgtatttgcagggaaaagaacatagtatgtatggggtttggttttatccaaagtttcaggcatctactggggccttggaatgtattccctgcagataggggggaccactatcctataagtgggtgtcacagccgggactagagccaggtcttcttacttcccaccccaacccccctccaaagtctgtcccaggcctgtaaagtgccccggtacggagaacagaagactggactgggtcaggagactggagtctgtggctcacttctcccaacaacttagcaaattacctcctctgagtctcagtcgccaatccctgcctggctgggctcgtgcagagaatgtgactttgaaacaaaggtcaatgtgtggcaggacagaggtgtgctgtggagagggcaggggcagctatagcctgaagcctggggccttgagccaccagcctcacatcttagcaggggctggaggcggggagctgcgcagccaggtgagcttcagccccaccgatcacccgagcccatcttgtctaggccaaaacaatgggccctcttgctttccttccctaagcctcagtttccccacgagcacaatggagcacaggaaggcagttagatcagatagatgatccctgagggctctggcgtgctgacattccaagactctgaccccataaccccatggccaggcctcctcctccctcaggcatttggtttattcagagcatcccaggcctgagactgcctgcccccagcacccccctctccctgcagcatggccctctctctctcatctcactgctgtttctacccggcctgttcctggcctccagactgaacatcccactgtcccctcagtgcccacagaccctccctatcctaaacctgctcagttgcagctctcactcctgctctttgacctcattctcatctcagaaaatggcatcgtcccctcagcacgtgcgcgtgtacacacacacacacatacacttctgcctcccagtattccaagccagatacagaggtgcatacctccctctccagcccctcaatattaagtcacccagtcctgttgattctcagctaagtaactctcaaatccatctgtttttttcagtccccactgccttctccccagacccaaccaaacatgcacgttggtcagagaagcggtggagctggtggcatagaacacagagtcacaccacttcactttaatctctgctctaccccttctggctctgtgttcctagcccagttattaaatgctctctgcctcagtttccccactgtaaaatggaaatgatcactgtatctacctcatagagttgatggagaatcaagtgagccaatacgtgccaaatgctcagaatggttcctggtgcagtaacacgggctttctggcttgtctgttcatgcatatggctgtgtgttcaggtgaatttggggttctatgtgcacatgttctgtgcatgttgtatgtgctgcatacacatgtgaactgttgcacacgggtgcatctccacgggtgctgggcacagtgggagctgcgcacatgtgttttgtgtgggtgtgtacatgtttagtacctgcatgagggcttggcacccacatggcctcttgcatacgtatgtgtttcagaggagtgtgcgaggaagtgcgtaggcaggcatctgtgcatctgtgctgtgtgtatgtgctgaccatgtgcaggctccccccatcaacccccgcagcaatgcagggccccctccctggcctgcctgtgtcgtgggagcctcaggaccctgagggagggaagctgttgctggcggatgtggccaagatgggctggatttatttagattaaggcggtgggaaaggagtggagaattgtacgtgctgggaggagggaagtctggggctctgagaatgactccccaagcatgcttgctctcctggacttggggcacccactcctctcccctggacttggggtccttactctgctcctttgacttggggtccccactctgcttccttttgacttggagttcccagtctgctcccctggacttggggtccttactccgctcccctagacttggggccccccactcctctcccctgaacttggggttccactctgtgccccggacttggggtcctcactctgctcccctaaggggtccctctgagtcacgtgaggagctgggcatgatctccactttgggcctctgagcctacaacctggccagaataggaggaatcaggaggggttcctggcacatagcactctcttcatgggcaaaagggggacacctaggggtgccctccctctctctgctctagaggcctccctgggcaggagagtacagcagatagggggagtgcctgctctctgactgtgacatccagcttgtcctaggtggcccttccctagagtacagtcctcctaaagaggggaagttgtcacaggcaagcccactaccaccaagtcagctgcctgggcctccctgggattggctggaaccagaacagcctctgggaagcacaaagaggcctaacacatttggtggaaaatgtggggtatcagggagtcatccaggatggcctgggaagtcatgtctgggtgccctaagcccttctctgccctccctggccctccagcctcttgtccctaccactctttccttgccacctcctggggttccacgtcaccagcggaaagtcccctgaaacactgttgaaacactgttgtctaacttttttttttttttttgagacagagtctcactctgtcaccaggctggagtgtagtggcgtgatctcagctcactgcaacctccgcctcctgggttcaagcgattctcctgcctcggcctcctgagtagctgggactgcaggcacttgccaccatgtccagctaatttttgtatttttagtagagacggggtttcaccatgttggctaggttggtctcgatctctcaacctcgtgatccgcctggctcggcctcccaaagtgctgggattacaggcatgagccaccatgcccagccttggtctaactcttaattgtatagatggggaaactgaggcccagagagggaaacaacttgtcaaagcccgcacagcaagtctgtggctgaatagtcatggaaattcctttcgtggaatgagatggctggtggattcttatgtgactctagcctcaggaatgtagccccctcctgcttactagcccccacctcctcaaaacaccccggtaagattcgtggtgactagaatcttctctttggcctgtcagaaaggcagagcttcaccatagggacagctctttgagatgacacctgccaacctctctatatggatggggacgcagagttcagagaggctggagactcgctcagtctcacagtgggtcccagggtgcttatgaggggagctgattgctctattcatagtaaagccagtccgagatccctggggtgcctacaccctccctacggcatccacactgcctgcctgtcctctccccacagcttgaatctgcctttttgctgtgtgactggggcatgcttctgtccttctctgggcctctgctgcccattcaaaaagcatacctcctagctcagagtctctaagccacccccagccccaggcccagcagaagagagcctgaaggggagaggatggagtgccacatgggaggagggtcgggggctgcatgccatgaaggcccagcccacatagccagcccagccttccagagccaggccagccccgctgcagtgacctcccttctcctggccagccggccaaattcctcctttagaataataaacagtgtggccagccagggagactgggagaggaggggcagggaagctgaagtgaccccctcccccagcctctgctaatgattttctttggctgagatctctagcaggaagggggcagccagaggggcaccgacggaggggcagatgggcctctgtgggggctgctggctccgccttggcgctgctccctcctgaccaaggaggcctggcatccagctggaggggctggggcagaggaatggtggggagcagaggctggagggggcgtcagaagggctgggctttgagtcaggagcagttcagagaggggagaggaagaaacgaggagaccttcaggcaggcagtctgaaagggaggagggaggagaagagctgatttgctcagactgtttcttggggtgttgggaagagctaagattgggggtccataggcgggaggagccttgcctatgtcccacccctgacatgtgaatgcagccctggtaggtgaggtactcaccatcatccacttccagagctggggacttaggccacagggagagcgatggcacaagaggtggcatgctggggcctgaacccggtctgcagacctaaactgaaaactaaaaggggtgagatggggaggtaggggcaagctgggcatggccttcagaggcaggccaggctgggcagccccacagccagaggaggctccttgttgcctcatcatgccgtcacctcccaaagctcatgctctgcgacccctgtcctctggcgtccttcctgccaatgctgcaggcagactcttggcatacttggctcctggtggtctcttgggacctgaggtgtgtcttccaagatagaggagagcaagggccaccccattcagtctgtctctgtctttgtccttgcttctgtctctgtctttgtccttgcttctgtctctgtctttgtccttgcttctgtctctgtctttgtccttgcttctgtctcttagtgcctctggtgctgtctctctgggcacctcctctctgtctctgtgtctttgtctctttctacttctatcattccaggtctctttctctctgtctccctctcagacaggctctgctgtggaatcttgggtaaacttctcaccttctcagagcctcagtttccccatctgcaccctgggggtgggggtggggggagcctggcttcactggtctccaaggacctgtgaggcctggctgctcgatgggacctctcctgggcccagcccctagccgctgtcccctgggcctccctgtatgctctgggctgagtaaaggtgtccaggcccacctcccacattccacagccccggctccccggcttcccttcccacagcccacagcctcctccatttcctgttgtgcttgtggagctgcgggagttctctgggttctggcctcccccctcctcctcccatccctttcatcacactttcccaaatatttgtcctggcagataagagcctggtattggaactgtcacccggaggacaggctgtcagagctggtaggctactggataccatccagcccaacttcccctccctcactgtacagacagggaaactaaggcacagagagagtctggggacgcagccgaggccacgtgagagtcacaagcagagccaaagcaaaggccaggaccccaaggctaagtccgggatggagaggagacagcctgtggtcatgagtgccctttcaggcttgggacgtggtggcttttgacttcagcccctcggacatgaaggctgggtggcccaagctggggctcattctgcaggagccaggtggtgagatagcccctgtcgctgcctccacctgccctgggccctgactcctgtttaactctgcaggacaccatgcggcttccgggtgcgatgccagctctggccctcaaaggtgggtagatgggagataaggtaggggacccggggggctgcggagtggaaccctggagctggcaggggtgatgtgtgctggtggcagggcgtgaagcaccaggcacactgccctgcccttcagctttagttttcaggatttccagtgggctctgtggaggcctccagctgccagcccttcagctcagaaagcgtcagtgggcccctgcttgtccagaaccatcagctcaaatcctttgattggccctccagaccccatcccaccttctggcccacacccctggcctcctatcctcggtctggtggatctgtggcactcggcttggacccctcattggctgggagcttccaggtccctgctgggcttctcagcacaccccacccctcactcctgcccgttaacatgtcttcagctctgcaggggctgagcgactgacccagcaattaatgaccagccagcagcctgcccggcagctggccataagatggactggctgcctgaccgcccacctcccctcctgatctgtatcaccagggggcatggagggcgtggcctgaaaaatccttctccaggggatgtcgtggagggggaccaatcacttgacacacacacacccccaaccccagttccctccagcccaaaagggcctcagcatcttttctggcccccctctgagctacctaagcccctccctcccatctctctcccacccagagccacctctgggccttgggcagaacctgggcagtcgggggagggggcagagagctgtagggaagaggctcagaaagtgacctgggaagcaatgcaggaactggaggccagggaattgcttcccgaggatttcctggccccttctggtgcctactgcctacacatggcactgctgaaggactcagaggctggggtctaacgggactgacagaggcagtccagaggaatccctggggccttggagctgggcgagcggtcctcagagccatggctggagagccccagtctgtcggataaaggagctgtgctcctcaaggacctgagggctgtgcatacgtggcctcctcgcaggctcagccttgggagaggtgctgaagcccctgtttcctgatgtctgatacctcctctcccaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccaggtaagggctcccagcctgtgtgcccactccttacccctcttgtcaactggaggcatcaggggaagtccagagagtgctttagtttattgtgaaatgcagccatcctagaaaagcagacaatcatggaaccagcctggctcagtcggggagtgtgttcgcccccactccttggtctgggtgatctgcctgctccctgccagtcaccctattcctgcctcccaagaactctatattctcagctgcttccaatctgctccctcttgaccccacatcccttcttccccattctccaagctccagatatcagctgcatttcaacttgtgacttgccttctttcttaccctggcactgtcaatatcaaacattagagctggaagggaccagctctaacatttgatttatgctcttctgggagcatccctattctgtaacggggagacagagggccagagatggcaaatgacttgccacacagcaattcaggggatggccagaaacccagttcccctgatttattcacggctccactcctggcagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgctcagcagaggcaagtataaccctccacagaggaatagccctttacagtttacaaagtgtgggactccacttcccagtggattctcaccacagccttcgaaggaagatagtgttttccccatgttacagaagagggaaactcaggcgcagagagaggatggagcttgtcccctgtcgcagaattcgatagtggcagagctggcctgtgcaacatggtcggtgagggcacaagcttcagagccagctgggtcgaaatcccagctttgctatttcctgtctgagtgactttacacaaagcacataatctctctgagcctgcttcccctcttgtaacgtggggataacaatggctgcctacctcataggatcaattgtgaagattaaataaaagatggagagtacctggcacatgttatgtgctcaatacatttctcctgtacatagatctccagagggtactttgatttccagactgttatcccttctagaacgtcagctccataagaacagagattttgtccactttgttcactactgttgctccagtgtccagaatagtacttggcatgtagtaggtattcagtaaatatttgttgaatgaatgaatcttctacatcagtcatcctttccctctctagccccctaccctatccccaagctgaagtgctagtggctggtggtgacttccccagacctaagccaatctctctctaccagtgtcatccatcaacgtctctgtgaacgcagtgcagactgtggtccgccagggtgagaacatcaccctcatgtgcattgtgatcgggaatgaggtggtcaacttcgagtggacatacccccgcaaagaagtaatgtggggccaggcaggggtcggaggaggggccaggaacgggtggatatctggcttgcaggctgatttctccccggcccctcctgatttggggggcctgcccaacctgttgctgcagagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttggtgtgtgccttgggctcagcccaatccccaattccttcaacgctccccaccctcacccactttgctgggtgcagagtgatggtgagagttgcatttttgatacagtgatcagggctgagctggacccagtgcctgtcacagccccggggtatagtcagccacactccagtgcagccctagctagcctctgtgccaaccaaaaccccaattccaggataaaccccaaaccaaaatgtagtgtcagccccaaatccaaccctatctcaacctagactttctgactagccagagccccagccccaacctgacttccaagcccaactgccatcccaggtccgggaagccccatccccaaattcaaccttatcactagtcccagcatcagccacagtactgacccagaacagagaactgttagtacaactctgttcccaacctgggagctggccccagcatccatattagccccaaattcggccccttctccaggccctgtccccagcccaatttcaacctcagctccggaaactccatggctggcacggtccccaggcctgaagccccaccccacaggctggcctcctttgggattcagttggtgccctgcccccagggccccgcccctgacggtcaccccttgcagagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtgagcagctcgctctcccatcccattcttgaagttatttttctttgcagccgccaggcagccctcggctttcagccacaaacctaggcccagctttctgagagcatattaggtgccaggtgctggggatgctgcagcgaccagagctgacagttcatccctcctagagtttctagtctagtggaggaaacagtcgccggtcagatgatcacccagatgtttagttgtccttgtgatgggtggggccagcagtagcagccaagaagtaaacgggcagatgactggggaagagggtgccaggcaggccactcatggcctgtggtatccctgaggctggagatttgctggctgacagagactgtggtaggttaggatggagcagtgtccacctttctgaaggggagagaaataggactttccttcaatgctccccacccccacccacagttcatctcaaccctccctcttggcctaggggaactgcctgtgggtgaggatttacgagacctggtttgagtcccggctctgctaccaatgccgagatgaccttggcaagcccttcccctccctgggccttgttcctctttataccaggagggtggggagaactgtaagagtccttccgactctgacagctgcctttcctgctccccaggtatgtgtcagagctgacactggttcgcgtgaaggtggcagaggctggccactacaccatgcgggccttccatgaggatgctgaggtccagctctccttccagctacagatcaatggtgatgagcacgcccctcgccatgtccctgctccttcccctccctgcccccgttccctctcccttcctgcactgtccacccacccatgggaggagtgggagagggagcctggaactcaggagatggattctaggccactgacccactgccgtgtgaacctggcctctgggcctcagtttccccagctgtataaggaggccatctggctagattggtgtttccaaaacttcaggcacttaggtaccaaggccatgattttcccttctcacattccacttatactgtactattaactcgataggtatttattgagcaactaccatatgcctgtctcttcaaggttcttgaacttccctccctgcctttgtgcagcttgcatccaagtaggggaagacaaacactaacagtagggaggaaaaccccagcaaattacataggttagaaggtaactaacactgcgggagaggaaaaacaggggccgggtagggaaggttgagagtgctgggcacagagtgatggtgtgagttgcatttttgatacagtgatcagggctgaggaagtgacatttgcatgaagacctgaagaaggtgaggacattagcttagtggatatttggggaaagggtacctcgggcagtgcaaaggccagagcaatcactgaaaggcttgtgtggttggaacagggctgttggggagagtggtgggagatgaagtcagaacggggatagggcagtgggggctgggagaagggcaaatcgcataggtctttgtgggcctggtgcagactttggcttttactatgaccgaaatgaagagccatggcagggttttgagcagagaaatgacatgataatgacttaatgttttgttaattgactttctaaaaacaaatttattttgaaagacaaaatgtaacctctctattgtaggtggaaaatcggcatcacatgtcataaatataaagcaaccactaaaataaactcagagaagaccaaacaatgctattaaatgctggcttcatgagcttggtggcccagggttctgagcttgaggcctagcctccctttgttaaaagggaagattagcaagtctcagagaggtgttaaagacagactagcaccctgctgaggcgttccctttgaagtacccagaagggaacccatcggttttcacactgattcctggtatttaatgttcacctgcagtctacagccctcctcccccaagagagtctctgggccaggtcctcccctgaggacctgtcctgttaactgtcctgaccctcccgcctcctaactcagtgctctctccatgcagtccctgtccgagtgctggagctaagtgagagccaccctgacagtggggaacagacagtccgctgtcgtggccggggcatgccccagccgaacatcatctggtctgcctgcagagacctcaaaaggtgagcagacctgggcctcagtctcccagtgtccccagctggctagaaaaagctcgtgaaggttatctagtcccgcccgttcttcttggcatattgttccgggcatagagttgcatcctaggaggccaggtcaccacctccttggtcctactctgtatgacctaaatggtcccttttccttacctttacccctgggcagtttggcctagcaaagtgcagggtctgagccccagagacctcacccgccctgtagatcagttctgcactcctggccaggtcgattctaatgcagtggacagaggcaggattcagtgcaggttctgcctctaccccatacgccgtgtgaccccgtgggtcaaataagaatggattttgcaatccacgttgtcagttctgggatgggagcaccccctgctgaccagtagagggagcacaggaggagcccgctcggaaacaggcagtgggacataggaactggacacgtcctgcctccttccaccagtttctcctcagtttccctgtctgcaaggggaaggggctggcagccaaccctaccggctctcctggcaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactgtgagtccccagcctcagtggcccctgacgatcccaatccctaccttaatcctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctgtaagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctgtttaaaccccacagtgtatgtctgtatgcatgtaccggtgggtacacaattcctgtacatgtgtacaagcaatgcatgtacaattcctttgcatgcatgcaaactggcatagtgcatgtctgtaagcatataattggagcacacctttctagaaaagtgtacaagcataattcccgtacacatgtgcctgctgtacaatgtacatctgttagcaggtacacatacacgtgtaatttctgtgcgtatgaacaatgcctaccagtgtcttgatgcttttgtgtatctagctgcccgtccttatgcatacatgcacctgtatgagtgtgcttcatttattcacctttcttcttcattcgataaatatgaggacccaacttctcattgaagtataaaggtcaaagggctcagccctgcctggacctcctagtacccatagtccagagagagaaggcagacaaggaacttggcaattccctccgggatcaccacattaggggcaaagcctggagggagaaggggtcccatgcccagctatgggattcaggaaagtattctagaaaaggaacctttaggtgaaaacctgaaaaatgactagaagttagcctggtaaggaatggtgtcccactcagagggaatggcctgtgtaaaagcccagaggcaaaatgagttcctagaaatgaaaagagttcaactcaatctggctggaggatcgagtgtgtggatacttaggggctggaagggtggcagataaaggggaaggaagtgctatgggatggagctacaggggtcggcagatctagagcaggcagggctccaaaggccatgtgaggcatcttggtctctgtgtatgcaggtccctgggcatgttcaggcacgtgcctgtctagagctgcctcctgtcccctgccctgtggtggatgggtgggcttctttcatcccctcatttcacccatgctcccacacatgcatacacattctctgagcaagtgggtatctgggcagacagtgtggacagcctgagtggaagaccagctctgagccaaggcagatgtgacacttttgtgtgactaaagcctgagcgggaagctgagcaccagcacacagggcctaggatggctgcaagagggctccttcatgcctccagcgatggctgcctagaagatgcaggcttccttcccaggaccgagatgtgtgatgagcgggaggagggaggagaagagggatgttggtctgggaccctgaggaggaaggcatggcgaggataggtaagggtaagggagaatggataaggggtgagagacgaagttggagagggaagcagaggtagagtcatgaagcctctgccttatgtgccattttaggagtttggcctttttcctttactgataacatggggaagcatccaaagttttttttttttttttttttttttttaagatggagtctggctctgttgcccaggctggagtgcagtggtgtgatctcggctcactgcaagctctgcctcccgggttcaaacaattctcctgcctcagcctcccaaatagctgggatgacagcagtccaccaccacgcccagctattttttgtatttttagtagaaatgggatttcaccatattggccaggccggtcttgaactcctgacctcgtgatccgcccaccttggcctcccaaagtgctgggattacaggcatgagccactgcacccagcctccatccaaagattttaagcataacaatggcattcacttagtaattcaacaaatagtaccagctacctaccatgtgccaggtgtggttttagggactgaggttatagcaatggatggggaggaggaggtgggacaggactccctagggagcaaagaagcatagattggggacagaagaggagggaatgagttccataggacctcatgggtggccagcagggcagggcaggggagaggcaggtctggcggggctggatgaggagagtgggaagctgtacagcgaagaggctgaggccttgagggtggaggagactcgaggcttgtaagggccagtgtgagccccactttgttaactaccgtcaccactccaaccccaactgggccctttgggtgaagtggggagaagtggcctccgtgctgaggtctggattcatcaggctgggggtctcagccattgctccctcagtggccactcactcagtccaccggccactcggtcaggcatggagcttggagtctgaccgagctgtggcagccccagcaagggtgtggactcagaggagaggtaagccacaacccagccctcaggggctccagggctaatgggaggtccaggcaatggacaggaactcagaacaggatttgcaccccgtccagagctctggcagcaaggccagactgactggcagggctgaagggacgtggaggccagcagtgatctgagtgggggtagttactgaggggatggagtatttacaggacagtctgaacgtgtggcctagagcgagatgctgagggtctgacactgcaggctgatggggaggtgggcgcttctattctggacaggatgtgtacggagggatctatgatgccaaagatggggtgaggggagggtagctgcccagtttgctcatggcctgctctcatctctgcctccagccttgccctttaaggtggtggtgatctcagccatcctggccctggtggtgctcaccatcatctcccttatcatcctcatcatgctttggcagaaggtaagcccctccctggcccagtgggtgaagactggcacatcattattttgcataaattccacccctctgccctccttgaatgctgcgtgatctggccacatgcagggctcagcatggaactcaggtggggacttgtgacgctggctgtctcagcttcctccacccccagcagtctgggccaacctgagcctggcccgagctatccaggattcccttcccctactgtgtcattaagtccccgggtcctgctgagacaccattcctctcatcctagccatggagcatgggacctttgaggtggactgcatgggctccaggattcttccaggtctcacccatggagaacctgtgattctactgaaatgcattctgatcctattagtctgtaatttcagtgttctgctttgagattttaccattctgtgattccaacattttaagcttcctgaatcaggattacagcacctcatgatcccatctttctaaaattccagtcctgtggttccaacaccttaagatgtcaacattctaagcttacatctttctgacttgcccagcactggggagggccatccgcatccagccgagtaccctacctggtgtcactttctggggtcacctgctctactacttccatctgaggagcagcgaaggctgggagagaagctagagaggaggttctcatgagccaggccctcagctgccagttgctcctcagtctgccaagtcctgaagcctcctctggggccccttggtccctgttccctccgagcccacgaagaccttggctcagttgagcacttgctgtgtgacttcaaatatgcccctgcccctctctgggcctcagggtctcctgccccatgtgtcctagacggacgaacctaatggggctcagggcctgagactccctctgataactaattcctggggttggtcctccagaagccacgttacgagatccgatggaaggtgattgagtctgtgagctctgacggccatgagtacatctacgtggaccccatgcagctgccctatgactccacgtgggagctgccgcgggaccagcttgtgctgggtcagtcctgagaggcctcatgtggcagtgtggggactcaagttgggtgggaagactctctgaggtctggtcccagccttgccatgactagctatgagacctagggctggtgtcttgccttctctggccctccatctcctactatgtacaatgagagcaagaccatcccccaggaactgcctagcattgaggttctatgatcctgtgaccctgtgagacgggatccctatgtggcaaaagtggaaggattgaggacaggctgagtagcaggcctggtctggctggggaagctgaggaggtacagagaagcgtgctcccttgggagggaagaaactttccagagattaaagatggggcagaaagcaggcaggacttagatgagataccaggaaagacagggaggtattgtggttgcaggagtgtgtttagggaatatcctgagtccaaggtggtttaagtaatgtctaggttgacctaagagagtggctctttcccctcactgggcaggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14011 - DNA, 49829 bp, Human
aggagaaggggttgaggggttcttgcccctgccccagaaaaatcacagaaggggtagagacaaggagagaaggggttggggtactcgccccttcctcagaaaagcgggacttgccgctaagggtgaaggaccaaggcaggcgtccctgcgtggtctgacacctttgaaacgtgggtgaataatcagaggcgtccctgcaatgattaaacaccaagggaaggctgccttcccagcccgtgaccggcgccggagttttgggtccacggataaaacgtgtctcccttgtctctaccagaaaatgaaaggaactgaaattaagagaagggagagattgaagtgcggcgccaagattgaaaggagaaagaggttgagggatagtgagggaagctggagaagacagtaaaaagaggccgcttactggatttgaaattggtgagatgttttttgggctggtcggtctgaggacctgaggtcgtaggtggatctttctcatggagcaaagagcaggaggacagggggattgatctcccaagggaggtcccccgatccgagtcacggcaccaaatttcatgtgcgtccgtgtgaagagaccaccaaacaggctttgtgtgagcaacacggctgtttatttcacctggatgcaggcgggctgagtccgaaaagagagtcagcgaagggagatggattatcattagttcttacaggttttgggtcaggcggtgaagttaagagcaatgttttgcgggcaggggtggatctcacaaagtacattctcaagggtggggagaattacaaagaaacttcttaagggtgggggagattacaaagtacattgatcagttagggtggggcaggaacaaatcacaatggtggaatgtcatccttaaggctatttttacttcttttgtggatcttcagttacttcaggccatctgggtgtatatgtgcaagtcacgggatgcgatggcttggcttgggctcagaggcctgacagctagattttgtatttttagtagagacggggttttaccatgttggccaggttggtcttgaactcctgacctctagcgatccgtccacctgggcctgccaaagtgctgggattatagatgtgagccacctcgcctggcctactccaatttttttgtattgtagtaaaataaacataaaattactatcttaaccatctgtaagtgtatagatcagtggcattcagcacattaacactgtcgtggaaccatcaccaccatccatctccataactcttttcatcttgcaaaactgaaccgcccaatcacacttagtttttatgaggtctaaacaatttcttgttactcttatcactccgacattgtaagccctgtgtatggggcacccatgtattagttataacatacacatagggtatctactattaggcattgctctaagtgctttgcaaatgttaactggcataattatctttgtatgttctgcaggatctagccagtgctttgcacgtgagaggtaaaatatttgaggaatgaacttcggtaccacctaaacatttcccattgactctggctgttattctggttggcaagttaggaaaggagcaggttaccttggggaaaacgactttcggggcgtaatctgatattaggtcgtaagtttaaagaagtcctttattttagccacatttaggccaagttgctaataagggaagctaacagggaagttattcctaaatgatagagaatataggaagtgactcaaggcagttaaggtcttggctttctagtagcaccgcgttcaactccaggaagactcaggccaccggagacccagggttgggacagcctgggatctgtcagcacggtagcgggcgggggcggggcttcgggccggggcggggccgggctgggcgggctgggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagtgagtgcggggccccggccgggagtgggcgggagcctcccctacccctcgcccgaccggcagccctacggccgcagctcctccctgcgccctccttccgcccggacgcgggagtccccgccctctcgcctccttcctccggccgtcggcctcggctcgcccagcaatttaaatcccctgccccccgccgccacgagccctgaaaacctccgcctcggtacctcccgccctccttcctgcaaaccaaaccctcgtttgtattagaagggaatcgcccatgcagagcccatagttagagacggcacctcctggggcacgtgtgtcgccattcattcactcaagtcgcatttattaagcacctgctgagtgccaggcgctgcttcgcacagggaacaccaaaacgactgggcactgtccctcccacttaggacacaacgtaggatgggagatagatttgtaaacaaatacatgtatggatgtaattagcgctgcaatggttatatgtaccaaatgtgagagacttaaaagcgtgtgtcttggggagagtaaggaacgactttataaagaaatgtgcaaacgagatctgactgatgagtgggagtgtgcctggcaggtggaaaaaagtctaacgttctaggtggagtatattgcctgtgcataagtaccaacgtgcgaggcagcatttagggcacaggaatctgtgggacccacccgggagccctggtagagtgcgagccgccacagagacgaaaacgaagggccctgcttactgatggtaacgatcgcatggtctggtggggagaccaaggcatacacaagtaatattaataattacagaatcacctaagagcaatgataggaggttcacggggttttatcacagctgggagaggtgaggcgcagagttcctgagggcactttttaaaccacctgagccgcaattataatttggttaagtaagagttgtaattaggtaccatggttttacccccaaaagatggtaaataggaatggtgagagtaaagggacttgagcatgttgtgtatatagggggagaggagcctccggagaggctgaaggtaaaatgagtggaataagattgggcgcggtggctcacacctgtgatcccagcactttgagaggctgtggtgggaggatggcttgcttccagcagttcgagaccagactgggcaatatcgtgaaatctggtctttacaaaaaaattaaaaaaaaattagtgaagtccggtggcgcatgcccgtggtcccacggacccagctgcccggaggctgagatggcaggattgcttgagtcctggaggcgaaggttgcagtgagccatcatcgcacaactgcactccagcctgggtgtcagagcgagactttgtctcaaaaatgaggacatgggaaggaatggattttcagagcattgatgggatggagagactcttagaggttagggaagaatttttgagagacaggacaggagtcacgggcacggaaaggagtttccagcctgattgtctcctttcctttgtgaaacaaacagatttatcaggaataaggtaggaagcttgtaaagacagccttgggagtggggcctgtaaacatggctgagcagtggtgcaggcccacctgtgtttggagaccatctccttttattggttcctcagtacagtgttctgcccaggtgtagagaagggaaacacttataattggattttatacacacatgcatgccgtcagtagcaaaagatgacatttttggaagcttgttcccaaagagaagataattttatgtatatgtagatttagatactctgaatcactaaacccaggacacattctggatttaaaaattagtgtagatgtattatgtatttgggtttttcaagagtagctgacttaaatcaattagaggattgtacgtagatcgttaagagtttttgtttcacttagaccgtcaggagagtaggttattttagcctttgcttaaaaatattttgttgctcttgttaatggtatttagtagatgatatgttggtggtaatgcatgtctcttgacttgggaatgcatatgaaatctctttttttccgggagttgggagctggtcatcactggcattgtcccttttatattgcaaaaacatactcatcattgcttgatagtctgttccagttcccttttcactagatataattgataattgttttactcagatattgctgtgctttaggtcaaggggtccccaacccctggtccacagaccggtactggaactgggccacactacaggaggtgagtggctgagtgagtgagcaaagcctcatctgtatttacagctcctccccattgcttgcattaccacctgagccacctcctgtcagatcagccacggcattagattctcataggagcgtgaaccctattgtgaactgcacaagtgagggttctagtttgcagacaccttatgagaatctaatgcttgatgatctgtcactgtttcccctctcccccagataggaccatctagttgcaggaaaacaagctcagggctcccattgattctacgttatggtgagttgtaaaattatttcatgatatatgacagtgtaataatagaaataaagtacaccgtaaatgtaatgtgcttgaatcaccccaaagccctccccgacccttggcacttcatttaacttctctgagcctcagcttttgttttggttaaatatggattgtatttacgtactgaggttttacttataagagtattctgcaggattcgatgttggcaggactttgacctccttgcaaaagagctgtcctgaccgttgtttacgactggttgtaatacttggtgataaagatgaaggcagttcatatgtcttgactgcagaattctagaaatctttcactagagttgcctctgtgtccttccaactaccattgttttgaccttggtggagactgttagttggctttcattttcttggaagatcaaactcactgacaggcacttctaagtgaaatattccatcccatttgcctttttcttatagccttgtttaagaaggagcaaatcagcagacaaagcaaactcctcaaattctggactgtcttcacctgctagtgtatcctgcttaaattcctgccaggattaggtctatagtcagtgatatggtttggctgtgtccccacccaaatctcaacttgaattgtatctcccagaattcccacgtgttgtgggagggatccagggggaggtaattgaatcatgggggctggtctttcctatgctattctcatgatagtgaataagtcttacaagatctgatgggcttatcaggggtttccgcttttgctccttcctcattttcccttgctgccgccatgcaagaagtgccttttgcctcctgccatgattctgaggcctccccagccatgtggaactgtaagtccaattaaacctcgttttcttcccagtctcgggtatgtctttatcagctgcatgaaaataacctaatatagtaagttagtaccagtagagtggggcgttgctgaaaagatacctgaaaatgtggaaatgactttggaactggggaacaggtagagattggaatagtttgaagggctcagaagacaggaaaatgtgggaaagtttggaacttcctagagacttgttgaatggctttcccaaaatgctgacagcaatatggacaataaaatccaggctgaggtggtctcagatggagatgaggaagttgttgggaactggagcaaagatgacccttgttatgttttggcaaagagaactggtggcattttgcccctgccctagagatttgtggaactttgaacttgagggagatgagttagggtatctggcagaaaaaatttctaagcagtaaagcattcaggaggtaacttgggtgctattaaacgtattcagttttataagggaagcagagcataaaagtttggaaaatttgcagcctgactatgcgatagaaaaaaaaaaaacccattttctggggagaaattcaagctagctgcagaaatttgcgtaagtagcaaggaccctaatgttaatccccacgaccatggggaaaatgtctccaggccatgtcagagaccttcatggcagctcctcccatcacaggcctggaggcccaaaaaggaacaagtggtttcgtgagctgggcctagggtctgcctgctgtatgcggcctagggacttggtgccctgtgtaccagctgctccagctgtggctgaaaggggcgagagtacagctcaggctgtggcttcagagggtgcaagccccaagccttggcagcttccatgtggtgttgagcccacaggtgcacagaagtcaagaattgaggtttgggaacctccttctagattcagaagatgtatggaaatgcctggatgcccaggcaaaagtttgttgcaggggcagggccctcatggagaacctctgctagggcagtgtggaagggaaatgtggggttggagcccccacacagagtccctactggggcactgcctagtggggttgtgagaagagggccgctgtccatgagtttatcaggggtttctgcttttgcatcttcctccttttctcttgctgccaccatgtaagaagtgccttttgtctcccaccatgattctgaggcctcctcagccatgtggaactgtaagtccaattaaacctctttttcgtcccagtcttgggtatgtctttatcagctgcatgaaaatggactatacagtcattcagtgtttggaaatttcttatccaggaaggtatgagccagaaacccagcaagtttagtagtccacagaaacccagcaaatttagtagtccacagacattgcctctaattctacttcactggcattagaggagatattccaacagagaggagaataggaatggactgtgcatatgggagctttgctgggtagatgagttagttctctagagctttttgggttcacatttttattaaggctaattttattttttattttatttatatatttttagagacagggtcttgctctgtctcccaggctggagtacagtggtgccatcatagctcactacagccttgagctcctgggcttaagcagtcctcctgccttaccctccaaaagtagctgggactgcggcacatgccacaggcctggccaattttttttttttttttttttttgtagagatgtggggctcccttttgttgcccaggctggtcttgaactcctggcttcaagcaatcctcccactttggcttcccaaaatgctgggattacaggcatgagccaccaggcccatccctaacgtgcattttaaagccaaacatcatttgggatgttatgcttttagccgttgcagtcctattgcttctttttagcgcccaatccctatttgttaactatgttatgtctgtattttaaaattttcattcttgggcttaatacctaggtgatgggttgataggtgcagcaaatcaccatggcacatgtttgcctgtgtaacaaacctgcacatcctgcccatgtaccccggaacttaaaaaaaaaattcattcttatgtttatgccccagccaggattgtttttgtatcctagtgtcttacacacttggaaagaaagcctattgcttattcacaattagatacctaataaacattttagggtgtttttttctacatgacatctttgtgtatacctctagctagtaagtagcttgtatgtttagtgtttgattttacgtatcccaattagatttcaagtcacttgtatctctgaactttagtttttcataaaacatcatgttttattgtgctgattattactttggtattgaaacctgaattttggttgtgaaatttgagtttggtgttcttatctggtgtggtttgggactctcttcaatacacctcatttgaattaatgcttagagtaatggagctggaaggagtatctgcttcttgtccaggtctctcatttatagaagggcagaggatacctagggaggttaaggggcctggccaatgactcgttatttgaagaaggatggagatgagagtttgtttccctagtctcagtcaaatgcccttaccatttgaccctcttgcctccctgtaatgctgttgggtaataaggtcaggtaactgcattggatagagcctgggtgtgttttattgtgaactccctctctttctcctttttgttgtatctgccttagtgcttagcttctttattacaaattagatattaaatcctgttctcacattgagagcgaattctttctccagaaaggataacaaaccttttgtttgagagagatttttcactttttgaaatggtctgtttgtttgaagttacagaagaaaaataagtgtaatgcacagttgtatttattattcatgtgaccctggaaacatttcttccccgccctgtgtttcagtttcttcatctgtaaaatgaggttaataatggttcccccttctaatgttgtttttgaagattacatgagttaatacatgtaaattgcttagaacagtgcctagcacctaatataatggaagtgttgcctactgcctattggcagttttctgtacggcttcaccttcccttaggacttcttgtcagcccagttatgtgatttttcacctcgtttttgtttaggagactctactttgttgatgtttttctgagaaacaatgtgctgtctgtttttctctgtttcctttgacatttgctgttcatctttcactgaatatttgtttaagaaagacatacagaatgttaattttcattgattgtagctttcttctttttaaggatttggaatgccctgacagataattatgggaatgtgatgcctgtagactggaagtcatcgcatactaggaccttgcacttgcttactctgaacctctcagaaaaaggggtaagttaggaattgaaccaatagtgtttgaataactgatgctgataatagaactaaaacagtagcatttctgcttaacacagattcactgacctgcctctcatttctgaaattatagcagtttgggtggctctgtcttgatgtcttggctgtagggccatcaccttgctggcacattcctccagttcttctccagcacactcattttttatgtgtagctaaatttccatcacaatttttttttttttgacggagtctcactctgttgcccaggctggagtacagtggcttactacaacctctgcctcctgggttcaagcgattctcccacctcaaactcccgagtagctgggattacaggcatgagccaccagtcccggctaatttttgtattttcagtagagacagggtttcgctgtgttggccaggctggtctcgaactcctgacctcaggtaattcacctcccagagtgctgggattacaggtgtgagccactgcacctggcagtgatgatgcactgaaacactcagtaaaatttggtgcactgaaaccctcagtaaaaatgctagcctttggtttaatatactgagagtattggaatctcaacacggagttaactttttaatgagtgtagtgacctgctagacatgatatgttgtcaggagactgtgtattcctgtgaatactggagaacctttaaaagatattttagttcttggcttttaaaatacggtcttggctaacttacctttcttggggtctcctgtgtacatcctggtattgtaaagtgaagatgtcttgactaagaagtgtgagcacgagtggtgggacaggtagggaggcagaaaagggttgagaattacttgaaatggaaaatcacagtgttaagcttttttaaatctgatgagaaacatatccaaattatctaagtttcagggcctggctgtttaagttccttatcaaataataatgtaaactcatgccagatcttcttgcgtgctctatatttcattaagtgtaattatgtgattattgagaatatagtgcagtaggcctgtcactattttacatagtattgttaatgttttgttaaaaggattttcttacatatgtgatcagaaaagcctactgttattattttctagtaaaatgtagaattctggctgtatttcccagtattcagtagctatggaaatcttcctgactgtgccagtcattaatcccattaagctttgcagactgacctggcatatatttaatgaaaaggaataaaatgagggatcttttgctctgtcttgtttacttaggtcctggctatcattttgggcttagttcaagtttcccttcctctctgaagcttcctattactgttttagcctttgctgatctcatggaattatacaattttagagttggaaggggctttaaaggacacttaatccagcctctcacttggggggaatcctcacctccagcatctctgacagatggtcatttagccatggcctaaattcctgcacggaaggaaaacacactcccctctaggggaactgatggcacttgtggggttgtgaactttgaaaggacttgttatctgtgccacggggtttagccttgctgtctcatgggtgctagtccccagatcactttgtccctgtctctaaaattaccactgccttctcttgttaatcatatgtttctgggtctgtcactagattgtgacttcccggcaggtatttgtatttgtctttatagtaactatactgttcctggcacatagtaagtatgaagatacctttttattgagtgaataagtgaatagccttgtcagtgaaactgtagggccagagatcgtgatagaaaggttttaaaaaaatattttctatgttatttaaaataatgcagaatgcaccaaaaccagtccatgggtactacttttttgacatattaaaaaatagcatagaagagtttccattcatagtttcaaagtcaggcccattagcagcgtgagtgagacagtttaatccaatttcattgactaaatgtacagcgggcccaccatattctctggtttcacatctgctgctttagccaactgtggattaaaaaacttgaaaaaaaaaccccacaataaaataacaacacaacaattgaaaataatgaaaataaaaaaccgaaaaccgatacaatataactttataatataaatattgtatagttatatacaatataactataaaccatttaccttgtattaggtattataagtaatttacatataatttaaagcttatagggggatgtgcacaggttatatgcaaatactaccccactttatataagggacttgagcatctgcagattttgctattggggtgtcctggaacaaatttcccttggataccgagggactgctgtatgtcttgtattgttcttagattgcatcttgggaggttgctcccttttgctgccttttgaatgttattttcaatgccacggtaatgatatggccaaggcagtgattagtaatgacgtagagtttaatgctagtactgacattaaaaagccttacctggctgggcgcggtggctcatgcctgtaatcccagcactttgggaggctgaggtggatggatcacctaaggtcaggagtttgagaccagccttaccaacacggtgaaaccccgtctctactaaaaatacaaaattagccaggcgtggtggcgcatgcctgtaatcccagatacttgggaggctgaggcaggagaattgcttgaacctgggaggcagaggttgcagtgcgccgagatcacgccactgcactccagcctgggtgacagagcgagactctgtctcaaaaaataaaaaaaaaaacagccttacctggaaaaactcagcagatgaaagtgaacacgtgatcattcacctatcatctctctgttgtgacatgactattctggtgatgaatagaattgaaatcagaactctgtttctcagggaggattagcacacactgagtttctgaaaaacaaatgggcaataaggactatgtaagaagtcatcacgtcattctattacatggtatataattaagcattttttttttaatctggcaaagtgactgtatttaccattgccacctggtgctctgttcgtgccgtgactaagctatgtaaaatttaccctttgaaagcattctttagattattttacttataaaaccaagtgtatagaaattttttttgacaaaagaagaatggtttttgcattaaaaagagaaaaacattcaggaaaactagtttgctagattgcagttttaaatttttctttgattgaagattaagatggcacacttctaaatttgatatgtcttttttagagtaaggcaactggtatctttcaaattcttacgtgggcacattttttccatttgatgtatcttcagttttatacagggaaacagtaccaccaggtctgtatctaaccctggcattggaaggagtgatgggaatgcttggcaaagagaaggcacatttaatgctgaagggaggagtgaataatgatacccatgacagccagggctagtttgcaaagcctgaaagatattccagctcttagcatatgccatctctgtggggaatggacttggctctctctctggaaagatgatctgggatcatttctgttgtcatggaaatttattataatagtttactgttattactcatgtgttttggccataaccctattctaaatctggtgccattcttgaatatacttatatgatagaatgcttatcattcatttcagcttaagaacatcttctgtgctgtatttctccttccatgtgcatttctttcaggacagggacttttgtatgcatctttatacctttaagagtagaaataagaaaaagataatgtcttccacagaagcaatttgattgattgatagattgagagagtgtctccctctgttgcccaggctggagtacagtggcgccatcatagcttactgcagcctccaactcctgggcttaagcgatcttcccgctccagcttcctgagtagctagactacacacgagtaccgccatgcctggctaattttaagaaaatatatttctgtagagacgaggtcttcctgtgttgctcagggtggtcttgatgtcctgacctcaggagatcctcccaccttggcctcccaaagtgttgggattacaggtgtgagccatggcaacctgggcttccttaggagtaatttttttttttttttttgagacatggtctggctctgttgtccaggctggagcgcagtggcaccatcttggctcactgcaacctccacctcctgggctcaagtgatcctcccacctcagcctcctgaatagctgggactacaggcatgtgccatcatgcctggctaattttttgtagcaatggggtttcaccatgtttcccaggctgttctcaaactcctgagctcaagcaatccacccgcctcagcctcccacagtgctgggattacaggcatgagccactgtgcccaccccggattaattttaaaattaaaacttttagtatttataagccagaaggggaaaaataaaacaaaatcatggtcctcaagttgcaacataggaagagtgattgggaagggggtgtgaagtgttcgaagtgtaaggatcgatgaaactaatcggtaggtctactccatggtatcgacatgcctttgtgatcacagtgtgccacattttcatcttctacagtatagaaatcatacatcccctctcatcaagagcctagtctcttgatctttctccttctttaaaaaattaaattattaaaggaacagctgtcatagtttaaaaagtaaattagaactataggacttaaatgaaaaggcagtctctgctccacttgatttctccttaccagaggtggccactttaaatgatatcagctatttcttttagcagataacatgctcatgccattttacttgatattattttctcaattttagactttatttattttctacccagagggtgaaggtttagctctcttctgtcctttgccaatccctgacactataccctcccaaaaacttccctttccccatcttcccaatgtaattacataacatctggggttgaattaatcttcatcatttatatttactatttaaatgtgcacagttgacccattatgatatattatgtttacattttctctttttctacttaggttttttcttaggatactacctgcctttttgtggtttatttagtttataattagctgaccagttcagcctcaatagagccgtagaactcattttagtaaatggaccgcactaggtaatctatctagtccttctgctctccctccccacccacctctccctcttctccatgctctctgcaataaaaattctaatctgaatgttactctctagtgtagctttacagtcatcattctgggattttcactttactatcattacgagaattctctttgtcacttgttattagaccacatatcttttttctttttcattttcctcctggtagctttttgagaaagggcacatgagaggtaaattttttcagaacttgtatgtctgaaaatgtctttatcctagcccctgcctacttgttttagctggatataggattctaggatggaatttctccaaacatggaagttacatcgattattttctagcatctattgttgctattgagaattcacttgacattttgattcctgatccttttaatgtgatttttttttccctccctggaagcttttagattctccttttttccacacagtgttcttagttcatgatgctgtgttgaaggtcatggccaggcctttgctaggctgatggtgcagtaagaaataaaatgagaagggctgtcgtcactgcgcaggagcctggagttgcattatagggttgtaggtggaccgtgcagtgttgatggggcccttctcccagcctaatgttggaaagtcagtgtgccagtgcttcttcccttggcccttctcacgtgcaggtttcttactctgtaggctgtgttcacctgcaaacttcagatgctcatgttatgaagaactagggaagcagtaggaacctacatccattccattgtgtcctcagctttagacatatatcctctgcatggataaataattttgccaggtaaaattttatcatgttagttctacactatgtaatagaatgacatggtggcttcttacgtaatccttgttgcccatttattctttggaaactcagtgtgtgctaatccttcctgaggaatagagttctagtttcagttccattcaacacctgaatagtcatgtcatgacagataggtagatgatagacagatgttcccttgttcattttaatctgctgagttttttcaggcaaagtttttacaatcagtactggtactaaactctaaggctgtttatattggtgtgggcagggttaagggaaacaaacttgatgtggtgcaatcccccagggctggcaacagaaactggtactttagcagtcctgggcatgaagaggtaaggagagggagaaattaccataaactgttgagattggccttgtgggagaagtctgctaatcagagctatggctttggtgaagagccatagtcaacaaatgacagtctgacagggaggaagacagcaaaatacatgcccagccttcaccatcccaccttgcagtctgccagtgtctgccaatggggtttaacccacctggaagccagacagcaagggcatcctttgatgtcttccataaaggtcgtcctcctggagcgcagagcagggtggaagatggtgaggaggtgagtggtgaatcaccagcttagttaggtttaaagatgtttttggaacctagggttattattttttgttaagaaggaatgtgcaattggaagggctaagtgtgacgctcatggacagatcccgcctttcagggagttgatcatcttttactcagatattagaagttagtttgcaagtaactaacttttatgttttctttagaatgttaacgtctaccaatcttagtgtgtgttgctaaccctgcccatattctcccttctattcactgtaattccctatgacttgctaatgaataccgtatttttttctgcatatctgtcagcttttatagcagtcttatgcagcatctcagtgatttcatatttattctacattcttctcatttctgttcaagatgaatatatactcattgcctggtacagagtgattgtaataatttctccctcttgagggaaggctcttagtagttgcttttctctgcagcctcttttactcagagctgttaactttgttttgatgaggatgtcctgcttttaatgatgggtatttttgtttttaggtaagtgacagtttgctctttgatacatcagatgatgaagagctgagagaacagctggatatgcactcaatcatcgtctcctgtgttaatgatgaacccctcttcacggcagaccaggtatagaggagatcctcagcaacgcaaggaaaggagactctagagctgaaaaacggcttcttgttatgacagtaaatgatggctgttggtttacttatctttcctatttttttctggttatacaggcttaatagttaactcttccacagagaaaaataagtatttgtgatctgaagcagaagggattatgttagttgggaaggtttccaacagaggccttgttgaagattatagcaaggtaccaaggaaaggttgttgcttaaccccaaaccagaaaaatattgtgaatttccttgtttctttagatttacccaaacacggacaaactgtaaagtatctgtgtagaaattatttagtatcttcaaaaccctgggtaaaaagcattagcatgtattaaagtaacatattgtgtgccccagaaagaagtgagcattattcccgtggaatgcgctaataaggtcaaccctgtattcacttaaaaccagtcgaatcagctttctcattttctgaatactcttcccacctctgttgtattgttgaaatgtgatgccagaacttcttcctgaaataaaatgttccatggctactcggactgtgagttctaccacactctatttttaggctggaaagatgagatcagtaaggagatacattatggcaagcttgggaggagtacattaaaaatttacattaaaattgtgttatttggatcctccttagtcatatttgtggttgaattgttctaggcgtgggaagaatgtggtgcttaaaaaagcaaggtaatagtaggttggaaggttgttttgaggtagagggtaatctagggatagacatgaccttgagaattcattgtcccctcactgacctgcctaataccgtaaactctccctttttttaagagttagaataacagattctgtaggatccttgagtggctcattgtaccttattatatttcctgttttggagactcttcttataattaacataatcccatctgcttcagatttgcctttgtttttccttggtggaaatcttacctgttaagcttgttaattcataaagcatggaaatatgctcatgatgtcttactccttcatttaattgtgtttaatttttttttttaactttaggtccttttttctaactattgagtaattttcctgggtttcctttacattttcgctgagttctatatccttctcaacttttagaatctggaaaagggcaagatactgttgtaagatttgagcagcactgcactagacagtagatcattgtttaaagtcaaatgtatttctgaagtttttctgcttttcacagcatttttctctttggacttctactttttgagtaatttaaaaaatccctttttttcgttgaattaatatataaaattatttttctgctgttgaaagaatattttgctgtcatagaggtaatttcccatttatatatactttttttgtgctattgtattttataaattttatgtcagaatttttgatgagatacctttaaattgagcacttgtatgtctatggtaaattttctgttatttgctttcttctaacgattactgtatgatctagctctggtgtgtctgaagtaaattattatgtgtttgtagcacgattacctagactttgcaagacatgttagggccttctgaatcatgatggacgtagtaaatccaattctatttaggtttgtgtttagtatattgtaattttttcttgataaaccatgttcactcctacagtcaaaattttgattatttggagcatccacacctgaacaccattggttaatggagaattcagtgcatttctgctctgggtgccttaggtgagcactgtgttccagatagatcattttccttttgtatatttgattaacagtggtgtgtgtgttttcgaaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagtaagggagcctgctgaaatcaatgatttctgtgctttttgtctgtatcaaatgtatagtatgatcatctccagaaagctttgatttcatcctccttctgtttgtgtttgtgtccaaatttacatttttgttgttgttgttgagacgggatttcactttttggcccaagctggaatgaagtggcatgatttcagctcactgcaacctgtgcctcccgggttcaagcaattctgcctcagcctcccaagtagctaggattacaggtgcccgccaccacgcctggctaatttttacatttttagtagagacggggtttcgtcatgttggccaggctggtctcgaactcctgacctcatgatccgcccgccttagcctcccaaagtgctgcagttacaggcgtgagccaccattgcctggccccaaatttcctcttacaaggacagcaatcatattggattagggtctatcctaatgaccttattttaatgtaattacctctttaaagaccatatactgtaacattctgaggtacttggggttaggacttcaacacatgaattttggggaggacacaattgagtctataagaaaccccatcatatttgaagtgtagaatagatattcagtaattatttgtcaaatgcaattcctgtttgtacaaatagtcttgtgtgttactatgaagaattttgggaaccatggatctgtttgacatatgtgagaataatgaactctagaaactctacagttgattttcatgaaaaatgtctgaataaatataaccagcctgtgaacagcctgaggctggttggaaggtgtgtatctaatcattgccatatgactggtcccttccttgaataggcactgatggggtctgtatctgctcaactcgtgttgtcacctagttttatctttatggcatgcccagtccaaagcttagttacctaaagacctttgggttgtatggcttcaacatacagatggtcagacagaccaaattctttcagatggtctgatttggccatgttcctgtaggtatgggctaaacagtgttaacgtcctgactcccaaatacagtcctgatacctgatacagatactaaaatctgtattggtttgctagggctgccagaacaaagtaccacagagtgggtggcttaaacaacaggaatttatattctatagttctggaggccagaagtctgagatgaaggtgttggcaggtttggtttttttcagaggcctctctccttgacatgcagatggctgccttttccctatgtcttcacgtggtcttcctactgtgtcctgatcaccctattttataagaataccagtcatgttgggttagggcctatcctgatgccctcatttaaccttaatttacctctttaaagaccccctctccacattctgaggccctgtgggttgggactttaacagtgtcctatctgtcacaaggggcagaagtgctgagaaaagactgaaatggggtttcagggaatattgttcccttttgtcttcccagtttttttagtccattcttgcactgctataaaatgcctgaaactgggtaatttatacgaaaagaggtttaattggctaatggttccacaggctatacaggaagcctggtagcatctgcttctgggggggcctcagggagcttttactcatggtgggaggcagagctggagcaggtatcttcacatggctggagcaggaggaagggggctggggggagtgccacacacttttaaacaaccaggtctcataagaactctgtcatgagaacagcaccagggggatggtactaaactgttagaaattgccctcatgatccagtgacctcccaccaagccccacctccagcatcacatttctgtatgagatttgggtggggacacagatacaaaccatatcaccaatttcaacaaaattcacagatcaggacttatgtaattaagtgtatatttagtttaattctttcagatcaactcctttcctgttcagagatatcccagaaccctgctgaacggcttgcagttttttgtcagcaggtggattctgtactttccctcgacttttgtgtttgttcttttccgtgtacaagccttcacagtcttgactgaagtattattcatgcaatgatttatttgcacaagtaaaaacttttgttagactttcttgccagcaagctgagaagtgactcacctgcccacttacctctactcagatctgatctccagaagttgtagaattctgagaagatcacccacagtcaatttaattgcttggaatatgatttttgctctttggcattgattacataggtgtttatttagtcattcctagtgactactctgttttgcttccttgaaatgtttttgtcttaatatctgctgtattttgcttttggtcacaggagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacagtaagtgatgttttgcaggaggcgtcgaacactggaaacaggttctgtggtagtcccagcctttggggctggtggcaggtgcgacaggttgtacatgggcaggagtgttaacacttctaatcagagcccagtgggattttattccagaataccgctgtgctcagcttcttcagaaagtcgttttcttgactagggtgtactggttatctgaataatactgaaatgtttagcaaggatgtaagtggaaggaagagggggcaaaaaaggagaatgtcttgaagaaaagaagctttagcaagtgaacatttttaccacatcaaaatgtgaagagtggttatgtatatttggctagtagtttttttcttatttttgctgaactcttacgagttgtgtgataagaaattagaaggggtttatttagaggtatcagaactctgctcaaggcacaaattgtttgtaaacaggttcctcctgatttttcagtgaggttggaatacaagaaggtaagtgacatcagccatgtggcctagtatttggcagactagactatttctgactggtgaaaacaagtttagaacatctgaaacgctgaccctttgataagatttttttgtgttgaagtcttgtgtattcccaccttgattttgtttgtgtgtgaagaaatgttggttttatttttagagtatgatggttgggtaaagggatctctttttctaaatgggacatctctttttaatttgtgatatcaataacatggtcttacaaatcacaaactagctattatggcttgcaataatatgagttctgtttttgataaagtctgatttacttatctaaagaatacttagcagagaaatagatctcattaagcagatgctgatggaatcctggaaatacagttctaggatggtgggccaccaatgagcagttaacacaaaaagagtcttaccatatagctcatttattatgctgtaattagcctatgaataaatccatttttttcagtgtaatgttcatttgtatctattttgaaaggacatcgtggctgggcacggtggctcgcgcctgtaatcccagcactttgggaggccgaggtgggctgatcacctgaggtcaggagttcgagaccagcctcaacatggagaaaccccgtctctactaaaaatataaaattagccgggtgtggtgctgcatgcctgtaattccagctactctggaggctgaggcaggagaattgcttgaacccaggaggcggagattgcggtgagccaagatcgtgccattgccctccagcctgggcaacaaaagcgaaactccatctcaaaaaaaaaaaaaggacattgcttatgcactgactttgaaaaaagttctcaggtatctattatttttaagaaatggcagtattgattgaataggtgtttatttagttattcctagtgagtactctgaaaaaaacccaaaaccaacccacatttgtttgaatatacaatcctagaaaatttgctttaaaatattagggacactattttgcatttgcatctcatatttttagaactggcaccctttaaattgccctgttatgcaagtgagattaaataaaatgcttagttaaaaagtcatagcatggttggtaatttctgcctatttgcttttagggattacatgtaaatcctccatttattgctgttaacacttggctgagaaaagtaaatttatccctagaggggtttaaaggcttcgttttgtaactcccatgtaaaaagggttagagtaaatctattgtgtaattttacatggcatttatattgagaaatggatttggcaaggcaacagttaggtcttacttcagccttcattggtcttgaaatagattcatagtaacagtaaatatttttcataatatttgaacttttgaagttgcattttgcctgatttacaatttgtgtcaaaaattttaatcagttcagtaatggcacggctaagcttgcagtactagtttcctgtatccttttaaagcctaaaatgcggccgggcgcggtggctcacgcctgtaatcccagcactttgggaggccaaggtgggcggatcacctgacgtcaggagttcaagaccagcctggccaacatggtgaaactccgtttctactaaaaaatacaaaaattagttgggcgtggtggcgcatgcctgtaatcccagctactcgggaggctgaggcatgagaatcgcttgaacccaggaggcggaggttgcagcgagccaagattgctccactgtactccagcccgggcaacagaacgaggctctgtctcaaaaaaaaaaaataaaaagcctaaaatgccagggaaagaccttcctatctgtgacacaagtaggctggaagggtgattctgaaaatagtggtaggttgctcaaaagaaacccaaagtgaaataggcagttggataaacagattccaggagcttgccaaacattttaccaagcattttatatcacatgcagtcttggcaagacctggtctctatgagtttgctattatcagtgatactaattcctaaaaaatggtgacctccttagaattgtcatatgttacctgtttttccaataacataagtcacttttttttttctcctgcctgagatatttttgttttattagcaggacttgaagtttttcgttaagtatagaatagcttccatttttcttcatgtatgtttcactgaagcagtacatcaatttgtagttggcataccacttaatctaaaattgttaccttgttctctttggtccaaagatactctaatgaaatattggagtgggtatagagcagagttaaacttggagacagattttgttttaaatatttgttgtggtgaaaaaaaaaatagagggcatagggatgctatttagagcattggaaaatttcattagaccatgaaaatatgtgaaatgttacagaaagtattatcttataaaagtgaaatatgattttgattggagttttaggtttaaaataaccataatgctgtatgttgggtaagatgaaacaatattcattcattcagcaaggatttgtggagtgctttcctgtggcaggtgttcttcaagatacagtgggcaggatgactcatgatggtaattctaggactttgagaggctgaggtgggaggattccttgagcccaggagtttgaggccagactgggcaatatagtgagaccttgtctttacaaaataaaaattataaaattagccaggtgtggtggcatgcacctgtagtcccaactacttgggagtctgaggcgagaggattgcttgagcccaggaggttgaggctgcagtgggccatggtcacaccactccacttacagcccgaccttgtctcaaacaaaaaacagaaaaaccacagtggcgaatagaatagaatagatgaggcccatcccatgccttcctggagcttatagtctaatgacggagaaaggcaataaacaaggaaaaaatgaatagatgatggaattttagtagtaaataaaggccatgaagaaaaccaaaggctgggtgaggtggtagatggtgatgctgttgggaagctgttttggagagtgtcactacaccactgcttctcctcattgacaagggagcctgcctagtccctttccaattctccgtttgaagaggaggttaaaggagtggacctctttgggaagtgcaactcaagagagtggcaggctttatatttcctctgtccttttttgcagcatctggaggagcagaggatggggggttagagagtggttaaagggcactgtctgtttatcactatggtgacctacatgtatttctttgtgctgaccatgctgttttgggtgacacttctttatattcaatgctcttcttctggaatcaaattccttacctgctgcttctgtccacttgggggattttttttttttctcactcatcctttaaaatcatggccaagcattgtcttcctttcttagaaccttccttgatgactctgtccgatgcagagttgactactctctctttttagaggggttagtgttactcctctttagtatttctattatcactgttgtatcatactgcaattttttgttttcatgcctatctctgttttatgtccctaatgataagaaatttaactttactttctcggtattcgtagatccaaccttaggtacctaataaatttctgctgaatgaatgagtgaacgaaagataaacttgcaaatatatatttctatattggatctttctgccaggtgtcaaacccatggacagtgaatattgtctaagacaatagaatattgactaagagctttgggttaagagctgtgtttgaatcttcgtcctacatacagacggctttgaattttggagagattaaatgaaataatgtatataagattagcaaacatagcaaacaccatgagtaaatgctaattgttatatatgtccaactgcctactagacaattccctttggatatcttgtaggagtctgaaatttatactattaaaccaaagttaccattttcctaaaattgaattattttcttttggttagcaaaactagtttatccactcactgaaaccgatagaatttccaagtcaaagaatatagagttttaaatggctttaaatgaccagcttttcaaattattgtgtagaagtgtagcccagtagagcgtaagagtgaccattttcccacacctcccgccaacaggagatattaagagcttttgaatatacactgcacaggcaaacaatgggtttgatctgttgaccatttgtattcttttatgagttgcctattatgtttatatgcctgttatgaggtgttttcatatttatttgtgagggtacacatacttgtgatattgaagtaccacactgtgttgtaatcattggcttaaacctctcttctaacagagtgcaagctctttaaaggctcattcacactgctttcccagcacctcacctaatttcttgttcttcgcacatcacttaatgcatgtttgttgaattgaaacttcagtgtacaggagattgaatcccggaggatttagatttgtagtatttgaattattattgttctattggggatttttattgggggagccaggcttctgttacatcagacattcacaggtcattgaatttcagtagcagttctcatgaatacaagaataggttgaacaacaccaggttatgttgtaatttagtagttgctgttcatctagtgttatctgcagttgtctgggcattatggcctacctgcttagcatcataacttagtaaacttatatgtatgaaaatggaatagttaccctctgagtatctagtaacaaatctttgaattgaatgtcacatgtaaggttgtttatgctaagtcttgttgagaagataggaatcgatagtcttttctgtttgccataatgacattgaactttgaagagagaatttctactgtgttacactccaccatcaaaaatgcataactgcgtcagtcaaccctgaaaaagtttatacggacaacttttgggatattagcaatcagtgactaacggtagtagagaaaagaaaaaactgtaaaaagaatcacattaccctaatttattgcttttcgggggttagggagagaattgctgaaggatgggggagagctagggcttagatgatatacactctttcttgtatatattttctttcacagctacattgctccgtttctgtgactcagctcatgttataatatgattgatagcctttgtttggggcttctgtttaaaacaacatggacctggctttttccccccttctttttaatttggaatttttttaacagcacatttgctcagatgatttaaaccagggattgtcaaggcagactactgtccaagggctaaatcaactcttcacctgttttatgaatacagttttactggaacacagctatgttcattcatttatatatcatctgtagcagctttggggctatatggacagagttgagtggttgccgtagagactgtgtggcttacaaagcctaaaataattaatgcctggctcttgacagaaaaagtttgccaatctctgatttagacttagtaaaattaaaaagtagaacaaaaagttatgaactccagttaagtgagtttgcatagataaaaagagtactgtaatgtttctaaagtttgtatttaaaaggttactttgttttatcttgagattatgttgaattgttccttttcttggggccccttcagcagcagcctgagtgatagtgacaccttggccagccaatctccaagctacgtgtggcagcttcttgtctaacagcagacctctgtgctgtgtgtgtctgaatcccggtggctaggtaaagagagtgagcaggtagaccagtgttctctaaatatggagacaaacaaaaggaataaaaatgttgtattatacacagtgataaaatgtggttttaaaagaaggttagaggagaagtggaaaaggcatgagtttttttcccctttatctttttttttttttttttttttttttttcctgagacggagtctcactcagccgctcatgctggagtgcaggggcgcgatctcggctcactgcaacctccgcatccccggttccagcgattctcctgcctcagcctcccgagtagctgggattacaagtgtggtccaccccgcccggctaacttttgtatttttttttttttcagtagaggtggggtttcaccatgttggccaggcttgtcttgaactcctgatctcaggtgatccacctgccctggactcccaaagtgctgggattacaggagtgagccacagtgcccagcctttttcccctttatctaagcagtggtgcttgagatactaaattctacctgacatacattctttttttttgagacagggtcttgctctattgcccaggctggagtgcagtggtgccatctgggcccactgcagcctctacctcctgggttcaagcggttctcctgcctcagcctcctgagtagctgggatgacggcgcccgccagcacactcggctaattttttttagtagagatggggtttcaccaagttggccaggatggtcttgaactactggcctcaagcgatccgcccacctcggcctcccaaagtgctgggattacaggcgtgagcaaccgtgcccggctctgatacgcattcttgaatgtaaatattgacacattttaacaataatttgttggtgatatttgatagtatcttgctgcattttctttagtgcaaagcatttactaagaattactattagcatgatagaaggtcattgtagggtggagaaaaacttgactatataatggctattattttaataattcaaacctatgaattatgaattactttagatgtggaacaaatttgttttatgaaaaataatattacctagagaaatatatgtcatcatcagttttcgatatgtttttatcatctacactttgttttctgcaatggtttttggtggtaggctggtaatagtgaactttcatgatccatcagttaatgtagtaaaaatcaggagtccattcttgacttctttatgtgttagagaggtcattgttaatataaacaagttcacataaaagctgtaatgtgccaggaaattgtgttcttcttgtatacagtcttgtgccacatagtgatatttcggtcagtcatggactgcgtatagatagatgatggagtcaggattataatgctgtatttttactgtactttttctatgtttatctatatttagatacacaaatacttaccattgtgttactgttgtctacattattcagtacagtaacaggctatataggtttgtagcctaggagcagtagactataccatgtagcctaagtatggagtagactatacaattatgtaggtttgtgtaagtacactctgtcatggtctatacgacaaagttgcctgactcatttcttagaatgtatcctcatttttaagcagcacatgactgtacttagagtatttatgtttcaggaaggaatttctaaaattgccaagatcaattattatattctagttttagtggttttgaaaatatttggcaataattagtttagtttccacattaatattaagttacataaaaaattttaaaaagatcttcaaagataaaaattaaattatttaatgctaattttgaagatctttgtattatattttttctgccataaaaataaactcatataacagttgtttaatattgaagattttcaagtgtgtatctgctttggtataatgtatattttctaatttacttagatctgtttttttaaaaaaatttttggtagaatttgcttttataactgctttataattcacattaaaattatttgaagtattaaaacaagatattacttttacatcttaaataatatcttaactatttgaatatttttactctaaattttttacacttgtttcctcattttgattattttaatttattaaaaattaaacctactgttttataatgtttgaaaatcatattcaagctattgaaagtgtcgtgatttatcaggaacaataattatgttttcattttgctttcatttgaacctcctgagtataaagaatattaatgaagtaagagtagattagagtaagagtcagaaatagatgaaaagcattccttgagtgctttttcaaaccttttttctgtcattgagctttgatattgagattttaaaatgatttcctggccagttagaaatctgtaccagttggtgtcaggtgaggctgagaaacaagtttgatagcgggaatagtgtaaatttcctgagccctttgttgtcttgcttttccctgtcttggatgttgctttctgtgaagctggttgaactggtgaatatgctgtgtgtagaagaagctgatatatttaagataccacagaagaactaacaaactgcagcactgtatctgattcttgttcacttttatgtagcatagtgttctctagctcttttctttttattgttcagaaagaccgaattatttaagtgttaacttgttttctgtttaagcttttttgctgattctgtgcttagtcatagatagtaatgtctctttatgttgttttcagtcctatcagctaggaactataatcggggatttattttttctcagctgcaattttatttatattagaagaacttgaaatgctgtttttgctgttctggagaaaagtagaaaggtgtggttatttctctttgggagttgtgtctaaaatattattctatcctttttatttttaggaattatagccaatacttttttgaatattgatatttgctgagcactttgctaggtacttgcatggattattccatgtaaccttcacaacaactctataaagaaggtattattgttattatttccatttcataaatgagtaaacaaaagcttaacagggaccttagctcacagaaccagcatgcattggaatgaggatgtggagttatttagaggtggatggaaggatccttggcttgaattttcgttttctgagctttgcaaggatgttgtaaatgggccttggggatcttggcccatttcttcgtctttcagattttggtgaatttttataaatctatatcctgtttatacattgttgctactggttttgtctgagaaaagtttccagataaggactgattttgagactttcaatacatacttatgccagggaaggaaacaaccacgaggcagtggtgagtattctcagcgtaaatactggtgttgaagctgtgtattgaataccctcttcctccgtccttgccacattactttggcatttgtcagtagtgagggcaacaataaagtaaatactgtaatgcttaatcatttccctgctcacaaatgggctcctatcaaaaattccatcctgagagggggcattttatagcactattaactccttcctaaagacgtagtgggaaatggatgaatcaattacaaaataacttcagattcagaattttcaccagttcttcactttgaatttgaacacttggattctttatttcaaacttggaaatggtagattaaatggagggaggattgggttttctgatatactgcgttattgcagttatttaaattaaactgtaacaaattgttttttcttttcttttaaaaaattatttacttatttatttagtaacaaatctttaatgtccttcatttcattcagcattcataaccctgagacttagttctgttggcgctttggtatgtctttggtactttaaccttgagaaatgttatcaaagaaatgcttccctcccttccccctcccactctgtctccctcctcccctaccccttctgtctctccctttccttgtcctcctacttataaaatttaagcatagagaaaatcttccctctggcccagttaagcaccataagcacctaataataccgcatctgctctcaaggttgtaaatgtagtgtttctaaatgaggtgacgtttactaaaaagtatatttaacctgcctctgaggttttatctttttaaaattcattttgccttccaaaagggtgtgttattttttggaatttacagggcagctataaaacagaatgcacagtatgctctacacagctcgtttcctgtttcttcctggtctcactgccctggtctctcttttcctttatccttctagttcactgatctcctacttgctactctttgattatcctagctaggggtttgagatttcttttttttttttttgagacagagtctcgctctattgcccaggctggagtgcaatggtgcgatcttggctcactgcaacctccgcctcccgggttcaagtgattctcctgcctgagcctctcgagtagctgggattacaggcacccgccaccacgtctggctaatttttgtacttttagtagagatgaggtttcaccaggttggccaggctggtctcgaactcctgacgtcaggtgatccacccacctcggcctcccaaagtgctgggattacaggcgtgagcctccgtgcctggccggggtttgagatttcttagtcactccattgttttatgttttataaaccacgccaacaagattatttcattaatctcatcttactttcctagactagattcttcagtggacttttccagaactccgttgttcactcttctgaaaaataacttgatgttctgtcctgtcatctttattctgttcatactccacttattttgggctttttttttttctttctctcctgcaagaagtcaagacacctcatgatatggtgaaacgatcataggctctaaggctcttgggttctggtgttaggagtgtcacagcctcagcttatgagacgtttaaaaatgactgctatggcccaggcactatgcaagctgcggggatggaaagatgcctaagacctgtctctcccttcagaatgtagtcatttcctcataagaaaatgaagccactggactctgaatgtatcatctggctgtgcagttctgccattctggagcactcatttatttagtcctatagagagagagagagagtgtgtgtgtgtctatgcgtatgtgtgtgtttttaatttgcttaataatggatctttttgattgaattaatccatagactcgtaggatttacaaataagaagacgtttaaagttaatatgatttaatcatctgttttacaggtgaggtaacaggccttggcagtaaagtgactgccctcctgtcacacaattagtggcaaagctgggaaagaacccagatcttcgatttctaattcagcacttttctgtccaagttgaccgtttaaaaatttcttgattctaagacttttgcctgagctatgattcctggtttcatacagaaatctggaagtatcccactggtattggtaatgatcgctgtagcgttttgcaggttaagtcactgactatcagtcagatgcctcctacatactggtctggtttttgctttttggagcatatgaaagaagtatctgacatttttttttttctgtccttaaggattttgagaacttgagttgaatttatgaaaaattaacctgaccagaattttcatttttctttctttattgtttctctttagatcttgtgcactctacctccccattaaaaatatcttgattacttttttttttttttgagacggagtctcgctctgtcgtccagggtggagtgcagtggcgcgatctcggctcactgcaagctccgcctcccggattcacgccattctcctgcctcagcctcccgagtagctgggactacaggtgcccgccaccgtgcctggcgaattttttgtatttttagtagagatggtgtttcactgtgttagccaggatggtctccatctcctgaacttttcttatactactattaggcaaacattaattgatccacagttgtgtccctggcatgggtgttaaggatgtagaaccaatttcagttttccaggaatgtgctgcccatgggttgcagattgaatgatgaaccatccaatgtgctttagtgcggtgattctcaaccaggccaattttgccccccacgggacatgagtcaatgtctgaaaacatttgttgttgtcacaactgggcagggtggggaaggatgggggtggtactgctggcatcctggtgaacagagaccggaggtgctagtggagatcccaccccactacactgacccccgtgacaagaatgatctgactggaaatgtcagtagtgtcaacgtggagaaacctaggtacagggtgtgataattgctatattcaaaacaactaccacgtttttagtgttttctgagcctggctctgttctgtggtcaaggtggacatatattactattgcccctagctaggtttaggggtctgggaaggctgagttgcacccggaggtcaggtagaaggaggagggaacaggcacagacagcagagggggtggtgtgtgccaccacttggaggggacagttagggacatctggggaaatgcaggctgctcattatggtgaaagctagaaggtgagggggcaagaaactcaagaagaggctatggaaattgcacagtggaagctggaaaatggatggcgtcgtacgacattctgaggcacctggtttttgtttaaagggtttagagaaccaaaaatggattttaggtcaggtagttacatgtttgggtttgtctgttttggaagagaacttcagtggtttcaaggagaactaattggaaggaggcaactggagataagttaattaggaggctgttgcagcgatttcatgtaagaattgagccagggaagtgaaagtagggatggaaatataaatagttgaatttcagagatattggtgaggttgattgtttcggacaccaaagaagggaggagttagggtcaggtcattgattgttgacgagggcaaacatagataaagcacatgtgccccttccccaaagggaggtatgtaaatcttgtcagcagtacctgcttctagcttcaagtccagcaaatgaggggatgtctctcttttccgtcaacctatggtctgaaagttaagccagccattgcaacacattggcacacaacgggggagagaagacagggttgctgcaataacatcttataaaaaggaggagagaatggacatattccatagatgctgtgttccatcccattgaatgagaattgcaagacctcctgcacactagctgtggcgtgaactcccgagttggcccggttggctgcttttggttttgttctctgagaagatctcccttgtccattgtcctttgtggctcatctaggatgggtgtatacgtcatatttcagctcagatgtcatctcctcaggcagcttttctctggcgtccgagtagaaagtaggcatccagtttttaatcgccttgctggagctagggatagggcatgtgttagttatctgcagcattcgcttcatttacgtgttgtgctttttgtgcccccttatgctggaatgtaaggtcaggagggtgggaggggccttggctgatgtgttcactctgaatctctaatacctggaatggtatctggctcaggatgttttttgaaagaaagaggaaatgaatgaacgaggagaataaaatgctgaaggaggaaccggtttttaaatttttttgtttgtgttttggtggggaagaggacattgaattcagttttggatatgagttttagaaatattgatattaaatatagacaggaacataggcttgtcaataggccattaaacatacaataggtacagatgtccaattggccattaaacatgcagagtgaagctcagggaaattacagtaaagatagctaacatgtactgagctttgccatgtgccagtctctgttcttagcactttactgatcttagtaaagtggagctatcaatttatggaagcagaagatgaagctattgattggtaatacccagagggggtgcatgataattaaatagggacagaatccagaggcacagcagcatctgagaggtgagtcaagaaagaggcacaagatcctagggaacactggcatttaagggatgagtgaagaaagtggcccctcttagaagaagcaactagagagcaggagggttggggtgagggaaatctgggagagtgtggtgtctctgaatccaaggaagcggttcagggaggagggattcctggatgtctcagagatctgaaaagtggccgtggtcttccagatcaaataaatgatgttgggaagagctgtttcaggaaaaccttgggaaaggaaagaggttgagggtttgagaatttcgggatgctgtcaggaaggagctagtagagagggagagtttggaaatgcagtggagggagaatattgatgctgcctgacttctggggaggtaggagttgattgcaactgaagcgtttgataggagcacgttctcagacgtagattttagttttttttttttttcttttttttcctgtagaaccttctgatttccttgttctgtaattttccaatggatcaagaggcgattgaactgtacatgctgcacattgcttccctggttcattgccagtgaaagagctggggacagtagggtcttgtcagctgcagccactgactcagcagccatcagcagcaaggacagaggttctgctgcattccttactttaccttctttcactggcatcagctgttagttttgtttttccaggttaccttggcttcccatggggttgcattttcactaatttcccctaagcctaaaattctggtggcacaaaagccatctttcacaagtagtcaggctgtcagtagttgagatggctcagtaatgtctgcaaccacacatttaataaagaaaacctaaattacatctgcatgttacgaaattgaaactgcatcaacttttgttttttctagtgacaggaattggctttctgattgcgaaaacaaagctagtgtttttggaatgtgctttccaaatagaaagtgtgtcttagtttcctgataggtggattctgaaactttttatctagctttagattttatgaatttgtatctagcttaaacatgctcatagataatggagccaggtaatatagactaagtacttaaaaacaagtactcttctctttgtcacatttgaaagaaaatatattttatgaaaataatttaaaaaataaactgacttggttatttgagaatagtttctcataattgttattatatactctgaagcctaagatgttatctcatttgataatctgcttaaaaaatatgaatgaattatgatagcattggaaaaatttacagaaatagttttctgtaggtttttgttttataactagcctcctccatcaaagctaatagttatgctttcagtgaagtgaagagtagtcagcaaagtatcttgactagacatttgattcttgctgaagcaaaactggcttgcaaatctgggaaaggctaggtagggaagttggatggtttaggaggagaggcatatttgtacagtctcctgtaaggtagtaaaatttggaactcagattttcagtaactccatagagttacatgactgatacagaagcacatagctccctcagtgattcagcctgttggcatttcttagctttttgttatcaagacttctttacgctcttaaaatttatcaaggaccccaagaaacttaatattagccatgttacaaattaaaagtgataaaattaaaaatataaattcatgaaaaataccaaaaataaattcattataaagagcatatatttatgaaaaataatattttacaaaatcatgaaaaaatatcattgctgtgcatttttgtcaatctcattaacatctggcttgattaaagacagctagattcacaaatgtgcttctgcattcagtctgtcatttggaatatttcactgtaagtcatgagagaatgagagtaaaaaagacaacttatattttagtagtattaagaaaacatttttgaactcctgaactcctgagaggatttcagggacctcttggcaggagttgggtgggagggggtccctggactacactttgagaaccactggatgaaactatatgtatttcttgatgaccattcccttggtttcctttcttctgccccttggggcctggtaaaatattctttatgttgactcctcaaatgtgtttactgatttaaatttcctctataaaattccaggggaaggaaccatcaagtgagtcaggccttcacttccttttcacgaagcctttccccttaattagtcatgctgtaagaatccatctcactcctttgactcagccgccatagaggtgccaccagacgctttttactatgcttgatgacattgtagactggttacaaatcaagataagttgtttaggaaaaaaatactcccttttcagtacaaagaattctaggaagtcttggaggttgctgggagaaagaaagtagaattgtttcctagaaacggagtggaaaagtctttggagaagtttttgggggcctggctggcacatgggatccactctgctctccaggaagcgtatgccatcttctagttcgcatttctgcaccaaggcagtggcaggtggcccgaagagtgagtgggaagcaataatcagctctccaagtaacagcattttcatttgctaaatgttatgttaatgttctccaaactgatggtagaattatacaaacttaggctgaaaatacgcatactgttcatcttaagttttcagacttctgataaaatgtaggtaaataatatcaaaaagtatcttaaaaattacacagtaaattttgtatagaacaaatatgtgtacaacttacaacatttacattggaacaattagctacatcagaaaaatgcctgcatgaatatagtagcataaaaacagttgcttttgcatttaacttgcaaagaaatggaagcaacagcattttaaaaagagcatgggtttatgtgctttatctggatgagtagtggcattttctaactgcttgcctcttgggcacataagtcatcatggtacattcttactaatagactttgaacttctttctctgtccttttcttctgggccgtatattgccgcctttagcgcttcagcatggaagggatctcaaatgtcattcagaatggcctccgccacacctttggaaattcaggtggagagaaacaggtgctcggttatccttattttcctcattctctgctttttcattttctgtgtaagtgaagatcctgaaagctggtagtttactaatttactaagaccattgcttaacgagagaaataaaagtttattataaaagttcattatatttatagtcttgataatgaacagaatttccctttgaggaaaaagcatttttcaaattcgacaatagattaaatgcattcttaagacgtgttttatagctccatttttcactcttagttttaaacaaatattaacattttaacataatgtattgcatgtgtagaaaatctgcttgtgaaaataactaaactaaaatatgtgactctaattctaaaagtctaagtcgcaagatgtcatttttgggggaagaaggccagatgtcggtatgtttgagactagagttctaggtcaaaaatatgtatagagtgtatcttacctcctttaaatgaaattcatgtgtttttaaggtgtattgcatagtcagccaactcagttgtctgccaaacgaggcatgcgacattatttatacaaaattatacacagatatgaatatataatcaagtatctagcaatttgctttttattcacatttttgtataatgattgaaggaatatcatgaacatgggaaacattcacattaatgggtatgcttaaaattacctttcactatatgaaattttcaccttgaaaaagaaaagtctttaagttagctcttctgtgcagattaagaaggtgtacaaaatgtagcttgtaggaagtttagcaaaagaacgcctagatcaaatgcctggagtttttactgcaggtagttaagtgtttctccggaagggagatcattcctattaaagagggaagcctcacactgacatttgcagctcatcaatgagctccatgaagggatgtttgagtttttgttttcattccgttgcctctcacctctctcaacctcaaaagaagacaaggaatcttccagactgtcagtggagcagggaggcctgaagatgcagccaggtagccagagagcgggccagggtgcagccgcctggtgcctctccaggttgcctcacacatgcagagtgaagccaggaggacatcatttctggccttttgttgttgttgttctttacaaagaaacattcgattatacaattgggcatcacctgcaagaagtctacgtcaaaaagacggtgggacacttaacgtgtctcagagattgaactatgcagttttaccacttttctggacttagggatccagttactgtaaagcagctttctttatcctgtttttcagttatgggcaggataagatcactcagtgaggattagccacagagctgagatttagggcacgaggttaaataatgggtggagctaagagattccaggtaaaaaccactggctttctatatgagcatatgtgaaatgcacggaactatttttttggtgggatggtaagaacaggaaaatctggacaatcatttatggattatgctttcatgggattagttaaaagacatggcgctgttacttgtgagcctttacaagtagtgaactaggaagtttatctcaatttcagacattaattttcattattcatttccccttaggccattctctactttaacttttctcctttaatgcctaaaaacgtttacaatgacttacccaataatttaaaataatagtaacgcatttctaaaacgatttaagtgtgtctttgttagcttctgaaagaagctagtgtgtgtttttcaaagttgtcatgttatatatgtggaccatttgttcaaccagaataaaaatggtctgaaacagaattattttgctgttggaaattactttattgtgcagaactgttaaaactatgtttttagtttaaattgctatttttaaaatgtgttgaaaaatatgcaagtagaatgtgagataatacttcactttaaaaatgaacaaattgagtaaaccatcctcagacttagtcctatgaaattttcaataactgaaatgcaaaaaggtggttgtttctgttgacattaggtttgtatgaagcaaatagaggtgggcaaaaaaaaatgagctccatctgagatagtaagataactttattcccatacaatacctgtgttttcattaccaaagtagcttgtgttttatattatcagatagaccttctagtaacagtatcaaattttttgcagataaggtaattccgatttaagtgacactttttttttttaaacttggcagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaactctagtgttgatttgtactttttctgtttttcttaccttgtgaaatatttatgagctaaaattttgggaaaaagcataacctaaatctccatcatctcttacatgtttaagaacatatccatttatcataaataaaattccttatggatcttatatatctatgattgtcagtaactgaataggaaagatttacggtaaacactttttatttcttatgaatgtagaacccgaggtagtagttataggtagaacataaattgacagtgatgttttaagaacatgcattcattcagcaaatatttagtgaaggcctactctgtaccaggccatgatctgggcacttgggatactttagtgaacaaagcagacaaagataatgcaccttcaaggggcttgccttaaaaaaaaaattgttagatttaaatatacatgatattgagtatctcttatgatggccgcaaatgagccttgaattctggttctatccctgttattttcagggatatccttggaagttacttactctcttttgcttacattgaaaaactaggataaaaaatatttgttctatttacctcacagtaaatagattaatatatgtatgattttggctaagttactatcaattagccgttaaaatggagggattgaatttgctgatctgttaggtctttgttatggtaaatatttatgatacttgctaattaggggggaaccaaatgaaagagcatcacatggatgagtatggatgatgatacttattttggaaatttaagaggaatgggcaaggaaaacctaagagtagaagcaagtgtcttatttcttagctccctgcctgctaacttggagcttttattctttcctttggtgaataattctttaaaaattttatatttaaatatggataaatcaagtgatgccagccagtctgaaataaaaaatcaagagattaactgggtagctagccctcttattttcaggaagaacttaagttatatgtgtccaagatcacacagggggatggttagttacagagctggatctcttaattcccaggcaattatacttttaatgatgctggtttttggtatgtgattttatttagaagttagaaaaaattttaaacatgattggaagcagaaatactgaacatggtagccctctaaagaagggaacataaatattgctcataagccaggaattactggcaggcctcagcttctcagatcaagaacaaatacttcattggtcaaactaaagtcatcataattccagcatcgagatgtctttataggttgtcacagtttggaatctctggacatatttgggtccaaagctccttttctttccaaaagaagagccctgtggagacagtcacagtgtttatggatatatagtcttcctgataaaagctattaggggattttgggtgcaataataatagttaataaaaatttaaataatttgagtagtgttagttacagttaatacatagcatgtactatgtgccaggcactatgatatgacctttatatctgaattagtagcttagtcctcataacaaacctttgagattaaatctaattattattctcatttcacagatgaagagcttggtgcaaaagtggttaagtagcttgctcagcgtcacacaattaggaagtggcagagccagggtttaaacccaggaaggctgatttgacagttacactattttgccttgtcgtattggtggggaaaaacagtgaaatatttttaccaggatgctttggagaaaatttgagttggcaatctctgttaaagtataatatttgtgagtttatctcaacctgaatggtctagcttaaaaaagaaaaacgttatactaggtggctgctttttctattttagtttttacttagaagataaatttgtcaaattagaatgaggctaattctcccaggtttctccctagtgcagaggaggcaacagccaggcagatgcccgatgctgcttcatggaagtctgttcttcatttgggtcttttctttgaaagtttctaaggagtctgacaggatacgcttgttggagggtatagctgtccatttctttaagagtttctctagtttgcttgatctgcagcactgaggttttcttgctgcacagagttcattgaggtgcacattatagtaacccactttccggtattattacagagcgaaggctccttgtaaataacccagttcctctttttttgtctccactgtttggaaattttaaatcagggaagcaactctcaggtaagtgggatattcttaccgaaaataaattcttgtggacttactccactaaaataaattattgggcctttattgttgtatccccttatcaggaaaatcacctataatttgtatgagtcagttatatcctataattaaggaagattaaggccacaatgattgaaattaaataatatttttgatctaaatttttaattgttgtcttttttcccctcttctattttgcagttcttcgtgccatgaaggaggacagtgaaaaagttccgagcttgttaactgattatattctgaaaggtgagttttataatggtataggtgcgatggctgggaggtttggattagtcagtaaatacatcgccttgctaatacattagacagtaacttcccaatgcacaactttcattaatcttattatgcagggtgaggattagctacatgactgacttctaccaacattatatatcatggttttatataatttaagttttattggaggttctgggttggaaataatctccacagttaaactataaacatcaagagaggtagtagaagaaaattagtgagatggcaccataatcatgtgggtatcagatgttggcagattggcactgggaaatttgagaagggtggtctctgtcatcttgaggacagtggaaaggaggacagatcattagtgaggacggatgaaggaaggaagagtcacatctgtgaacagtgccaaagggaatacgaaagggactgatgtaagacacagggagggaagcggggaaataaaaagaatggacttgcataaacccaggaaagtgaaaaagcagccacaaatcttagaggcaaggtgaggctcacacagggtgggaatattgatgaggcaaaagaagagtgagaggttgagttgctttgccgagaaaagagcaaagtttggatgataaagaagggacggaagaacttaattagaggcaaaattaatactttacgatgaaatatttttttaaagtagcaggtattcagggaccagattttgaaagcatcacaaaatgcatctttgtagtgtttgatcaaattttgagagcaatcctcttctagtaacagtcttcttctctgggttctctctcttctccattaaagttagctgagcacaaggaagatgaagatttctgagacattagaaacctctgatggtcttttcttaaaccatagtgtcatgaaaggggaacctcagtagtatacacagggtgctcaaagtgaatcacacatttcacttgtaagagtcttgatgcggtgagagtaagaagcatgagctagacactagtgggttgacactggagtagaacagactgagttgacatcattttaaaaaataagctttttttctgatggaggactttttctccctataaaattctgaaaaattttttttttaatacctgacatctttgtttgcttttgtgttgtgctagcattggtatgaaagctggattgttctgaggttcgttcttctagatgtgaaacaggaatgagacgaacataaagaacatgtcttaaattttaattatatcgggttcctaggcctctatgagggccagagatagaatgagcttctgaagcattctctagctattttagcatttaactgcatggaaggatgttatgacccaaagaacagagtcctctggggaaaaatgatttttaattctttactctgaaaacctaggactataattgtgaacctacctataccgcatgccttagggaagcagcacccatctaattctgctcctcatgctcgggccgctggctcctgtctgtaagcccagttctatctatactgtacctgcttctgatgagctgtctgtgtgcatgtgttgtggttttgtcttggctttgtattgtgaggactgggtggaaaagcagcaaggatttagactacagtggagactgtagtcagagaaaatgaagacgggagtgcaatgtggagatgtatttacccaaatgtgtgtgggaaggtggggaagtcgggtcattgaaaatgctcttttccacccatcctgaaagttcacagctggttaactgttcctcttccttggggaccaataatacgacactttgcccgggagggggatattgctcaaggggagaatactccttccccttttttgggtggtttgttgttgttttaacacagatgagagtgtggcttggctgcctaaatacaccacttagttttaatgcaaatgtcagaagtgaaagaaggtagaaaagtggtctcatttggcctgagaaaagggagtagggtgggcactgtatgggctaattgagcttctctttctcgcacctgcctaatgaccccactgcagcctgccgccactgctgccttgacagtagtacccaaggctgattctgaagtaatgtacgcgtggctgctgccgtgctgctagttaggaataaaaatgtgtgcagaaacttgcacccttctttgacttccctagggatcctgtttgttgtgtcacaagcctcatggtatagggcgaatgttaggggcttctatctccaagtggcaccctaagagacatggccttttggtatctcatttctgggaaattctaatgtgtgttgagagaactcatccttgttgggtatagcctcttaaaacctttaaaaaattgctacatagatctttgcattaacatttagttctcattacttaatggtttttaaatgtacatgtaaaatgtatgttttgtgtaaatgtatacaaaatatacatttgtagctaaaagttctctttttcttctagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaatacatgtttgagagccttatatttgggagttttgtgttgtattttttttttccttacagtgctagattctttcccttaattccacacagaacccatcgctacaatatgtgagcagatgaaaccctgattagtcccagaatgctacgaaggggaagaggaggacgtttattagagtatgctgagctgctgtggaatgacagaagtaagtcctgctctttttctggggctgtgagacatttcaaaaacagccatgcagacccctcccatagacgacatgaatgaattaagagtctatataggacctgctacaggcggctttcacaattccacttaaacacctgtgagcaaaacaaacagggctaacatattcctcactccactcagcaactgagacaccatgactgcaaaggcaggggcgcggtttgaagtttaatgcctgcttggcatttcagccatcatctctaggggtatgagaaactcgagatggtttccttgttttattaatgttcttatttggaacttactggccctttccccagatacatgtacttacacagtaatattaataatttaaattaatttgaatttgtaaaaatgacgccttgtactgaagaaatgtagctttaaagggtatatgatatagtagaaagtccttagggggatatatttttttaaaggagattcaacattggtctgtttatagctcattcttaaattgatgcttctaaaatgtatgaaaatatacctatttattttttcctgtcagctcaaaaagtctctttgcagttaggcttcccctgatcgtgctcggtaaagtctttcttcttcagcatcgaaccactgtaggatttcccaccacagtcctcctgtgcgtagcaagttaattttgataccagctatgagcacgtttctgacagcaggtaggtttcttgtctccctaaaaacagcatcgctattctctgtactctgggagacacttttctttttgcaaggataccttgggaaagacccgcctaatgacaaaagcacgggacttcttgttacaccaggggttcattggactgataaccttaaaagtctttcggatctcagagatggaatctttttgcaagttacactgtgtgatttcaactcaaaatgtttatttcctgccaagaatcaagttgcagataattctcttacagcttttttgaagaaaacaaaaacaaactgtagaactatgatgcactccaagtgccatatatctattttattcttcaggaaattatatttttcttttacaagagcacaacaggaaccaaagtaaaagagtaatagatacagcactcaggataaatcatatctttaaaataataataaaaaaatttacaccttgtcctatatcctgttagtattttcataatatggccatgattgaaaaaacaaaaagcaagcatctacaattttttttgataaagactttttatgccaggaatggattaattaccaacaaaatttatactaatcaggctgatgtcaatctatttttgtaatgtatcattaacaaatttattttggaaaagataaaaatattgccccttgataataaatctttttttcctttgatgcaaacagctagaacacctttttctttttctttttgatattctaagacaaaaaaatggttaatcttcagattaataaattaggtcattataataataaattaattttttttaaagttcagcaacctctgtccaagtatttacaacaatacttgaaagttcctttacaaaacagaacacattttcttttcacgttaagcatactgggtatctgtgtctttcacaacaagcatttttaaaagaaaactcaatgcacaaatgggttaattagtataaaagtgctaagggctgtttgaaaagttaccactatagtatacagtcagttatatttgaggcatactacaacaaacttccagcttattgtggacaatattccagtagttgtttcaaaccattgtttga

SEQ ID NO: 14012 - DNA, 8137 bp, Human
ataaataaaaatagagactagaaaaacaatagcaaaaaatcaatgaaacagagtttttttgaaagacacagaaaatttacaaacctctagatagactaagaaaaaaagaggaaacactcaaataaataaaatcgaagatgtgcttttctgctcctctcatgctgcttttgaaattcagatgcagccttctttaaatgatttgtattgtgttccacaaataatcttttgggacttctttctgaaacatgactttgtttccctgcggaacaaaggcaaggtagagtgacagggaaaagaagtgaggtagggaaggctattctgtgaagagtgattattgggcaatagagaggctccctaggttatgcaagagtcaaagggtaactggatcccagaggtgatagaagcacacttatcagagacagtgtctacttgtagggacaacagagtaaatctgcattctcatgggcactgtggcttgtcctggaagcatctcaggctggcatagtcatacctctaggagagttaatactctagaaagaggaacaagtctagaaataagatgatagaaatttccagagaatttgagaaaaagccaccatggatacaaagatacctctgagcacccttgctccaattttcgtttcttggtgagtctgcagtattatgcttcatattcatgcttcagtgctgccatctgaactctcactgctccagactgtttccagcatattttttcttctagatatttctactcttgctcatctttagagaggctgttgctttagtacaagttggcaaattttttaattttagggctttgtggacactatagtctctgtcacaactacacaactctgccactgtagcacaaaagcagccatatacaatagctaaacaaatgggcatggctgtgttccattaaaactttatttactgccggacgcattggctcacgcctgtaatcccagcactttgggaggccgaggcgggcggatcacgagttcaggagttcaagagcagcctggccaacatggtgaaaccccatttctgctaaaaacacaaaaattagccgggtgtggtggcgggcacctgtaatcccagctactcggggggctgaggcagataattgcttgaacccgggaggtggaggttgcagtgagccgagatcgtgccactgcactccagcctgggcgacagagtgagactctgtctcaaaaaaaaaaaaacagaaaacaaacaaacaaaaactttatttacaaaaattcagcagggtaaacttgacgtgtgggctgccatttgcagatgccctcttttaggtatactcccatccattccattggtttccattttactttctcatttctcaaccatgaacatgccattgttttcagttgctccatgtgttggcaagttccctaaaccccaacgaatagtaaggctcaggatcatttcggcgaatacaggttgagtttctgctataaaaacaaattgaatgctgaaacatggatgaatgtgggaggaaagagctacttggaagagtaactctcaaagctctctctcagagctctctctctggggagaaagaacagtggcggaaactcctgggtgaggaatccctgattcccaaacaactccaccccatgtccctggctgtcctcccctctgagtaatgcagacagccttttggggctgtgatgattctatctcctatgaagccatctgatgaaactctgatttcaccaaccactagcacccaggaagagcctggtgtgacataagctgaatggaataattttatgggttgaggggggactctttagaagcatctaactagcatattttggagaaaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaaggtgagggggttggccatatggggggccagcagcagctggctctctttgaacagtaagacattttcaagttcaagtgtacctcatgagagaaatttcttttcagattctgtgtgccaaggctgagaatgccaggctggtggtgaacattgacaatgccaagctggcctctgacgacttcagaagcaagtatgttgaacttcaaggtccctatggttctttcatggccctagggacctactattgcctggaagagaggagaaagccatttctctctatttctcctcctagggctggttatgtaaaattagtttcaaatagggaactagactcatgtgctgcctgctctttggtctatactggttttttttggaagtgtttcttaaaccacaaaattcagagattgaaatgaattgttctttgggaattgatttggtggtatattagctaacaaaaccgagaacacagtgagagacttcatctcatgtgtgcctgtgggctcctcgtggtgttaggtgagtcagggaacctcttcagcctatccatggacagcttgactgaagcatatggaagagaagaggcagaaaactgtaagttcaagaagattcaggccaattctacccaaacaacacatgagaggggaaggtggttttctttcctgacttatcctcccactccgacacgtgcaggtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggtatgaaacaaattcacaaaagcaggcctcagaactaagctactagcactgggaatcaggagaggattactgtctggatccctggtctgggacccttctctgaggaactcaagatgttctcagagagtgacggtgctacatccatatcaaggagtggagtgagctgctcattcttcagcggctgggtgagggttaggcaggtgttggaattactgaggagggacatcattcattgagccctgctctctgctgatcactgctaggtcctgaatttggtggtggagatggagggacaaaaaagaaataagacatggcccttttcttaaaagagctcacagtctagtatagaaagacagtcatataaacacagtgatataaacaagacagagtgaaacaagtaccatatgagatgtacaagcagtatgctctagaaataatccaggctgcccaagaggagatagggaactcttctcagatgcaaagaggaggattccagtacttgggtgtttcagtctgagggaagaggttgaacaaagacacagaagtggcagggcagggtgtatctgggtatggctgggcatgcagtacctccaagggatgaaagtgaagatgtgatgggaagcgaggaaggacttgcatatgccaaggagtttagacttagtcttgtagaaggtgtgaggttgtttccgtttctatgggacaacaattgacgtgatccctgttggagtttattgctataaaatgtgtgtgtcactctttgggaatgatcagaatcttccttttagtgcttttttttttttgacggagtcatgctctgtcaccaggctggagtgcagtggcgtgatctaggctcactgtaacatccgactccctggttcaagtgattcacttgcctcagcctcctgagtagctgggattacaggcacatgccaccacgcccagctaatttttgtattgttagtagagatggggtttcaccatgttggctaggatggtttcgatctcctgacttcgtgatccacctgcctctgcctcccaaagtgctgggattacaggcttgagccactgtgcccggccccttttagtgctttctgggcagcatcaagctcattttcccagagcaggaagatggcacatcttccatgggacagcaattgatgtgatccctgttggagtttattgctataaaatgtgtgtgtcactctttgggaatgatcagaatattccttttagtgctttttgggcagtattgtgctcatttccctggagcaggaaaatggcagatccattgccgtaggttcattgtttcccttttctccaacaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcaggtgggcatctaagcacatggccactcaggacccgaggtgccccagggccctggagacagggtctgatcctttccccacttgggtgtttcagaccgaggagctgaacaagcaggtggtatccagctcagagcagctgcagtcctgccaggcggagatcatcgagctgagacgcacagtcaacgccctggagatcgagctgcaggcccagcacaacctggtgtgtattgttcagacctgctggtgagcgatgggaacttgggaggcagagtcccggggatgtgcttggggccacacactctccttagctcttggagcttgtgacttccttgtaatcctgtgaagaaaccctttgaaggagcagctctctgacattcctgatcttccccaccacagcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagtgagtatggggcaaataatgtctgggaagaatgtgtacagtgggatattgtaggcacacaaatggtggccatgttttcaactagtcaggcaacacacattaactgtgtagcatgtgtccagtgatctgtgatagctaagcaaagggaggccaaaggtaagggaacagcccctatctcagggggctaacaatggaggagtggtggcaggagctggccagttgtaggaataacatttgtgtaaggcacattaagttccaggagacctcaagagtatgagataatatttttgaaaagcacaatttttccacctctgcacatggcattctgggagagagagaagggtttggtagtaatcagaacttgattctggctgggtgcaatggctcatgcctataatccactttgggaggttgaggtgggtggatcacttgaggtcaggagttcaagaccagcctggccaacatggtgaaaccccatcgctaccaaaaatacaaaaaattagccaggcatggtgacgcatgcctgtgatcctaactacttgggaggctgaggcaggagaatcgcttgaacctgggaggcatagtgagccttggctcccacttgcagtgagccaagatcgcaccactgcactccagcctaggcaacagagcaagaccctgtctcaaaaacaaaacaaaacaaaacaaaaagaacttgattccaactaactccagccactgagaattcataggttgtgtcattaagcccaaggtattgtgtgcattaaaacctcctcctaaagccattctaaacctccttgtcctcctaggctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataataaatgtttctcattcatattcatgcattgtaaattactcatcatggctgtttcataaaaataccccttcattaggagaataaaatgaagtaaatgactgagccaagcctttatgcttcaccagaaacactgatgtagacagggaaggacgtccttctgggagactcccacccagggtaggccatgcaggaaacctggccttcaatacccatgcttaccttgccttgactacagggcccttggcaattttgcaaagcctccccagacttcactgctatctccagctctcaccctcatcagaatagaatgttctgcttccctttctcctaaactgcctgaagaaactacagaaactgcttctacagaaactgttcaaagagcagtgattctctcctctcaacctctctgctgctgctgccttgctgatatagatacctactcctcccttaaaatacaccttcattgatttccataaccctgcacactctgggtcttcttgtaatatctctaattacctgttctctgttgtcttgttagctgtcttcccctttttgtcccaaatgaaggaaacacctatattcttagccctctgtctttctctttctacgtccctgttcgtgtagatctagctcctctatgctgatgactgccacatctccctctcatctcagctcagtttccaggttttctgttgcgcatatgacagcttcacttggtatcaggtcattacatcatgtttaattggactaaaacgtatttttcccaaactggttcatcttgccgcccacttgttatgcctgacatgttgtcctccagatagaccctttaaatgcagtccttacctttcccctcttcaagtttattctttcccctagatctttggtcttatccataatgttcttccatagcctctttatcatttcattttctataattccaagaaaggccaatgttcattaaacatctcccccaaaacattaatcttaccccacaccccaccccacttgcctcatccctgaatttttaaagctttcaattttataggccagtctcaattatccattttatttaatcctatctgattgacacaactgcaatcaatcatctatagtgtgtgctgggtactgtgggcggtactgagaaacacaaataagtgaatcccagtctcggcccacagcatgttttacagtttagagtggatgagacaaagctacagtcatcatagacaaatatcagtgtggctcaagaaaggtgcagataaagaattacgaatttcagatgtgtgagagaatgaaaagaagaggctccaagaaggagggagcactcaatcaaagccttgaaaacccaaatgttctgttgatataaattttgtctgcctgtcttgttgactgcaggcccttcagcagaggcaatatcatcacctaattaaagacgatgtaaaccatggaatactgtaagtggaataaataaggaagagtaacactaatgaaaattcatgagaaggttattaaaactttatatacttcccatagtttcaacttcaatcaatgattac

SEQ ID NO: 14013 - DNA, 14091 bp, Human
  misc_feature (1)...(14091): n = A,T,C or G
aggcataactagcctgggcagaagccaactgtgaggggataccttttagggtctccacaggatggaaaaaggacatggtcaggaagagtaaagagctcagaaggggacaaaggaagttacaaaagccacttcctggtgcgtgcctgtagtcccagctactcagaggctgaggtaggaggatcacttgtgcccaggtgttcaagtccagcctgggcaacatagtgagacccccatctctaaaataaagaaagaaataattttttaaaaagccagctaggcacagtggctcacgcctataatcctagcactttgggaggctaagacaggaggattgcttgagcccaggtgtttgagaccagcctgggaaacatagtgaaaccctgtctctacaaaacatatgaaaattagctgggcgtggtggcatgtaccagcagccctagctacctgggaggctgaggtcgaaggattacctgagcctggggaggctgaggttgcagtgagccaaaattgtgccactgcacttcagcacaggcaacagagtgagaccctgtctcaaataaataaataaataaataaagccacttcctcaggtagcagcaacagggttgtggtggctgcagcagaagtgctgcagcaactggttccagaatctaagcagaaggtggaggaagatcatgcagctactgaagaagggcctggggaaatgataggctttccccaaaggggctttcaagcctgtggccctgcccagagactccgctggaacagtacaaatggcacagtccagatcctatgtggtatgtgctccctttgcaggaaatctcaagtagaaacctcagagagcctgtaatcccagcacttcgggaggctgagatggatggatcacgaggtcaggagatcgagactatcctggctaacacggtgaaaccccatctctactaaaaatacaaaaaaaaatttagccgggcgtgttggtgggcgcctgtagtcccagctactcgggaggctgaggcaggagaatggcgtgaacctgggaggtggagcttgcagtgagccgagattgcgccactgcactccagcctgggcaacagagcgagactccgtctcaaaaaaaaaaaaaaaaaagaagaagaaaagaaacctcagagagcctatatgtgcttctcagggagacatcgatgtctatcccgcacagcaggttgaactgagcatctcaacagcaaatggaggttaaaaggcagatcctggctgggcgtggtggctagagaataactccttagagaccagatcctggcggtggctcacgcctgtaattccaacattttgcgaggccaatgtgggtggatcacctgaggtcaggagtttgagaccagcctggccaacgtggtgaaaccccgtctctactaaaaatacaacaattagccgggcatggtggtggacacctgtaatcccagctactcagtaggctgaggcaggagaattgcttgaacccaggaggtggaggttgcagtgagccgagatcgcaccactgcactccagcctgggcaaaaagagcgaaactccatctcaaaaaaaaaaaaaaaaaaatgcagatccaagtgtttgtcttttattaaaactgccagagctcaagaggaaagaatagggagtgaggcagacagaataattgtcaagtcttccccacatcattcctttgtaggaggtactgggtttagttaatttggtcccttaacctgccaagatctagcccttaccgagaaaagaccaacctatccaggaactttaaaagagcagttccactgtgaagacttccctttttgtccccaaatatagcactttaagccctccctgctccaaatacacccacaggtctctccactctgccctggattggctctgtgtggccctcagggcatgttccccagactctctctctctgactgaattcctatccaatacttgctgtctacttcctgtctccctctcagtcttcagtttctccctaagtgcttctttggatctcaggctctaggtgcaatgtgaaggggagtccctgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggtaagtctccagctctatcgttagaaaggctggagcccactgtgttgacttctgtgtctgtgtctacaattgtgattcttgatcctgggggagtctcccctctcctcatctatgctcagctcccagctgtccagttggaaggagaggggaaggagagttggaaggagaggggcccaggaggttggggggaatggagatgtcgggggaggcactggaagaatgggaagggagaccccactaagtcagtagagttgcagatgtattttttgagacaggacttagaagaggacagcatttcactgagtgccaacttctcttaagaagggattggagtccatcttatcccagtttgtccctttccattgccagatcctattactatgtttctgccccacctcaattccccactgctatgatattgctgaattgacgtgtcgggatttgaatgctccctacccttcccagttccacacctgcctccactctggggtctgtggcgggagtgattgcaggagcagggccatgacttcccaggccatgttccagctggcctgatgaaggagcaacaacctctccttcctatggagagtgtttttggctgaatctcctcaaccctggcagaatatttctctgtcctcctggggactgggggaagactgaggagagaccagagcctggaatcacagccccagtctgatatcccagtgcaaataaaaacttcaaatcatgccaagccaatgaaacctgggtgcattgccctgcttgtgttattgttttttaaacactccccacacctagctatgttcctaattcctgcactgactctatgaaaaacagctcacaacaggttggtagacaacaggggctggtgtgcatctatacttcctgtcctgtatcccaagaaaagagaagccctaaagcgcaagttttcaccttttggggaaatacatgcttctttgaaaatctgggtcaggtgaagtggctcacccctgtaatctcagcactttgggaggcaggaggactgcttgagcccaggagtttgagaccagcctgggcaacatggcaaaaccacatttctacaaaaaatacaaaaattagccaggcacggtggtgcgcacctatagtcccagctacttgggaggctgaagttggaggatcacctgagcccagggaggttgaggctgcagtgaggcatgattgtgccattgcactccagcctgggcgacagagtgagatcctgtctctaaaaaagaaaaaaaaatttttttgtcccctcaagcccttaaacccaggttaagaagtgctgctctcctacagacactcactcttcccagtccctgtccatccaccaactcctccttcccaccctgtccaggctgaatccacctccacaatgccgctctcaggaaccccggcccctaataagaagaggaaatccagcaagctgatcatggaactcactggaggtaggacatgtttgcatctccctagtgtgggacttcttaagagcatccctaaaccaagagtcccagaaatatatatcttagggtgaacaaacaagagaaattaagtggtgggaaggcgggtgatggggagtgggagagggaagattaagaagggtaaggagaaagagagaaaagattcaacaccttctacccttttcacttcataatctgagacaataccctgccatgttacctgcacaggtccaggaccacaggacccatgagtcagtgaggtatatttgaggaagaaaatataatggagactggcacagactcaggtctcaataagtggttaatttcccttacttctttccccagagctagggagcttgtgtaagtacttaaaatggaaaactgcacaggcatgtttcctgggggtgggcaggggtgcatgcatgtgaagagctcttcaatacctagagactctttggagccagagctcactgagggaaagaaaagggaaagtagttaagacagaagtctgggccaggtgcagtggctcacgcctgtaatcccagaactttgggaggccaaggctggtggatcgcttgaactcaggggtttgagactggcctaggcacatggtaaaacctcgtctctacaaaaagtacaaaaattagccaggtgtagtggcatgtgcctagagtcccagctactccagaggctgaggtgggacgatcgcttgaacccgggaggtggaggctgccgtgagccatgattgcgacgctaccctccagcctgggtgacagagttcatcctaagatatatttattttgtctcaaaataaataatacaaatagggctggggctgtgtctcatacctgtaatcgcagcactttgggaggctgaggtgagaggaccacttgagcccaggagttcaagaccagcctggacaacataatgagacctcatttccattaaaaaaaaaaaaaaaaaaaaagtccaggcgtggtggctcatgcctgtaatcccagcactttgggaggctgaggtgggccaatcatctgaggtcagaagttcaagaccagcccggccaacatggtgaaaccctgtctctacaaaaatagaaaaattaactgggcatggtgccgggtgcctgtaatcccggctacttgggagactgagggaggagaatcacttgaacccaggagatggaggttgcagtgagctgcaatcgcgccattgcacttcagcctgggagacagagcaagtctctgactcaataaataaataaataaataaataaataaataaataaataaaatgtaggctgggcgccacggctcacgcctgtcatcccagcattttgggaggccgtggctggtaggtcagttgagctcaggagtttgcgaccagcctggccaacatggtgaaaccccatccctaccaaaaaatataaaaatcagccagggatggtggtgcaggcctgcaatcccagcgacctgggaggctgaggcaggagaattgcttgaacctgggaggcggaggctgcagtgagctgagatcgcgccattccactccagcctggatgatagagcaggactctgtctcaaannnnnnnnnnnnnnnnnnnnnnnnnnnnnnnnnnnnnnnnnnnnnnnnnnnnnnnnnnnnnnnnnnnnnnnnnnnnnnnnnnnnnggccttgggtttttccgaatccaaggtttctccaatggcctccatctatgatgtccctttactccttttgctctgtaccccatgcccgtacctcttttaccccattggcctctccactctagtattcccattatctccacagtgcaccccagttcccatgcattctctccaagtcccaggaaatcaaaatccctcacaaactagacagcatttgttcccctaaatgacctctgccaggacacacatacacacttagttgtggatgaggtctgcattctgagcccagaaaaccctactttcctctttcccttgattcttcttctttgcctccctgaaaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggtgagtctggaactttatcactatctcaaagcctggtgcctgttctgacagcttgttagtaggccctgaacctccaaaatgcagtcaacatcccctccctgaaaatttataaatttgttaaacccccagatatattgagcccgcaacagctccagggtgagttacagcccacctctgaaacccagttttcatcatagagccactgaagggttggagaataccacacccttagggagaaaattccttcccagtaaaggtaagtgttaaagatagattgccagataaaacacaggatgcccagtggggcagtccagtcttgtattttgaagttgagatacacaatgaataattttttagtgaagtatgctccatgcaatatttgggacataaagataaaaatttaaaaaaattttagaaagaagataaggcagccaggcatggtggctcacacctgtaatcccagcactttgggaggccgaggcaggtgggtcacctgaggtcaggagtttgagaccagcctggccaacatggtgaaacccccatctctactaaaaatacaaaaaattagctgggcgtggtcgtgggttcctgtgatcccaggtactcaggaggctgaggcaggagaatcacttgaacccaggaggtggagttgcagtgagcccagattgtgccactgcactccagcctgggcaacaagagtgaaactctgtctcaaaaaaaaaaaaaaaagaaagaaaaaagaaaaaaggaagaagataaggcaaagaataaaattgaaattttaaaatacagaatatacaattaaatttgagtttcagatgcacaatgaattcttttttaaatatgtcccatgcaatatttgggacattaaaataaaaatacaggatgtccacttaaatttgaatttcagatgcaaatgaataatttttttagtataagtaagtcccaagcaatatttggaggcatatctatactaaaaaagtatttgggtcaagtgtggtagctcacacctgtaatcccagcactttgggatgccaaggcaagaggactgcttgagtccaggagttggagaccagcctgggcaacatggcaagactctgtttctacaaaaaattaaaaagttagctgggtctggtggcgcacacctgtaatcccagctactctggagggtgaggtgggaggatggcttgagcctggaaggtagaggatgcatgaacatgagccatgttcacaccactgcactccagcctgggtgacagagaacccatctaaaaaaaaaaaataaaaatttgttgtgcatctgaaattcaaatttaagtggtatcctatatttgatttgctaaatctggcaaccctagaaagagttaattgagtttttacagccacctcccatttgagccattcttccatttaaagggtcagtctattccctaagaagccccaggtgtggagactgaaacggtccttcaagatatattctagtcaggctccttctccaaagaaagaggagactggagaggggccaggcacaggatggtatagctgaggaagaagggccttctccatttcctttcttcctcctccaccctctctgagtggctgggggagagtggaaatagatgcctgcatggggccgggggcagaagtgtctgtcattggtcctcatataggagcagagtaaaagtgctgagctgctcatatctaactttaggaggccaaaagcactcttctctgcctgggtctggttacactgggtggagcattggggtgtacatggtgggatggccaggagagcctcctgaagaagttggtggggttatttttaggctttgggtttgcatctaatgttgcccttttggccacacttccccccacctgctacagtgtcactgtcaccagtgaggtccaacaggcaccaagaggagagaggaagagaaagaaggagagagaagagagttctgactgttggacaagctgaggaagggagggggcagaatttctctagtccttgtaattaagactgggtgctccatggcaaccccatcctcccaaattttagttggggctggacacagctcatgcctgttatctcagcactttgggaggctgaggcagatggatcacttgagcccaggagtttgagaccagcctgggcacatggcaaaccctgtctctaggaaaaaaaaaaatacaaaatttagctgggtgtggtagcatgccagtagtcccagctacttgagaggctgaggtgggaggattgcctgagccagggaggtggaggttgcagtgagccgagattgtgtcactgcactccaacctgggtgacagagccagattctgtctcaaaaagcaaaagaattttttttcattttttttttttaaagctgggcaggcgtgttggtcttttttgacttgttaaggatgagaaaggggagtgtggagaacacgctgcccttaccctaggtataactggaggaaacgagccaagggagtcctacctcttaagaagagtttaattcgggctgggtgcggtggctaacgcctgtaatcccggcactttgggaggccgaggtgggtggatcatctgaggtcggagtttgagaccagccggaccaacgtgcagaaaccccacctctactaaaaatatatcaaattagccgggtgtgatggtgcatgcctgtaatcccagctactcgggaggctgaggctgggaattgcttgaacctggaaggctgaggttgcggtgagccgagatcgtgccatcacactccagcctgggcaacaagggcgaaactctgtctaaaaaaaaccacaaaaaatcaaacaaacaaaaagaagagtttaattctcttagtcagcccatgtactacccatcaactggagggggaaatatcagaaaattcagggtcttctggttagccactatttctgcctttgctaaacatacctctgtttttgtatattttccatacccattgctaaccttcccctcactttgtcttcttttcaggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggcaagtacactcacccaagagtaatgtgtttggtccctagagcagagttgtacccaggaatgatgtctacgctgagtgtggggagcagaggaggtcagtttaaatatcttaatattaaatataataatatcagtttaaatatcataaatatcttggtgaattacctgggtccaggagtatatagagatgtgtctattctacccagaagccttgtttttcagttactttcctggcttttcggattcagtcacagatctgcccacagactatcattatgccacaaaccttatacaattaccaggatattatatctttagtccctggctcttgcaatttccctagtgtaggggcgtgggattacctttcattggctactaaatgctattatttgactgaattttctctcccatggctaccaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggtaggggtggtgaggaaggaaccagatgcattctagtgtgaggcactgtgtctttagttaggatggagactaattcaaatgtttcagaaggaggctaaggagagatggcagggatatgggggtcctaatcaaaggccctgctcttttcactctatctcagcttcatcatagcagtgtgatgaaggaaaaaatttgctgggaggcaggatttgaattctagctcaatggtcatttattagctgtgtaggcatgggaaaatcactctacctctgagcctgggttgctttgaacgttacacttatttattttttgtcttttttttgcttcctttttgtggagaatggggtctcgctatatcgcccaggcaggtctcgaactcctgggctcaagctatcctcccgcctctgcctacctgagacctgggattacaggggtgagccaccgtgcccggcctgctttgaatgttaaatgcgaataacattttacatgtctgaaggcctcttgaggctctcttccattcaaggttaggatgccattattctccctgtaatatgattctatttccttatacttttttcttttctttctttccttctttttctttgactcagttttgctcttgttgcccaggctggagtgcagtggcatgatctcagctcactgcaacctccgcctcctgggttcaagtgattttcctgcctcagcctccctagtagctggcattataggcacccgccaccacgcccagctaatttttgtatttttagtagagatggggtttcaccatgttgaccaggctggtctcaaactcctgacctcaggtgatctgcccgcctcgggctcccaaagtgctgggattacaggcgtgagccaccatgcctggccaccctgctttagatggctctaagtctctgttcttttggaattaggcttctctagcccatggagaggaggtctgtgtgaaaggatagggaagagctagaaaggtactcttgtatttggtcctaaggagcctggattttccaggcaacaataattactcttagccaggctatccactgtccactagggttggagagagggggtctctatattgcaatttttttttttttttttgagacagagtcttgctctgttgcccaggctgaagtgcagtggtgcagtctcggctcactgcaacctccacctcctgggttcaagcaattcctatacctcagccacctgagtagctgggatgacaggggtgcgccaccatgcccagctaatttttttttggggggggggtgtttgtatttttagtagagatggcgtttcaccacgttgaccaggctagtctcaaactcctggtctcaagtgatccacccaccttggcctcccaaaatgctgggattacaggcgtgagccaccgcaccgcacctggcctttctacattgtcatgtaaggtgacctcaggcccttgggtctatagtatttggggtcactttctctgaaatgctggtctgggtcacagctatccaagagtctctagtacacactagactccttttctcattattagctttggggaaacaagctaaccaggaaggcaaaatgggatgctaaggaagaagaaggagtacagatgcaatcccaaactagaattcacagacttccctattctcaaagagggtagcatctcatgataaggctctgtttcttttattctgattcttaattaaataatgtgtccccttctcaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaactcattcttcctttgatatttgagagcagatgaaagccgaggctaacaatgcacagagactaattaaagccaaatactaaacattaattatgcaaactttaagacagatctgagctccagttgcttacacacctacacccatacgcacaaaaccacattcatagttacttacaaagacgtttattcaatagtacatgagacaaataatcacgcacaaacacatgtgccggcccaaatgttggcaaagctaaaaagctgctgtgcaccgcagttgggaaatgggtgttggtgaccctggtgttcacccgctttatgtagttgattagaagctggtataatcagggttatcctgattgtcacagactagagcatgccataaagtttccagattataccaaagtgggtttaggaatataagtgtcaaagattacacattcccaaaaggatgaaatagaatagggggccatgtggaatccagaaggaaatgggagaaaccagctacagttatagtatgccaggctctgtgttgaacacagcaagaaaagatctaagggttacaagggcactacagtggtacctagaaagcagtatggttgggaagaaatcttaagagcccgataggaatgcgcaacaatattctttttgctcattacaaggatggggactctctaagagtcccaggcctactgccatgttccacaaagtaagactaatgcagatcagaaagaatgaaaagatggcaataagatctgagaaaataacttctaaggagagctggctgaattcagtcaactccatgagctgctaatggttagattaagtttgccagaatctgcattagatggatcatattttagtgcaccttgggtcaaatggcatttaccctggtcatcttcacttataatctaatgagcaaattccagagaattcataccccctctaagcatttttttttttttttgagatagggtctcactctgtcgcccagactggagtgcagtgaagtggtgcaatcttagctcactgcggtctccacctctcaggtgcaagtgatcctcccacttcagacccccaagtaggtggcactacaggagctcgccaccacgcctggctaattttctgtatttttttgtagagatggggttttgccatgttgcccaggctggtcctgaactcctgagctcaagcaatctgcctgcctcggcctctcaaagtgctaggattacaggcggagccaccgtgcctggcctacctcctttaaacgtgtatacaaaactttgtaccttttccttttttttttttttttaaatggagtctcgctctgtcacccaggctggagtgcagtggcgcgtctcggcttactgcagtctctgcctcctgggttcaagcgattctcctgctccagcctcccgagtagctgggattgcaggcacccatcaccatgcccatctaattttttgtatttttagtagagacggggtttcaccatgttggccaggctggtcttgacctcttgaccttgtgatccacccacctcagcctcctaaaagcgctgggcttacaagcgtgagccaccacacctgcccctctgtactttttcctaaggagagggttgtcatagtttgtattctcccacccaccctaaacagaccctgaaagaaagatttggatgcaagaccagttcatttgggatatgatcccaagaaatcacaaacggggctggaaggatccgcgcaggcgaaattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14014 - DNA, 8896 bp, Human
tctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccggcccgggtgctgtcaggctcacacgtgtgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgatttgcccaaaatcacactacaaggacacagcagggctgagatttgaacccaggcagtggcttcagagcctgagctgtttcctactgcagagggaggaggcaagacttctacccgtagccagatggggaggcatgggcacaggaacggctcttgggtgaagtggagggaggaagaggaggactgaaggcgaaggccacgtcaggagtgatgggataccccacaaaggcctccctgagaagcgctagagacaaagatgagtgcctcctcatctggaagatgaaaagatgtctttgcctgcatgggctgctgtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagtatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgcccagtcttgcgggtgccatcccttctctttgaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcaggggtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgaggtgggttcagaagctcctatgcatctgcttcccaaggtctattctgttctattctttctattctactctaccccatttcattccattccattccactcaactccactccactccactccactccagttcactctattcaattccactccactccactccagttcactttattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattcctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctggtggcctggtgatgcctggtgtctcccctgcagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactgttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctgtggaggagagatgaccaggagcagaaacttcattcagggacatctcaggcaccagctcccccatgagccagctaagttccctccctcccttcaccaagcaccatgtgtttcctcatgtgccgaatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccaaagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttatgaaggggccccttcatggggtcatgcactcctgtgtgttttcccttgcatcatgccttgcctgtcttggcaaatatttctctggagtttacccagccagtccaaggtcacagggaagccctgtctgtgtctcacacagaaggtcaacgtccagcactgtccaaactttactcagcaaacagtcacaaagcagctcctgtgtggggggtcaggggtgg

SEQ ID NO: 14015 - DNA, 13214 bp, Human
ttaggggcctctgtcttagtaagaaggaggccaaggctctgtcgtctagaggcattgcagttaccacagatcgcatgctcctcttgtgccaggcacctgctgggcgctctatgcacgctaggtcattcagtcctcaccacggctgagaagtgagtagaatgattcccattttactgatgaggcacctgaggctcagggaagtaactgagagttgcccctgttgctggaaagtagtggcttgggaattggaatgccggcctaactccaaagcccacactcttaaaaccactgcgctgggtggctgctcctgccgcgggctctctgctcccagactaacctgtctcgcttttcccctccgctgcggccactccctgaacctcagaagaggaggactggagagaggacgaagacggtagtacagcctttccttctgtggtgctttctgctgcctgctgtcccgagtgcagcctccttgtccaggggccctgttctgggggctggggggtgtgagtaggcggcagggacggagtgggtcagtcgtttcctcccctgcctcccaggggccaggatcacagttccaagctgatcatcatgcctgaacttcagggccactggctcctcttcctggttcctggatccttcccctgggttgggtggtgggagggaccaaggctagctggtctcccaagctgctccaaatgtggccatagaggggacctggcacctggaagacagcagcgccaccctgcccccgcgcacaccccagtgtcccatgctgggccctccttaggagctggacagcaccaagcagggtggccaggtgttggttggggggtctggggacagagtcctctggagagcagccagggagactggaaatagccagagcaggaaggacatgacgtcagccttcagatgcgccctgctgatggggagcacaggaccaaggcaagggagtgagaccagggcttaattttagaaagtgcgttctgacagctatatctcaagatgcagtaggtgggttggggaggcagtaagctccccatccttgggatgttgcatggccactgggtgggctggggtatattatatagagaaatgacacgtcagatgaggtggcagaggtgtgaacaagatggcctaaaggtagaccccacaatggccatgtccttcctcgctagccctctgctttcacactttctagaaggatcattttgaggtaagactcctgcagggatcaaataaaaggcatctccaggcttcagagaggactcagacctgggaagggaggacagagggaatgaaggccaacccttctcccacgatggtgtcttcctcctgtctgaggtttttcttctccctctgccaagaggcacccacttcccagtgcatcagtgaacaggcatcacagaacacttcctacaggcacagcccaggccaggcggcatcctgtctcccttatctgtttgtctgtctgtctacaccaagtgcctgagtgagatgggggccacatcctgccaaacaaatagatgaaaatagaaaaatcctgcccactttctggatagtacgaagatccagatattgagtgtgccatccagccacacagtcgtactcttttggtttctttgagatgtggattgagggtgtctagagtcactaggttcaggacaggagcttctggacacctcggcttaagcagagcatgttctgtggtgccagacacggggtggaacttctgggctggaaagttggggaatgaggtggagtcccatcatcagggaggttgccgggatgagtggggctaagctgggtggcgggaggtagccgacagtcaaaaccaagaatggcagccccccagcacgttggttgcccccaaattcatctggacctagacgtcttgacccccatccccactccccgctgcccattctctgctctgggttctgcctgatagcatgagtggggcctgcttcttcactctgtctgcttcacttctccagagcaggaggaggcagcggaagaggatgctgaagcagaggctgagaccgaggagaccagggcagaaggtaagtctctggttgagggtgcaggggcctcagggggtggcgagagcccctggagccattcctgaggcagtaagaaaccccccagaacaggctttcccatgtgcacctgactctcctatcgactaagattcaaccattgattgcccaatcaacaaacgttgacccagcgcttctcttgtgtcaggcagtcttgggtccaggggaatgtgtgtgtgagagacagctctgtaaccccaaaaaccaacagagtgcatcttggctagggcttatctgtggggaaggctcttgctggtggcggagggggggacttgagctcagaacaaggaccttgattgatttctcgtgtttcatttagaagatgaagaagaagaggaagcaaaggaggctgaaggtaaggatatcaggagagaggtacaagggaggcaaaggaacccctcacagcagctttggaggagaatgcccacagtgctctttccagggaagtggatgtgcactgagagggtttgggagaggagaggacagaacttggtggcacttccaaagttttagatgttgagctttcaactttgccccttctcccagagaagttgcattggtggcacccagtgggagaggggaccattgtccagccccctggtctggacagagcaatgggacccagaagtcatatccacacatgaagctcctagagcttaggtgaaatcacttgtaggatgtggtgtccgtaggatgaaatcccaatgcatagatggtcatggtgggtcattgctgcagtcatcgtcatgctgcagccttcaccagggttctaagtggtcccagtcacttctccaaaggggaggggacaaccagctggggcttggaatcatgtcatcagcttctgccctgtggccaccgggaagtccaaggggtaacaaagaaggcaaagacctgggaggggattctagggccaggacccttggggacctttccaaaggccttgtcactgtgaagcacaagagaagcaaaattgctttgcccagaactggtgagtgagagaaggctttgtgtgaagttccacactgcgtgagtgtgtgccctgcagaactctatgggagggggagtgtggcatctgcagcccccgctgccttcattctcctggatgcttctggaatcagggctccccagtgccgggagggactcactgtgcagatggggaaatggaaatccacagggatctagctcatcgagggcggagttgggaccacttctggggccccctgacccatggctgtgtgcttctatctcctccagatggcccaatggaggagtccaaaccaaagcccaggtgagtggggaggcacctgggtagagccgggagcagaggctcagggagagaggatgatgatggaacagggtgcagtatggtgcagtggacacgggctgggggtttggtgggcacagagcaccacagtacagttgtacaagttgtgtactgcacaagcgtctcttcctaagggagtgagtgagggctgaattccacccaacactccatcaccaatcgtgcaccctagcagggatggggctatgttcttctagaggaagggccctgaacggacactctcctctctcacagtatggccagaacaccctcctccatggccgaggtgggaccttgggattaagggaagcaaattgtggggagccaaacaatgaaaccgtgccagcataggcatggcggcttcagagagctgagagagggcaggacggcttggtgccacacacgtgaagcccacctgaaggtggtgtgtgctggggggggctgggggatagggagcatttccctttttatgatgccaaccctgccagcagaggttgacccatggcacctctgcccactcacaggctcttcccatttcagtggggccttctgaaaccagcccaagacatcccagatccatttatttgcccagtgccttcccccttcctggcctcttgtgcactgcggtatctcatttcagctccacacacctgagggcagatggggacatgaagaatcagagaaccccctgggtctcagtatgtgttgggaccaggaccaaactgcaagactcccaggttcatggccagtttctgcggggtccaccaggggatttgaagtccaagaagcatggcatcttgtcacagcttctttgattccaagttgtgtggctttgagcaagtcattctacctccctgagcctcagttctcctaagtgagattaacggtacccacttcatgggcatatcatgagcatgaagtgaaatagcatatgtgaaagagctttgtgtattcccaggtgctgagcaaggctgaggactgccattgttgacgtcagtgttactatcattgctgtggttggtcggggcagtgctggaagattctctaggaaggatcagggccctgcctgtcctggacaccctcagtccctgggtccagaatggggctgatgctgactattcctctctccaacaggtcgttcatgcccaacttggtgcctcccaagatccccgatggagagagagtggactttgatgtaagcggtggctgtgggttgagtaggcctgggctggggatagtcccaagggccctcagtgacagagattttgtgaccttgggctggggtagagcataggtgggatggggtgcagcaccagccaggctgggtgcccatccatgagcgtggtcctgggttcaggccacagttaccccttccctggccaggcgccaggccctgccagaggtcttttgcactgcgttggggggtgtctagcccacccatctctcctctggactctttggagtggcagcctctgagccgcagcggtccacccacaggacatccaccggaagcgcatggagaaggacctgaatgagttgcaggcgctgatcgaggctcactttgagaacaggaagaaagaggaggaggagctcgtttctctcaaagacaggatcgtaggtgtccagtctgcccacctaacattctctgatggcccagtctgtcctccatcccttttgtgaggccccacctcctccagacagccttcctcggcgcctcaaacccagctaggtgtgaggtctccttcagaggccctccagcattctgcacagctcctgcagccctgactggtttctcgggtccctgccttccctccccatcctactggatgctccttgactgccagagctgagtctgatctgtttcaggcctcccccagggcctaattcaggcccgggctgtggactgattggtcacaggcctgctgcgccacccctgcccttgcctcctcttcccccgcagatgaaggggagtgtgacctgcagaatcccacatccttctcctgcagagcgtggaggctgctttgattgcttttgtttctccccatcaaacttgccttcccacagacatgctgctctggctggagcaatgacttggccatctatccaagcatatggcacagagcagctgccagggcagggtgggatggaggtgggggcagagcccagaaggagcctgcctgatgtctcccagttgtggagggcagtctcaccatgaggaatgttggaggtgggtcactgcaggtaccctggtgtgcacgtccgtggagctggttgaaagtggaggcccttggaggccgggcaccattgcttcaagactctggaaggaaccctcccccaggaattcccttgccaccccatgcaggtttctgtacctgcgatgtcaccttctccctatgcacacctgggtgggctttgcctcttctccttaggagagacgtcgggcagagcgggccgagcagcagcgcatccggaatgagcgggagaaggagcggcagaaccgcctggctgtgagtgacccctagcccaggcccatggaggccccccatgctcccagctcctgctgggcccccaggcccctctctattcatcaacatgaatgaaatcagtcaagagacaatattggccgggtgcggtggctcacgcctgtaatcccagcactttgggaggccaaggcgggtagatcacttgaggttgggagttcgagaccatcctgaccaacggagaaaccctgtctctactaaaaatacaaaattagccaggcgtggtggcacatgccggtcatcctagctactcaggaggctgaggcaggagaatcgcttgaacccaggaggcaaggttgcagtgagccgaggtcatgccattgcactctagcctgggcaacaagagtgaaactccaactcaaaaaaaaaaaaaaaggaaaaaaaagagacaatatcaatatcaacctaggaagtgctgggcattgtcttggctctgataatacatcagcaaacaagacagaaatgcctgcgtccttatgaacgtgttattttataagactctccagccctcatcccttccccagtgcagacttcgtgggaaccgaaggccccgtagctctcttcctgtgcagctgctgaaggcatttccagagcaacaggtcttccaggggcactcccagcttaaggggatgacgagacctcacatttgggaatcaggacctcattcaatcacgcagtcatttctcagtcagtggactcctgtgggccagcactgtgctgggagctaccctctcagaaagctccttgctgagcggagagaaagctgaactcacccataaagaccacaagcttcagcccagaatcagggtttccaatcctttcccctaatttgctttcttcctccctgctgtaaatcaggaagagagggctcgacgagaggaggaggagaacaggaggaaggctgaggatgaggcccggaagaagaaggctttgtccaacatgatgcattttgggggttacatccagaaggtaggtagggagcagcaggggttgccaggagatcctagtatagccctgaggaatgaggtgtccactgcagcaggtagactttaggtcaggtcccaggaagagattcccagctgctgtgggtggaagactgaggtctcctcatgcccagccctgagctggttttcagcctgaccgcggcttgcactaggaggggcttgctggggtagggggctacaggcagagcctggggcaccaatggtgccccccatgcctggctccagcagtgctcaggagcccccaaggaggctgggtgcagctggaagagccttgtgcctagagtcagagctctagttggagacccagctctgccacatacagttgtgtgaccttttgcaacctctgagcctcggtttcctcaactggcactcatattgcctgccttgatgctttgagaagctcaaatgagctaccatggaaagtgtctatgtgccacacagatgtgaggttgtttgttcctggaaactcactctcgatccctaacttttgtgccccattcctcctaggtcctccattctcgagggaggagggatatgtgaaattgattttctctaggtagtgaaggaatcaaaacattttcttagatttccagcttagtccctagctcaggactaggccaccccctgcctctgcccccatggtgaccacaccagccaagactttggcatcaaagtcttcatgctaccgaacagcccctgctgtaaccctcagacccacgtcctagtaaacccggctgactacagcgagtatctgaatcttctcttccatgtctctccttgcctttgtcttcctgccttctctctgtgtctctgttgccgtcttggtctttttctatgggcctctctctcatggtttcccggtttagcaggcccaggtgggtaccaaaaacctcaagccttcttcctccccatagttttggagagctccctgggaggggaaggcgccttgctggaggggaggagtgaagagattgggctggctggggaggggggaagctggtgagaggtgaaagagattagttaggcaaagaaggaagagactgacgtgatccttcttgcccctacctcagtttccctagggaatacatgtagttggtagttggggggtgtggcaggaagaagagcataagaacctggccctcctgcaggccttgctccacccccagggggtttggggagggttaggggacagggagggggcaatctggccagtttactctgcttcccacaccctccagacagagcggaaaagtgggaagaggcagactgagcgggaaaagaagaagaagattctggctgagaggaggaaggtgctggccattgaccacctgaatgaagatcagctgaggtgggggctgggaggaatggtcctggggcactgcccgcatctgctctgggaggggtcgggccaagggcacttcttgctgtgagccaccagagggcaggactgcctcacatattttcccatggcaagtttggtgggaccagagctgggccccagcaggtcgggccaactcctttctgggctttgctgatggggaaagagaactgagcaggtgccccacccctctgagcttcacctacccacctgcacacgggtgtcaggacaggggattgaactagatgctctcctgcgccagaagggcttctcctgctccccgcttgttcttggaactttgccctggcagtccctggtgtccgttcctgagcactgggtgctgccgtctggtccccaggctgggtcaggcccagggggtgggctggggtacccttggcaggcctggaggtgggaaggagggctgggatgctgggggctgggccgggaccaggacggaggcccaggagggccctttcttactggacctccccattctcacccttgcccgtgcagggagaaggccaaggagctgtggcagagcatctataacttggaggcagagaagttcgacctgcaggagaagttcaagcagcagaaatatgaggtgggccgccatgctgtccccgcccagcatctccatctcacactcctcctggttcactgggtccggtaatactgctgcaggtccctgggtccctgtccctattccccaacagcccccttcagctcctgcatctgcccctgctgcctggccttcagcagtgttccatgtccaccgcattgacgactgcttgctggaagtgtctgagagctcgctggggctgagcagagacactttcctggtgttccaaccctgggggtctccaacacgttgaggcagcagctcagtgatctgagctggttacaaggaccaggatgcaccaagccaggacccccagtggaaggggagtgctgccaacagagaggtgcttctccccacatacacccaaggtcctggtgtgggcacaattaggctgagcctcaagctcacagtctttcggagtcctatgtgcactaatgagggtcttaggtgaacagacaccaggcaaggaaatggcttagaggacactgatgctgcataccggagcttagacctgggcgccagtccttccttacccaccacccccgagccccggtcccagggcctctttgctacctaagggaagaattcagcttcccctggaaggtctcctttgctgctcctgccaaaccactcctccctgggcaagaagcccctcgctgggcaggctcaggctgcagtggctacagggtactcccacctcccaatacggagagaggctgtattgcctggtgacagtggcatggactttggagccataatgcctgggttgaatttctacctgtgcccctcactggctgtgtgacattgggtgagttagtccactgttccttgcctccatttccacaggtaacactacaatatacttcagagggtgattgtgagggttacagagataatactaattgttattattgctatagtgttccaaccactgttccaagcatgtcccatgtattaacttactatgccctcatagcagccctatgggttcatatctgggaaggtgctcaggacagagcctggcacccactaaatgctcagcaggtgtcagccattgttatggcctctctagtcctgtgccttccacttttttctctttttttggttccacactgaactctgcaccggccaacaggacacagatttgccaaactttggggcagcaccctgcaggggtggtgcatggggatgctactgctcaaagggcacagcttccgggatggtgggcagctgggcaggggtgccccagaggggtctggggctgggctgctaggagggctccatgacacagcctccagctttgtgcccagctctcagaggcccttcttatgggactctcatatcctgaacctattatggccctgggaccccacagtgggaggcccatgaggcatcctggaagcttctccttggcttctgcctgtggtacacgggcccctcctgacccttaactatcctaacccctcctactcttccatgctcctccttctcctcctgcactgctgcactcagcccccttctccccatccccaggccacctgggacctgagccagtcagctccagcgttgctctttgtccttcccacttttcttgcagatcaatgttctccgaaacaggatcaacgataaccagaaagtgtaagtgtctgaggtcattctcgcctagccctccccctgccccctccttccctaccttccagctatcccattcctccttggagggccccaggctcccagcccttcctcctctgcttcagcccacaggtttccttctctggctcctccggggcctcgtgcttctctccctgtggcctctgcttgctggtgggggtgaaatgtggggcggagaagcttccctccagcctcaggctgctgtcctattctgcccctggaggcagctccagcctgctcctctcccctttggcaccccagtcctaccccagccgcatggtgacctactaccctgcctgtgtctccatgtcactgcgtcctgcttcccctgcagctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggcatttctgtcacgtccccttcagagagagagagaaactgaggcgagaccctgctctcacaggtccccggtgtctgccaagctctaaggagctttcccctgtctggtctccctgcttgcctctagctggggagagggtggagggcccagggtgcagcccaggaggcaggagcagtggaaagggcttcagatcattgctcctgggagtcaccaaaacagcacatgggaaaagtgctgttgagggggacagagtgttccctgcatgagtcactcactggagaacaatgcaggactcttcggatggttcccgttctctttctcctcctagccagggccctaggaaccaggtgtctgagggacagggagctcttgaggaaggaaggaaggccagttttattgggcagctattcaggcctgagttgttgagaggtgtgggttagtctgggtgcctcagtttccccctcccatgatctgcacatcctcgagggcttaagtcacagggtcctgagctgaagaggacagcttggtggcatggatttcagttggcagaaagacaaggaaacgatgagagggcaccatcctcctctccagaggagagcctgagacgacacattctcttgaccctccattcctttgtcaggcgtggaatttcccccaattcctgattccttcccttggctccccacttgccatccatcagcaagtgcctcatgagctgtgtctggaaaggcttcctgtggtctcccagccagagcaaatccatttctgcttgctagagcatgtgctgtcacagctatgccatccaatgccacactctgttagacgggtctcttcctgcaggcgtggctctcatgctcccaggagacaatgcagacatgttatcctgtgctgtatgccaagcactgggatccatgtagtgagagatgaagaggaaatggtccttgggccacagggaggggcttagcctggggtctcggcctcatttcttattcattcattcgttcagtcattcaaatacctcctgagcaccaactatgtgctagacactgtgttgggtgtggggtgctgtgatttaagccagcacatcgctcatggagctcacagagctcacatccagcagcagggagacagcaagcagaggtcccagccctgggtgacaggggcgggtggggggtgcgatgctggggagaggcatagccacgcaccacacctggccctggcaggtgggaaggctttctggaggaaagagtgtctaggccgagtaccagagggtgaggagggggaagtcaaggggaagaggttgggggtggggctgggaacggcacatagaaagtttgagaagcaagagccagcatggtgtgtttgaagagatatagttattagcagaatccaagcatcttctggtggggacaagaaggctccatcataaatgcccccaaaatggacagggaggcaggacgcaggcctcaggcccaaggagggctgtcaccacgggctctgggagacccactggcagctcctggcacgcaccagccctactatctcagtttgccggataggacagctggggcagtgccctagcccctctccccataaaggggcactgcacctctacccccacctgccgccttggctccaccgcctatgcctcagtgtctccttggtgcaacaagaggtcatgatgggccgtgtgtctggggccctgtctcctgctccccctctcccagcagggtccttgtgaccatttctctagtacagcggtccccaacctttttggcaccaaggaccagtttcttggaagactatttttccatggacaggggtggggtggggaagaaaagtaggggtgggtgggtgggggtggtttcaggatgaaactattccacttcagatcgtcaggcaatagattctcgtaaggagtatgcaccctagatccctcgcatgcacagttcacaataggtttcacactcctatgagaatctaatgctgctggctgct

SEQ ID NO: 14016 - DNA, 40625 bp, Human
tcattgctatataaaatttcacttacagtctaaccattctactgttgatggatatttggtttccagtttgggggttattatgaatagtgctactatcaacattctattaatgtattttggtgtatgtatgcgtgaatttctttggacatttttgtgttttttaaatccacagtcagtgaaccctaagtgttcctcagcattgcagtcagtatatttaccatgtatgcgttactcaaatgacagctgtagttgcaggcattaccaaatccttccctccttaatgttatcactggactttgtctatacttgggattcttaacatgttgtattttggttaagtatgcgtattcatgttttttattagattttgagtgctttttagtactttgttttacttgcttatgtatcccgactcctgacgaggtacctgaaatatagtaagctagttgagcgaatggtgatagctgtcaccattgccagtgattaacagagcaagtttccctagttatgtgaatcacttagcctagagtaaaatccatgctttagtttgatatctcagtgtcaaaggattaggaatgggaagtcatttctctctgagagaagcccagaactgtgggctcagaactgaatgtgctgtgtggctaaagggaattgctatggctttacaagcctcttggagatttaaagtgttaacagcagtgattccaaggcatagtgtgggggggccagatataaatagcagaacacaagtagcgtagtgtgccactgccaagctactgctgggggtgtttataaaaagaaaagcattcctgtctcagctctcactgtcaacaacatcccatcctgaagacttgcttaccacaactgagagtggggagtcagtttgaggcctagcatcacttaaacttcctccaaaggcacaaaagccaggtaaaccttttgacttatttacactcagactaaagaaatgaacaatttttaggaaaatcctgatcaaagcttgcttaaaacatattgccttgtgacagatatctatcatcttatattcaaatcttttttggaaagagaagtttaacacaaagtagcatgttggtactatattttagtatttttagtaaaaacaaaacaaaactgcttctgaagaaatatgggaaactgaggccaaaatgatctataaaagggaagacttctcccttcccctgtgctgttcattctcatttttagaatccagaatatggtgattggtagggtaaaatagaagcttcatttgagttacattatcataaatactgggatgaatattaggcattcggccaatagttgtataatcttagaattgctgcctacccagttccttcttattcttgttcccgccttcagaaagttatgtaagacacttattttaccctcgggcttctcttgattgtatttgggggaagggggccatctctgacaatccactgctttgtaccactactgacctcatcatctcctctgtcccactcaaaagggcatgacaatgtgcaaagaggatagaagaatggataatgtgcatggacatattcctggggaattcttagaaactgggagctaggggaccaatttgagactgctgttttttagtctgattgtgttatttcctgtgcacgctgaggggagatttagagatgggaagaaaatatgactcccagtgactgtggtgggagagatgacatgtctggaggagtatggaaatgcacagatttaatcttgagcaaatcactgaaattctaaggtgtttttgtttcctcgtctgtagaatgagagcattagaccactagataaagcctaatggctcttgtagcccgttaggaatttattgataatcacttcctgaccatcatgctatccactcacattctaaatgaaaaaatacacagtgtcatcctattctacttccctacacctcttttttgagtctactgaattgaaatttctttattttaatttagaagagaaaaatgaagacgggacattttgaaatagtcaccatgctgctggcaaccatgattctagtggacattttccaggtaatgttgggaatgggaagcatgtggtcattggaatggaaattcgtttttttttttttttgagacggagtctctctctgtcgcccagactgctggagtgcagtggctcgatttcggctcactgcaagctccgcctcccaggttcatgccattttcctgcctcagcctccccagtagctaggactacaggcgcctgccaccacgcctggctaattttttgtatttttggtagagacgggttttcaccatgttagccaggatggtctcgatctcctgacctcatgatccgcccacctcgacctcccaaagtgctgggattacaggcgtgagccaccgcgcttggcctggaatggaaattcttgatataacattacctgaggcatctgtgtggcttgatggtggaaatgaaagtaggtaggataggtaaattaattataagtagctcttttcattttaaatatgtgacagattaactgtaaaaagttgaaaaaattaaaattaagcaaaaagaggaaagtaaagattattcataattcctccactcagagggaatgattcccaacctgttggtgtatacaggcttcttggcttttttctatgtgtatactgtttttaatttacaaaaatgggttcacactgtacatagaattttttctttgcattttaagttaatactatgctgcatgtcacgcatgtcatcagatattctgaatatatgtttttctccaaataagataatgctgcattgtttgattacatgttttttaattaatgaccattttcccacattttttttctggcagaacttttatgattttatttgcaattgactctttaagcatcctgtaacatatttttatgtaaaatataatatttcacttgattttttttccccacgttgttagctgccacattacttgtgggtatttgtgcaccattttagatgcctttttaaaaatatcttaaattcttaaactgttatccttttttgaatttaatattctaatccattttctatagaatcattgtgtatcctgtttcctgtgtcgcagtatgttttttattgaaatataatttacataccataaaaattcaccatttttagctgtatacttcagtggtttcagtatattcattatgttctgcaaccatcaccactatctgattgcaaaacatttccgtcaacccaaaaagaaaccctgtacttattagcagtcagccccaattttctccatcccccattccctggcaaccactgtctactttctgtgtctatggttttgcctattctggatatttcgcctaaatggaatcatacaatatgtgaccttttgtgtctggcttctttcacttagcataatgttctcaggagtcctatcagtacttcattctttcttatagccgagtaatattctattttatggccgtaccgcatcttgtttatccatttatcagctgatggacatttgggctgtttccactttatggctattacgaatagtggtgttgtgaacatttatgtacaagtttttatgtgaacatgtgttttatttttctttttaaaaaattttctaatcatatagtcttgacatattgagatactacaaacactatttggttatttggtagcattacagagtaaagtttacttatatataggaaatatatatgtaagaatgaatttgggggttatgatttatgattcatagcaaaattacctattgttgtgaacatgtttcacttctcttgggtgtacacctagtagtggaattgctgggttgtacggtaattttatgttaacttttttaggaactgccaaactttttcacactagctgcatggtattacaatcccaccagcagtatattaggattctaatatctctgcatccttgtgttacatgttacttggtttttcatcatttatagccatcgtagaggatatgaagtggtatttcattgtggttttgatttggttttcaatatactcttgcaacataatttaagtgtatttgttctgtaattgtttcatgatttgcttagccagtttctctccttgacctttaggtcatttccatatttttgtaagaaatttttggtaattgaatttcattagtatgggctttttttctcggtggttatatcagagaaatataatcagcttgttcacctagccttttgtacctgttttttagtatctgttcagttgtccctgaatagtggtggcatttatgaactttgtcactgctcaaggcacgcaccatacaaaatacacaatcagctatggtgtctggccagaaagacttgatgtctaaaattagacatttggagactggttagaggcatagggaaaagacaggaacatagtagatcaactctgatataatgtaaggaatgtgggaggtgttttcagggtctggtgtcttatacggtgttgaagtcttgaagataaatcaggcattggcacccaagctgcactctggtacattctgtgctgtggaggaaagtgcatttcttggctatgagatggcagtgatttgatctcctgaagctcaaattcccatgtcaggaaactgacctacaaacccaggactacgggggtcttaatgacttccatggcagaattctctgtggctagtaatcaagatagtttctgaagctggcacaattccctcgtttgtaaaatggtgttaattattttttgtttaaccttttataaatgttgtaatgaggacagaattacactctttttcaagtgctacataaatgtccatggtcttcataattggaaacattctgattctttagaggcaacagaacagtttggttaagaggacaagacggccgggcacggtggctcacgcctgtaatcccagcactttgggaggccgagaaaggcagatcacgagttcgggagatcgagaccatcctggctaacatggtgaaaccccgtctctactaaaaatacagaaaaattagccgggcgtggtggcgggcgtctgtagtcccagctactggggaggctgaagcgggagaatggcgtgaacccggcaggcggagcttgcagtgagccgaaatagtgccactgcactccagcctgggcggcagagcgagactccgtctaaaaaacaaaaaaaggacaagactctggaattagactgcctgagatcaaattccaattccatgtaagtctcaatctcttagtttcctcatctttgttaaaaaaaaaaaaaaaaaaaaaggcggggggctaataatagtacctacctcacaaggttgccgaacacttagtgcctggcatatagaaagaactctggagatgtttgttaaacttggtgatagagtgtccacccagtgtgtctgagaaggaaatatgtaggaaaagttcacaaatgaaaaatggttttaaataagaaccaggtcgttgtggctgtacgattgtaagtttcgtcttagacatgttacgtatgaaggttctttgaacattcaagtggaggtgttaagtaggcagataaatttgatatataggactggcacttacaggatagatcagatatatttagatcataattgaaactgtaagcatgtatataactgcctggggagcgtagagttgagagttagaaaatacgtagccttgaggaactccaacatttaatggctaactggaatatgttgggtctgcaaaagagtctaagaagaaatgctcccttaagtgagagctgtttgggtggagaaatgggtgggaagccataatggggagggttgagctatacgtgggaaatgaagtggagatggcaaggacagacatctctttcaagatgtttgttcgtgagggagagaagagagatgggaaaggagatacctagagcaggatatggaagcaagttttgttttgcgtttacaagttagtatctctgtctctctctctctgtctctctctctttcactctctctctctctcacacacacacacacacacacagagagagagagagagagtttttaagtatcattcacatagaacctgtaactttttttttgaatctgtaactttaacagcttctagctaaatatgtctataaagtctccaactgaggtccctaagcagacttatgcaactatgcaccatacaagtatagactaatggaagaggcattatccttttatttgtagaaactcataaatggtattcctggggagatttgatcatcttattttttgatccataagccagagtacagggttctaatgtagttcacttgaatattttgccaggttctgtgctaggtgtgtaggattcaaagataaaaacgatacagatcgtacccttaaggatctaacagtataatacatatattcctagcatgaaataatacaaaaaaaccacatcacactggagaaagaccttatgaaaaaataataataaccacggcatgttaaagacttgatatgtgccaggcatggggcagagggctttgcatatgttcattacataatttaattctcacagccatcccacagttaaatactatttcctccactttgtcttccttttttaatttattttttattttttgagatggagttttgctcttttgcccaggctggagtgctgtggtgcagtctccgctccctgcaacctccgccttctggtttcaagcgattctcctgcctcagcttcctaagtagctgggattacaggcgcctgccactacgctcagctaatttttgtatttttagtagagatggggtttcatcatgttagccaggctggtcttgaactcctgacctcatgatctgcccgcctcggcctcccagagtgctgggattacagacatgagccactgcacctggccttttatcctaattttttttaaaattgaaaacttgaggattagaaatgtcaagtaactttcccatacctagttagtaacaaatgggatttgaactctgatctgcctggcttcaaagtggtgttaattacattacaccaccctgcttcttatgttatgtgaacatatgtatatgtataatttagttgtatgtggtattatgcctcttcagttgtatgtgactgaaatacagttcaaactagctgaagcaaacagggaatttattgattcttacaactggtgaagagtacagttaggcccagcgtctaaagtatgttttcgggtcctcatctctacctctcagctcagcaagccttatttgttgctttattttaagacagaattctccatgggactaaagaataactgttggaagccctaggccaatattatccttagagcttacagctttagaggaagaaagatccatttttttcctctgggagctctgattgctagactttagatcacctgcttatccaggaggtgcaaaatcatttctacccaggccatatggacaagggagggggcaaccccaaaggaaaagggtaatgtttgtcattatgtgttatagatcatgaataatattttgcatatgatacttcaaattcccaacagccttgaagggttgaagaaatctagctaagatgttcaaagccaggactgccacccatttctttagcttcacatccattgttctttgctctgtgccataatgtccagataaatgagctacaggcacaatctcacccatacctctcacccactgacatttactctttcacacaaatatggcacagctgagaaaagttatcaatagcaatggaatatacttcctgcataaaaacctacccaaaattggttataagtcaggcgagaattttggcaagggatgagaaggtgggggtaataatgtgagagaaaatgatattcactgaatttcttatttcaagagtattaatttctttttcctttgaaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggtaagtgtctgctctgtctgtgcttggctgggagggaaggagtgggattcttaggcttagggaaaggtcagtgaaaggagagtgagaggtgtttgaaaggtgaaatgacattccgtctagcttctttcatactatctctttacccatagttaattttatgaaaattgtacatttacagtattattaaaagttaaaaaaaattagcactataaggcagtggttcttaaccaaaggcagttttgccctgcagggtcatttggcaatggtcagaaacatttttggttgtcacagttggggaaaagggggattgctactgacatctaatgggtagaggccagaaacactgatagacaatgcataggacagccccacacaacaaagaattatatggcccaaaatgttggtagtgctgatgttgagagaccctactataaggcttacaataaataaatagtgcagcctgggaaacatagggagaccaccatttctactaaaataaaaataaattaaaaattagccaggcatggtggcacatgcctgtggtcccagctgcatgggaggctgaagtgggaggattgcttgagcccaagaagtccaggctgtagtgagctgtaatcacaccactgcactgcagtcttgcagcagagcaagaccctgtctcaaaaaagaagaaaaagaaaaatagcagtcgccagccccacctttcctcaatttccactcctcagtggcatccagttttcattcttttagctatttcttcaggtgcttactgtcatgtttccaagtaaataacatgcttcaacatgttatttcttggtttttaaatctttagacatcatgtattgacttcctactacagagaatgagtatgtaaccctcatctaccgtgtattagttaagaattttttatgtgttcagctgtaaataacagaaaacctgactgagctttcatttaataagtcttagaggcaggctgttcagagtcagcgcagtggctcatccatgtcatgtcactcatgctctttctttctgttccaccatccttaccatgttttgtttgttgattcatgtttgcacttgtgactgttgcagctctaggcatcaatccatgtccaagacaaaaagaaagtaaaggggatgacagccaaatctacttgttcagtaaggaaagtaaaagttttcccagaaacccttactaaactcctgattacaggtcattgacttgaacagtttcttggtcacccatagctaccagagaagcttgggaagggggtaattatcctttctccagccaagggaatatagtgtgtgggggagacaaaggaaaagggaattagaaatggctgttagatcagtaaaccaaaagtttctgaaagccaacaccctccttcccaatgtacgtccatttcccccttcccattctcccagcatagtaaagacaggtcatagctcagttagagtggtttttctgtgcttaaatccctcttttaccccagggttattctatgatttttttgtttgtttccttagtttttttaatatccaatcagtaattcacctccaaatcctttgacagaaatataaatttcttctttcccctggataattccctcatcatactgctctatgataagctctttaggcctgctgaacatcctgaaatctctcattaccattctgagatattgcttcttccctatgagagatctcctatttcttggatttgcaactctttcttggattactactttgtttggtgtggtggggatgggggttctgcagaagtttcggagaaatggtccactaaagaaaattttctaagtctctgcatctctgagagatctgcctttaagcttgattaatagtttatgtagatttgcatttctattttagaaactatttttccttggaattttgaagatattcctccagtgacttctaggttctgtagctgttgttgaaaggtatgaagccattctaattactaaaactttgaataagactttttaaaaacaaaaatctggaaggttttaggttgttttctttattcccaacattctgaaattttatggtgttgtgccttagtgtgtgtgagcaaagggttagtaaactccttctcctgtcttctgtgaaaatggcctcctggtgatcttccagcactctctctgcaatctatgaaaggtggaatgacagctgtgtgaccttacagcattgcctgtggtaaacataacccttgattggtaaagtgcatctgagctgggaggattgtgaatgaactataaatacttgaggagaagccatagctttgggctttcctgaatgtggtgtgacatacccaggtgttcttcttgttgagtcctggaaggacagcagtactctcgtaccaatcctgcataggttcaaaatatattgtattttatatgtggcatgaggctactaagctagagaggctcctacacccacctgtgtaatcttgtttccttgaacctgagctgtaatttggaagcaaaagaacagccctggactcctgtgaagacttgcattaaaggaacacatctgatgctgctctgctgctagacagtatgctttattcactgctgtatattcttctgcaaaactgagtaaactggtgaggggttggcctttttgggtcttgaaggtgtgattgcctaactgaaccaaaaaccatcgctgctgggtcaagtaaagtgtgcagtaggcctcaaagtgggatagacttttagatcttgactaaatgtagccaaggtactatgagataaaaaaggctgggtggtagggaagtgctaatgagacattgatgtctgggtagggacagatccacttatgattggatggcagaagctgtgtggctattgaggtgcctagggtgaaaattttaaggaagtcctcactcttagggctgtacctgcacttgtatattcctgagagtgcctccttaaattttctctaggcaccttatttgcctcaccctagtcctgcatctgagttgcacctgagaaggacgattctagttagagcagatgaaagctgaaatgagtaaatttggttgaaagaaaaagtgtttataaaaagataggggaaaaaagacaaaagacgagatgagaaatgctggctagggtttggagaagagggaaccctggaacactgttggtaggaaggtagattggtgcagccattatggaaaacagtatggaggtttctatctttaaatagaaattaaaaatagaactgctggtcaggcacagtggctcatgcctgtaatcccagcgctttgggaggccgaggcgggcagatcacctgaggtcaggagttcgagaccagattggccaacatggtgaaataccatctctactaaaaatacaaaaattagccaggcgtggtgccacgtgcctgtaatcacagctacttaggaggctgagacaggagaattgcttgaacccaggaagaggaggttgcagtgagctgagactgcacaactgcactccagcctggtcaacaagagtcccccccccgctccctccccgcagaaaaacagaactaccatatgacccagtaatccctttcttgggtatataccccaaagagttgaaatcaccgcctcataaagatatctgcactctcatgttcactgcagcattattcacggtaaccaagatatagaaacaacctaaatgtccaccagcagacaagggggtaaggaaaatgaggtatatatacaataggatattattcagccttaaaaaaagagagagattctgccatttgccacaacatggatggacctggaggacattaggctaagtgaaataagccagacacagaaagctattgcatgatctcagttatatgtggaatatatatgagatcaaaaacgagagaatgaaacagtagttaccacaggtgtggggagaggaactgaagagatgtagatcaaaggataccaaatagcagacaggtaggatgaacagatttggagatctaatgtgtaacatgaggactaaagtcagtaaaattgtattttacttaaataaggattttagctctcttgctacatatacaaaaatatgtgagatgatagctatgttaatttgcttcactatagtaaccattttactatccatatgtatttcatggtttcatgtaaaccttaaatatacacaataaaattcagtttttaaaaaaggaaaggtgctcattctcaccaaccatacattggacctgacccaaaaccaagccagctggggccagtttagacgagctcatgggaactgatcgtgggtatgcatgtcttctttcctgctccccctatgtgacagtagcctgaaattggccatagtttagagttataccatggaaatcagaaaacactgcaaaccagggtctccctccctccctacaccaatcttgtgaaactttatcagcatagcacagccaaaaacccggctgcagctgggctgacagaaatggtaccgcttttggtgtttttgatgcctttggccagatgccgtttgtggaaccgttagttatatcaaagccctggctgcagtggctacaagctaaatgtagcacaggggtctggttgatgggctgaggtgggcaatggagcccacagactccatgtttgtgagtgggattatgaaagaaccaaagaggttctattggattgattctgaaaatgccagagttcagacccgcgtggagaagtgcgggtcattgtggaggcgcacgtgtaccatgtgtttagggagctatgacagtcagccattgtactcgagtgtgttgatttaaccctgggctggagtcctctgccgccatctagagatggaaagtcaggatcaaaaactccctggagtaacctttaaagacaggcagtttgaaacagtgtgaagaacaatggccaagtgttttaagagccctagctaaggagaatgtagtgagaatcttgttccattgtgactggatataactgagcctttggattaaaaaaagacaatgtttctaaaaggggtaaaaaaaatttttactgcgttacgtttagtgtgctaaacatagtcccacaatgttttaaacttgcctgtgatttccaagataaaaatatattgtgagtttttcaaaaactagttagctgaaaactttgttcgttaggaagcagagagaatatcaacatctctttagataatatagttcctggtggtcatagacattaatcttggtattaatccaagctgatgtgagtgaaaaggagtaacagaaacctttctccttcctcaatagaaaattagcccaggttaactaacttttatgctatttttctagaaaatgcgataaagttgaaatgttagctgtataatcaagctacatccattatcattaaaaattactccattggggctgggtgcagtggtgtgtgcctgtagacccaactactggggaggctgaggcaagaggatcccttgacccgaggaattcaagtgcagcctgggcaacataatgagacacccatctcttaaaaaaattactccattggaaaattatacctcaattgggaggacggtgaatgaattataaatacctggtgggaagccatggctttggggctccctgcaccctacagggcaaatatactaggtttataggaagaaaatttatatgcagagaaatagtagagcacatatcatcccctgaactctcttttttttttttactgaacagagtaggcagagattatctggcattttggtcaatgtttccatagagagaggcgtgcctgtataatgctctacataatttatagagtaagagggccagggaatattgttccctggctggaaagtagccttgatagaaaggaggagcctgtagactccagtggctagtagtattattttgtagagtttactgagacctgttgagccagctctctgctaagccatcaaaagggggaaagaaggtgagcctacaggactatccagatttatttgttataaatctaccccagcccttgtgtgcttattaaatgttaagtatctccattggttctgattggcacctttctttagcatttcctgggagtagcaaagtttctgtactgttgtctgggattgtctaagattgagacatcaataagatccatgtctctaggcctaataggaagtgacatatccaacaccataagaaattcgtacttctaaacagtggctgaaatgtccctgaatgctatagcaaattcaccaggctgccaaggaatatttttaaatttcaaaacagacaccgccatacttgatatttgtcagacactgggtgaactactagcttgaggtggaactcagtttcaaagttacatgttatatcatagtacattctgtttgatgacatcataaatttgcaaagctggatctttttagcaattgttgtaatgaaaccaagtatatgtgaaaatcaatgtggcatttatcaataccccaaattaataaatatttatatcttaacaccttagtaaacatttgaaaaaatagcacatactttttaaaagtactattattttattcttaacaataattacttgctaatgggatgtgtttgctttttggacattcacagcttctcagaccctggaatcagattgtgtactatctcatttcctgttccacactgattttcacatatacttgctttttgcgacaacaattgctaaaaagacctaccttgcaaatgatatggtttggatctgtgttcctactcaaatctcatgttcagttgtaatctccaatgttggagatggggcctggaaggaggtgattggatcatgggggctgtttctaattatttagcaccgtcccctttgtgctgttatcatgatagagttctcacaacatctggttgtttaaaaatgtgtagcatcttccccctctccctcttcctcttgctctggccatgtaagacgagcctgcttccccttcaccttatgccatgagtgtaagtttcctgaggcctcccctgccacgcttcctgtacagcctgccgaatcatgagccaatcaaaactcctttctttataaattacccagtctcagatatttctttatagcagtgggagaacagatatatgtcatcaaacagtttgtaacatgatataacctgtagctttaaaactgagttctacctcaagttcacacggtgtctgacagatatcaagcctggctgtgtttttcttgaaatttaaaatattctttggaggctgggcgcggtggctcacgtctgtaatcccagcactttgggaggccgaggcgggcagatcacggggtcaggtgttcgagaccagcctggccaacatggtgaaaccccgtctctactaaaaatacaaaaattagccaggcatggtggtgggtacctgtagtcccagctactcgggaggctgaggcaggagaatcacttgaacctgggaggcagaggttgcagtgagctgagattgcgccattgcactccagcctgggtgacaagagtgaaactccatcttaaaataaataaataaataaaaatattctttggtagccctgtgaacacctcagccactgtttagaaaaaccacagatctaatggcaggtcagccacatgtttgtgaaagtggattaggttttagtagccaggtttggccctttattggaggtaagatttccatatgacagtggagctttcaagagttcgtccagccttatgggaatttagttcagagagaacgtattgcataataagatactggtttagtgaatcatgacttttctttcgataagacagtctgtctcaattaggcccagttaacaggctagcagtaacagccctgcagaaagaggaagtcctcgtgacctacaaattctgacgtagccttgttgccagagattctaatcagctgtgagtatagtcattgacatttgtaatttctttggatctgaaagagatagggaacttgtgggagggctttatttactcttgtccagactgcgtctaatgtttctaactgtagacttctctgctaacatgacagccatgtaatctccagtatttaacaagtcagggatgtggagggcttcttttggtagggaactagagaccagatccaaaacctagtcctgtcctgttcatcccatcctcataattaagaaaaaaaaatttaatagctttactgagttataattgatatgcaataaactgcacataaagtaaaatttagtaagttttgatatatgtatatgccaatgaaatcatcactacaatcaagacaatgagcattttacatttgttgcttacaaaagtttcattcctctttgcaattcctttctcctccctttccctgtttcccagtccccccaggcatctactaatgtacttgctgtcactacagattagttggcactgtctagagtttcattcaaatcttatcatacagtatattctcttttttgcctggcttctttcactcggcataattgttttgagattcatctgtgttgttgcatgtatcaatagtttatttatgctgttgtagaatagtggatataacacagtttacttgtctattcacctgttgatgagtacgtgggttgtttccagtccttggctattacaaataaaacttctgtgaacatgtatatacaagtctttgtatggacatatgctttcattacacttgagtaaatgcctaggaatgcattggctggattatatgataggtatatgtgtaactttggaagaagctgccaaatggttttccagagtacctgtaccattttacattctcaccaggagtgtataagagttctagctataccacattcttgccgacacttgatagatgtctttttaacagttctaaatagatatgtggtagtattttattgtagttttaatttgcatgttcctaatgagtaataatgttgagcatcttttcacatacttatttgccatttgtatatatttactgaaacacctgctcaaagatttttgtccacttttaatgaggttgttttcttatcttttgagaattatttatgtattgtaggtacgaggtttttgtctgatatgtgatttgcaaatattttctctgaatttgtagcttatcttttttttttttttttttgagacagagtctcgctctgtcacccaggctggagtacagtggcacaattttggctcactgcaacctctgcttcctgggttcaagcaattctcctgcctcagtctcccaagtagctgggactacaggcatgtgccatcacgcctggctaattttttgtatttttagtagagacagggtttcaccatgttggccaggctggccttgaactcctgacctgaagtgatccacctgcctcagcctcccaaagtgctgggattataggtgtgagccactgtgcctggtgatttatctttattccagtatcatatattgatcactatagctatataataaacctcgaaaccaggtagtgttcattgtattcttttcttgcaaagttgttttggtgattatatgttctttatgcttccatatgaattttagaatcaccttgtcaatttctacaatttctgcttggattttgattaagcttgccttgcatttatagatcaatatgagaagagttttaaaaaatatacttttccaactcatgaacacagcataacatctccatttatttaggtcttaatttctgtcagctgtatccaaatagtgttcagtgtgtaaggcttttccatctttcgtcagatttacctttaagtgttgtatgtatgaaaagtttatttcaccttcagttttgaaagctgttttcactgggtatagaattctagattgatcttttttttgtcttttagtagtttacaaatttactgttcctctgttgttttacttaaattgcttctgacaaaaaaatctgctgtgctcctcatttctgctcctctttatttagctcccctgctccccactggctgcttttaagactttgtgtttatcatacttatttggaccaatttgattatgatgtaacttagtgtcatttttttttcatgtatcttgtgcttggagttcattgaacttatggatttgtaggttcatagttttcatcatatttggaaagttgtgactactgtttgtgcaaatattttttcacccctctcttcttcctttagggattctgtttatatgtatattaaactgcttgaggttgtccccagctcaatgaaactctaatgtttcttgttattagtatttttctctgtttcatttttagatgttttctattgttttgtatatttcagtacttcattgctgccataacaaattaccacaaatttaatggtttaaaacaacacatctagatttattatcataaaattctgtatttcagaagcctgacataagtcttgctgagctgaaattaaggtgttggtagggctgcattccttcccaggagcttaggcaagaatctgttttcttgctttttccagcttccagaggttacctgcattccttggtttgtggcctccttcatccatcttcagtcagaaacagcatgttgatggccaggtgtggtggctcatgcctgtaatctcagcactttgggaggctgaggcaggaggatcacttgagttcaggagtttgagaccagcctgggcaacatagcgagaccctgtctctacaaaaaataaaataaaaaaagtatccaggcatggtggcatgcatctgtagttccagctgcctgtgatgggctgagatgggaggattgcttgagcccaagagttgatgttgcagtgagccacgactgcgccactgtgcactccagcctaagtgacagagggagaccctgagaccccatctcaaaaaagaaagaaacagcatgttgagtcctccgcacctcgcatctctctgatcatctcttctacttcttgttttttccacttttaagaatttatgttattagattgagctcacctggaaaatccaagataattgccccacctgaaggccagctaattagcaacattatttgcatcttcaaccattgttctcttttgccatgtaaaataacatattcacaggttctggggataggatgtagacctctttaagaagggtattattctgcataccacagtatgtcaagtttgctaatcttttttcttcagtgtctagtttgtcagtaattctatctggtgtatttttcatctcagaatttttatctctagaaattcaatttgggtctttttatattttccacgtctctacttaacacctgttagtagtaatgacatacactactgaatgtatcccccccaaaattcatatgttgaagccctaatcctcactgtgatggtatttggaggttgggccttcaagaagtaattaggtttagattaggttttgattaggtcatgagggctgggagtacccatgacggggctaatgtccttataagaagaggaaaggagaccatagctttgttctttctctgacataatgaggatatagtgagaaggtggctatctgaaagccaagaagaaagcctttaccagaaattgaacctgccattaccttgatcttggatttcccagctctggaattatgagaaataaaaatctgttgtttaagccatccagtcagggtattttgtgtggcagctggaggtaagacaacacctttaactattttttggacacatggaatacagttgtaatgactactttaatttacttttctgataatactaacatttgtgtcagctctgggttagtttcattagattgagttctcttgtcatgatgaattgtattttcctgcttctttgctggtagtttttgattgggtgccagatgctgtgaattttaccttgttgtgtgcatggtaattttatatttctaaaaatattcttgagctttgttctggtacatagttaatttactttagaacagtttgattgttttagggcttattcttcagattttctaggcagaaccagagacactttaatccagggctcattatttctcactgctgaggctgtacccttctcaatactctacctaatgcctgtgaattataaggttttccagcctggttgatgggaatagacactattcttgaccttgtgggttctttctctggccttgggtagttttctaacacatataatctgatcagcactccactgaatacttgagggaaaccctttgcagatctctggagttctctgtttgtgccactcctttctctctggtactctgtctataaaaattgaattatcttggtatattctttctggaaaaattttaaactacttaagggttggtaagttaaatttttctgggaatttgtccatttgcctttgtatttcaaattagtaggcataaagctgttcataatattctcatatctttttacatctgctgaatctgttgttaggtttcctttttcattccttatatatttatgcctcttcttttatttctggaccaattctcttatccatttttaaccctgctatttctttagaaactcaaaatagtttgattactgctattgaaaatgctaaacagaagattaaatccagagtttaaatagggaggagaaatgcaatcttaacaaaatgactctgtgttaaacattaaagaggccagtacagtggctcatgcttgtaatctcagcactttaggaggatgaggcaggtggatcatccaaggtcaggagttcaagaccagcctcgccaacatggtgaaaccctgcctctattaaaaatacaaaaattagctggatgtggtggtgggtgcctgtaatttcagctacttaggaggctgaggcaggagaattgcttgaacccaggaggcggaggttgcagtgagccgagatcgtgccactgcactccagcctgggtgacagagcgagactccatctcaaaaagaaaaaataataataaataaagatacccattcttttctattcaggaggccttcaaaaattttgtgcataaaaatcacttggagtgcttatttaaaatgcagatcacaaggcatccccctctagaaagtatgtagcaataatagtcctggctatggtcctggaatttgcctttttaataagcacccaggtgattctgaagtatgtggctggaaaactacactttgagaaacatgctctaacttgtgctacagacaaaaggcttttaaaatccccctggtgcctggtccccaggctgcacctttcaacttacatctgtagctttcttatccacaattcccctcaccttcaccttaccctcaaataagccctctggatgaggcttgtactcactcatctcctgctgagacaacatttttttttttcttttgagacagagttttgctcttgtcacccaggctggggtgcagtggcgcaatcttggctcactgcaaactctgcctcccatgttcaagtgattctccagcctcagcctcccgactagctgggattataggcacgcaccatcacgctggactaatttttgtatttttagtggagacggggtttcaccatgttggccaggctggtgtctaactcctgacctcaggtgatccacccgcccttggtctcccaaagtgctgagattacaggtgtgagccaccataccctgagacaacattttgtaataatctctagaaccaatttttaaatttctagtctagtcaaatgcctgagtttagcctcagggcactgtccagattctaacacatctgttatttcctggaccagtagaaagtggaccaaatcacctgggtttttggttcagacactcactacaaatggagcaggacttgagagcagattatagaagtatatatcttttttaggagccaggcctctctagggattctcctattgtaggtaaagaggctcctcctcaggtagctgaacttccagattagattagtgtgttcgtcaggtatgaagtagagaccacgaggcatctagacctttgttatgcattctggtaggccttccgtatggctcatactgcacccaatctgtatactgtctcactaaccttcttaccttactgctgttggctggtagattcccctttctgtcaagtctcaggggaatcactgcagtgctgacaactttttctagggcatcaccagtgagagcatctagggcctttcaaaaagtactgtcagatgccacgttctgttctccaaatattgtggatttcctcatatacaaatgaatattctggggcatgccaacccgttttctttatatgaatgtgaaggatctttgttcaaatgttaaaggatgttgaaggtctgattgagattcttcttcttcaaaggataggaattgttgtagtagagggataggtttgctgttgaggacgtttagtatctgaagagaggattaattggacaggtaaattttctcctaaattttgccgactaattatagaatagaatgataaggtattagccctggatgggcccttgaaagtcatttgaagcagtctcctagtaaaagatacagataagaaaactgaattccggaaagcttaggtgttttgtcagaggtcatatggctgtttggtggctgtactataaatactaaaatataattgttctgcaatttttttaaataattgagatagggtctcactctgtcacccaggctggagtgtagtagcatgatcacagctcactgcagcttcaacctcctgggctcaagcgatcctcccacctgaccctcctgagtagctgggactacaggtgtgtgccaccatgcctggctaatttaaaaaaaaaaattgtagaaatggggtctccctatgttgcccaggctggtcttgaactcctgggctgaagcgatcctcctgcatcagcctttcgaaatgctggggttacaggcatgagccaccatgcccagcctgcaatttgcatcttactaattatgagtctgataaaccaggagctgacagattaggttaccaacagccatagattaattgaaatatttactagggtatattatgtctaactaataaagctttatctttgtgtttcaggactaaaaaccgaaaactgtattgagaacctaggtaagatagctttaaagtcttatccctataataggaattttatcagttacttctcatagctatgggtcagagctaccccaccactgtactgtcgttctgtcaaacatcattttctcaaggctaaattgtgctactactgctagtaccttttcaggtggagagcctaggagcctttgctgccagtccccactgccaccctcatccccaccccaagacttgcctgtggctcttctctcagacactgcattggcctgggcatgaagggaacacgccactgtcatctgagcctgaccttataggagtttaaggactccttaattcccctacatcttcagccatttcccacttgactcctatgcaaagagctagctcctgttcctgtattttgttatcttaggaaataacatttgggagaccaatgaaggaatggcatgaatataggtcgaggaaggaggagaatgggatgacagaagggtaatgcggtagattttaacttcctcggggaaaaataagaggatgtgaccaaaaaaaaaaaaaaaatctttcttagaggactatgggaaagatttgggaaggcagacagaaaattctaagagtattaaggaacagcattatcaaagaggcctaataaatttgaattaaagataccaaaaatgcctttggattaagacatgctctgggtggatccttttgaagatttcctcattaaaaagtttaaaaacataccaaaggtatcagaagagagagaaagaaagttcaaaagcaaggttctgtttctagctgtttttctggctagctttcctgtgaatttttttttcatgtaacttaaatgaatccacatccagaggctgaggcgggtggattgcttaaggtcaggagtttgaggccagcctgggcaacatgtgaaactggctctactaaaaatacaaaaattagccaggtgtggtggcaggcgcctgtaatcctagctacttgggcggctgaagcaagagaattgcttgaaacccgggaggcagaggttgcagtgagccgggatcgtgccactgcactccagcctgggcgacaaagcaagactcttgtctcaaaaaaataaaagtgaattcacatccatttgtctttgaattgaaattttatatctcttatagtaactgtatttttatgtttcttaaatataagccaacacaatctttatttttaatgaacatttaaaaatagactgatcctgacattcacatctgagcatagtaccatgtaatgaaaacatgtctgtatttcagaatattttcaacccatctatgtctacaaccctggtgagtatgttctaatttttaaaaataatcttggttgggcatggtggctcacgcctgtaatcccagcgctttggaaggccgaggtgagtggatcacttgagcccaggagtttgagaccagcctgggcaacatggcggaaccccatctctacaaaaaatacaaaacttagccaggcatggtggtgtgcacctgtagtcccagctacttgggaggctgaggcaggaggatcacttgagtctgggaggcagaggttgcagtgagccaagattgcacccactgcactccagcctgggtgacagggtgaaactctgtctccaaagttaataataataatccttacctggatgtttaatagctctttcttgtttagcaaatgtatttcttagctgaagaaaatttgcagatataaagcagtgacttggcctatatgagaggaaaaaaataaagaacctattctagggaaatataccttcctcaaataagagaattggcttcgtggagatctgaacaatatggaaattttccggggaatacgggtggtgagaatgaagagctagagtcattcttgaccagttatgagggcttcttaggtatagctctgtattcagtcattgaaatgaacctgtgtgactccaaatactcagacaaaaatacaaaactcagcatgtttgcatctctcaaatatgcagatgcttgatgtttactatgatttaactaaaatatgtaggtgattagatgctcttaaagtttccactgaaggatatatggcccaaatcatttctttgcacataagttccttatcatgtgtttggctcatgtggctacaataaatttttctttgttgaaaagagaagaggttccagcctttttaaaacatgcaatttatttcatgtttgggaaaatacttcctgtcctgatagaagtgaagcactttataccttgaagacttgcttagcagcccttctttttattgttccgttgcagtcacaggttctactgatcacttcccagggactttagctgactcttcaacaaagacattttctcggctccttgagatccctggtagacaagctatttgtaatgacttttcttaatagtaggggcagagaatgttccagctcattagccaaggtacatttagactctgaccgacaacttaagtttagtagggtagtttcctggacgtatcaaatggttctttatagtcatatttcctgaaaataattttgctgtagcaatagtaactgccagttcttttgttccattgttaaaactgatgaacttcttttctgtgactcaggtgagaaaaaccagaagcttgaagaccatagtaagacatttttataaattctgggggcttggccaggcgtggtggcttatgcctgtaatcccagcactttgggaggccgaggcgggaggatcatgaggtcaggagattgagaccatcctggccaacatagtaaaaccccatctttactaaaaatacaaaaattagctgggcgtggtggcacatgcctgtagtcccagctactcgggaggctgaggcaggagaatcccttgaaccagggagctggaggttgcagtgagctgagatcgtgccacagcactgtagcctggaaacagagcgaggctccgtctcaaaaaaaaaaaaaaaaaaattctgggggcttgcattttgcaagatacctccctttacaggtgggaatattttcatatttcttgcaaataattttgctgtagctgtagtaactgccaattcttttgttccttcgttaaaactgatgagcttctttttgtgactcaggtgagaaaaactggaagcttgaagaccatggtaagacattttttataaattctgggggcttacattttacaagatacctccctttacaggtgggaatattttcatatttactgaaaataattttgctgtagctatagtaactgccaattcttttgttccattgttaaaactgataagcttctttttgtaactcaggtgagaaaaaccagaagcttgaagaccatggtaagacatttatgtaaattctgggggcttacattttgcaatatatctccctttacatgtgggaacagggaagaatgtcgtggtaagaaaagtgggaggaaggcagagctcaccttagcttactggtttggtatattagagactctcctgggtttcaggtagaattctttagaaaaatgacatagcagctctgtttctcctgtctaacaatctttaggtcatcccaccaaatagaggaaggtgtgactaattattccccacattcttgtgacctctaggatattgggcagggcataacaaatattgttttttctaaattaaaatgactattctttgtatttatttctgtcaccagcaatctgattaatatatgccattagctatatccatttgattatttagtacattccaagtgtaacttatcctcaagtatttgtttttgttttatttttaatattactcaaatggccgggcggggtggctcacgcctataatcccagcactttgggaggccaaagtgggcggatcacgagatcagcctggccaacatagtgaaaccccatctccactaaaaatacaaaaattagccgggcatggtggcacacgcctgtagtctcagctactcaggaggctgagtcaggagaatcacttgaacctgggaggtggaggttgcagtgagccgagatcgcgccactgcactctagcctgggtgacagagtgagactccatcttggaaaaaaaaaattactcagatgtcctcaaggataccgggacaggaacagtctcataaattactggcgagattataaattggaacttttttggagagcaatttagtagtatgtattactagtcttaaaaatgtttgtaccttttgactcggttataacacttttggatatttgtcccaaggaaattagagatgaacacaaagatttgtgtacaaaaatgcctatcacagtgttatggtagtgtcaaaagacaaaattacaacaaatttaaagagatcaattggctttatttgagattctagaattgggcaacactttattccatagaataagcgttcattgagctgagcacagaagtttggctttaaagacagagaagagccaaagaaagtggaagcaaagaacagagtatattaattacttttagacagaacagtagaaaaataactgattagttaacatcagtttatttcaggctaccttttttgtgtgtaaggattgaagcatcgggaacttcatttatcaagctgattgaagattttaaaatggccaatttgggaaattctgttatttctttctcctgatttcttagaagttcagacaacttagtttagatgatgtggaactttagcatgggtgactccatttcgatttttagtctggtctgttggggccttctgcagaaacttagtctgaagcaatggcctcctataatttttatttgacagtagcaaaaatttagaaacaacctgtgtccaaccattgggtattgttaaataaaatattatctatattatgaaacactaagcaacttaaaaatcatgttttcaaaaccatctaaagatagaagaaagtactcttaatacaatggtaaataattggatataaaactgcatatagagtataatattaacttttaaaaatgtatatgtatatatatgtatgcatagcaaaatgattgaaatacaccagaaatgttaagaatgagtagagtatttccgagatctgcagttttaagagaactttaatttttaataattttctgtatttttccaaattatctataacgtattatatagttaggaagcatattttatatattacatataatgccaattttgggtcgaggtctttgggttgaatttttaaaaaacgaacaagaggtgcttaacctaggagagattctgggtcactagccttagttcttatcatcagttaggctccagtgggttaaatctcttctttttgttaccttgtcctctgccatttctcaaagcgttctgagttttctactacagaagtcaagtataaggtcaaattaattttcaagctgattgcatttttttactaaatagttcttattctcgtccttaggaataaaaagccagaggctcactgtttcacctgggaaataatctatttactgagactagctacatggttaggagacgataaggattcctaggattaagaacattgtgaaaagccagcacagtggctcacacctataatcccagctctttgggaggcgtaggcaggagaatcatagtgagttatgatcgtgtcattgtaccccaccacagcctgagcgactcagcgagaccctgtctctcaaaaaagaaaaaaaaatgttactgagcctggagagtttgaggaatgagttagacaagaacaaagggacttcatttattgagtaccttttttcgctccgtgcagtgtaccaagcacttttatgcagtctttccttcaatcttcactaactacaaacctaagaggtaaatatttctcttgcaaagtgagaaactaaagttaggagggattaagtagtctgcccaaagtcacagagctaataactataattacgatagagctaaaccaagcagaaatgtaaaaccagtagtgtttcatccaaaaactgatatattgggactgccttctgaagataaagctggagagacgggttagatcgtggaagttcttgaagtccaggctaaggagtttggactctgtcacatggagaatgaagagccattgaaaggtgtttttgttgttgctgtttcttttttctttccccctgcctttttttttttttgaaagttggaaatggaggaaatatagacaaaagaagagtattaacagtataagataactgattaatacaaaccaatatttatttctgcctttaggtgtgaaaatccttgaacccacccaaatacctggtaagacagctttctatttactccctgagcccaagaatgagttgagcaggattcccaggcatttaagagaatactgtcatgagactattattcatgaatatttcccttatagctacctgccagtcatctacaaatatttagctggggaagtgtagagaagtctctttcctcctgtgcattcatgtgctcctggagcattgtctctggggcaggaaagttagttctgctctggatgttgctgagggaaaggctcctgggatctggatgcatcagtccaacaccttccaggttctacagctaaagttattcaatagaaacctacctttacgcacaagttgactgttagtcttggctaacatctcattgcctgtatctccaggtaacaaaacacgatattctcctggcataaacatgctcagtgaagtgctatggcagaagactcctctaatcatggtgtggatttgtataataagggtttacgtaagcagaacttttaaataaaaagccagaaactatagtgcattggggccttgggtgcttgcatctcttaagctcagcagacaagagtttgaaaattatactcagtggagcaaactgtaagtcattggaaacttccttctcatttaggaatgaaaattccagaaccttttccactacctggtaagcaactgataggcatgccagaggggaacatgccagtttggggagtacagtcaccattagatatgcatgggactttctatgcctcataattgtcatctatcaaatgtagccatcagtagtcacatgtacatgacaggaatatttgtaaggactataaaaccatggaatctcagggtgcaagccactgtccaatgcataaatccctttctcctgagttcatgtagtactttgaaatatttttttgcaggttttgttattatggaaatgatgatctgttaaggaaattagatatttggcatcttaaaaactatatccagccacacagtgctgaacttcacgtaacgctgctgtcaatggaagctgcgtgctgtataaagaaacagcgttttccattagttaaataaaggctcagagaacataggctcagagaaaagggtccaggacctcttttatattgacccaaatttgcactgttggatttatttggccacaactttgaagtgaacctctagtgacactgatgacacaccttgtgcgtctacatctcttcagctcgctagtcctgagtttgcacagtgccatcattggggtcttgctcatctggctatctgaaaggcagccaccgagcatggtgggagatgaacatgagctgtgtagacagatagacctggcttcaggaagtctctgccactttcctctgagtagctttatataagttacttcactttctacgcccctgctttcacatctgtaaaatgaggaaagcttctgtcttgcaggactgatgagataaagtacctagcaaagtacctagcaaaatgaatggtggtaacatagtagtaaatggtagctgcctttgttattatctgaaaacctctttcttgtttaggaataaaaatgatacaactgaatgaaaaacctggtaatatattctttattgggggtggaggcaccatggattctaagtcctttaccataatcattcagttagttcagtcttatggggtctggggaagacatctgggctgtacactttccgatatcccagtctgcaagccagacagggaaagtgttgagaatttctttcagtgtgagcagcaggctgctattacggttctctgggccaaacatcaaaaaaggcacttgatcttaaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccagtaggccactagattttgttgggactacagtgtattgtgccctctcctggaaagctatgtgtagctttttaaaaggtgatgtgaaaacagtacacaggagctcatttaatccaataagataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggcttcaaagctgttaaaatatggtaatatcataatatttctatgctaggcacacacttggtagtacagatggtctccaagttacaatggtcagtctgtaagaaacacgaaaaggtggcttgccagttaggacagatttattttagagaaaacaaacttgagaggcgccttctggccgagttaggttagaagcccacttttttacagactaagagtttttaaggatttagggtgggagagtttatcagaggcttggactgcttctgtgtctctttgttgtgcttatctgggagagagcgttgtgtgtctgttcccatacatcattctgcagctgcaggcatattccccaagtctgcttttagcttccctaacttagtgcacctgaagagaaaggaatgtgcttattaaggcccactgttttactggggcccactgtatgagggcgaagtttgggagttactcaagagactttccccccacctccctttgtgcccgagctgttttatctgtgttttactgtttgctccttctggctgcttgtagttagaagaggtgatttccttgaaatgcatgaggctagaaagggagctcgaatttaaagtggtggtgtttgtccaagatgacggtgctcctgctctatcaggttcaacttgggattttttgattttgcaatggtctgaaagccatacacattcagtaaaaaccatacttcaagtacccataccattctctttttcactttctgtacaatattcaatagattacatgagacattcaatattttattataaaataagctttatcttagctgatttcgcccaactgcaggctcatgtaagtgttctgagcacgtttaaggtaggctaggttaagccatgatgttctgtaggttgggtgagttaaatgcatttttgacttatggtattttcagcttacattggatttattgagacacaaccccatcataagtcgagaagcatctgtatagcatagtaattcagagcaaatttgaaattagatatttctagcaccaattacacccgtgattttatgcatggcattcctcaaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaaacccttcccctaaccccacacatacccgtaaacctattaccctgcccctcagacccactcacagagataaccaagtttgcttaatttttaatcagatctttcttttctggataaacagatatacaatataactaactcaaaatctctttatattttagaagataaaagtcaaggaaatatcaacaatcctagtaagaagtatctcatttcctcagttgataaatgcctgcttctgtaatatagaaaaagtgagaaatttatttttcctcaataaagggaacaaagttgcaaggttttaaggcatcttaataacagagtataatgtcatatccaaaagcttgtgtgtgcatgtgtgtgttggggacaatatagctttgttttttcgataatcgttttccattgtatctagagtttctactcttagaacagtggttcttaccagtctgaagactgggagcaaaatataaaaataaaaaagaaaatatatattaaaaaaaaaaagaacagtggttctcaacccaattctccctttataacaagtattttataaagtccttatattatccagaaagaagatccatagatgagatgcatttgtacccataaaaatcaacatcatgtctaaagtagaccgatgtttacatttatgcaaataaatttgggttgaagagaagattggaagctattctatacaggaagtataagaaaatggagtgaagaaatagagtagatactaaataaaaactgatgtttaatgtttatcaaaactattaaaaatatacataaaactgctttaggttctgagtttgattattttaaataggttttaacttacatgtatgtctagcagtacatttgaaagttgtgcaggaagttggtcaatttttcatggtccagaactagagcactgcaggatatctatccctctacctccactccactgttagcaatgattaaaaaaaaaaaacaaaaaactcttgacaatcgtccaaactgcctcttggggcagtaatgcccccctgagaaccactggtctgtggtaacatacagtcatgcattgcttaacgatggggatatgttctgattaatgtgttaagtgattttgtcgttgtgcaaacatcatagtgtgtacttacccaaccctagatggtataccctgctacacatgtaggctacatggtatagcctactgctcctaggctataaacctttacagcatgttattttgttgagtactgtaggcagcggtaacacaatggtaagtatttgtgtatctaaacatagaaaagttatggtaaaaatataaaagataaaaaatggtacaggtgtatagggcacttaacatgaatggagcttgtaggcccagaagttgctctgggtggtgttgagcggatgtgaaggcctgggacactactgtacactcctgtagactttatacatactatacagaggctacactaaattcataacaaattttccttcttcaatagtaaattaaccgtagcttaatgtaactgttttactttataaacttaattttaatctgactcttttgtaataacacttagcttaaaacacacattgtacagtagtacaaaaatattttttctttatatcctattctataaagcttttttatcaccttttttttaactttttaaacttttgttaacaactaagacacaaacatttacattagcctaggcctatacagggtcaggatcatcaatatcactgtcttgcacctccacatcttgttccactggaaggtcttcaggggtagtaacgtgcatggaactgtcacctcctatgataatgccttctggagtagctcctgaaggacctgcctcaggctgttttatagttaacgttttttaataagttgaaggagtacagtctaaaataatgattaaaagtatagtaagtacataaaacagtaacatagttgtttattatcagttatgtattatatataattgtatgtgctatacagttatacaactggcagtgcagtaggtttatttacaccatcatcaccccaaacacgtaatatgttacaacggcaacgatgttgctaggcagtaggaaattttcagctctattataattatagtcttatgggatctctgtcatacatgtggtctgtcattgatggaaacatcattatgcgttgcacgactgtactaatgcatgtgtgcatctgcctatccatttctctgtgtgtatacatccaactgcatgtttataactatggcaagtacattgataatatgaaggcttttacaaatctgactggctatttttcttggttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactgtggatcgaaaatatttgtgggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcagacaaactgcatgacctagaaatatatatatatataaaaagaaagtatgtcatgaatgcataaaatatatgtagatgctagtctatttttatcatttactaccataaaacatacacaaatctattgtaaaacgttagtatttatccaaatttgtgcacacagaccatatgtggcaccattcaaaatcaaaagaaacgtaaatgtaaagatgcggtattaaaacttaactgcataaaattaactataatacatactgtatcattgtaatcatttcatggccacctcctgttgctattgcagtgagttcaaatgtttcgagtatcctcttaaaacaccatgtgttgctaaacatctctgaggagttcatctccagtaaattgcacatcacagcaaaaagtgatctctcacagttctcctgtattttttgtcatgtttggtgcaataccaaaaaccttgaataacaccataggactcaaaggaagtgccactagtgaggccggaagtctcacaagcagagagaagccatgacattacaagaaaaagttgaattgcttgatatatagattcaggtctgcagctgcagttgccagccatttcagacagataattcatcttataaacagatgatgtaaactttgggtattagtaaatacagtacagtactgtaaatgtgttttctcttccttatgattttaatattttttctctattttattgtaaaaatacagtttatttatttatttatttatttgagctggagtcttgctctatcacccaggatggagtgcagtggtgcaatctctgctcactgcaagctctgcctcccaggttcacaccattctcctgcctcagcctcctgagtagcggggactacaggcgcccgccaccacgcccggctaattctgtatatttagtagagacggggttttgccgtgttagccaggatggtctcgatctcctgacctcatgatgtgcctgcctccgcctcccacagtgctgggattacaggcgtgagccaccacgcccagccaaaatacagtatataatacatttacaaaatatgtgctaatcaattatttttatctttttaaaaatagagatggggtctcgctatgttgcccaggctcaaactcctggtctcaagtggtcctcctgccttggcctcctaaaatgctggaattacaggtgtgagccaccatgccccaaccagaatacagtatataatacatataacatataaaatatgttaatcaacaatttctattatcagtaaggcttccagttaatggtaggctattagtagttaagtttttgggaatcaggttacatgtaggttttcattgtgtgggggttggcaccccaacacccgtattaagggtcaactgtatatggaaatatagcctgaaatctgtaatgaattacacttatttgaaaattgcttttggctggaagtatttcaggtaagtttctacttcaactttagtgtcattgtttacatattcaggatatattttataggtggatgatacttgacataaaaaatgatgtgtcagtgactgtgtattcttgttaacagctccaggtccagttcctgttccaggtcccaaaagccatccttctgcatccttgggcaaactgctgcttccacagtttgggatggtcatcattttaatcagtgtttctgctataaatctctttgttgctctgtagtttgatgcattgtttatctttcttattctttacttgaaataactatagggatacacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttcagaattgccagtatgctcaatactgttagtgtttaacatcaatttaatatctgaattagaactttaaggatagtctactcatctctttgtcttagtctgtttgggttgctgtaacagaccactgtagactaggtaacttgtaagcaacatttatttatttctcacagttccagaggctgggaagtccaagatcaaggtgccagcagacttagtttctggtgagtgtcctcttccttgtcctttcctcaccatctcacatggcagaagggacaagagagatagagcactaatcccattcatgaaggctccaccctcatcatgacctcccaaaagccatacctcctaaaatcaccatattgagtgttaggatttcaagatgaattttttgagaacacaaactactcagtctataacacttgcttcgataactgagtctagttatctcaccagttatatgctcaaggaccacaggcctgccttatatatgcagtcaccagtgggacagaaacccaacaggatgactgggcctgcctttttaaaaggctgaccttaggccctgtctggtatatttatctggttgaactagcaaccagcaatattagaacatgaaaaatcaaaggctagagaagcgaccatggtatgcatgatcagtgatccatccactagattatatagctcagtgagtaacaattctcatcaattagaccaacaactcttcctactataagggggtgtgcagagggacaaaaactcctatacttggctacatgggtaagaatgatggacatgcagatcttctgggccacggagaaaatgtggacaaggcaagaaattcctgtcccaacactgttggtattgcaatataatgggtaggaaagaatgatgagagggtagtagagtagtgtaacaaatttacacaccataaacttggcaaaagtagctgcatacttctggcagtcaatttggaaagaaacaatcagttttaaagttcctagtcttggccaggcatggaggttcaggcctgtaatcctagcactttggcaggccaaggtaggaggattgctggagtctaggagttcaagaccagcctgggcaacataacaagaccccatctctacacaaaataaaaaataatagccagttgtggtggtgcatgcctgtagtcccagctactcaagagtctgaggtgggaggactgcttaaacccaggaggtcaaggctgcagtgagtcgtgattgtgccactgtaccccagcctgggtgacagagagacttgtctcaaaaaaaaaaaaaaaaaaaaaaacccacaaaaaatcctagtctacacaactgtaacctatacaactgaggagaaatctcttcagtggattctcagaggatggactccagatagatatacagtgcatcacactcttcaccatccccatagtaaatacaatagcaagattcatgggcctgtttcttctaacacctgtcaatacaagccaaagcatcacagagaagtgcaaagttaaagcatctcaaaagcggccaacatgatgcagcccaaatatagtgtagtcagaaatactgtttaaaatgatccactggttaaagacccactatttaacactacttaatctgtttaactcagattttctagtatttcgaatactaatgacatattagggaattcttaatactagatgatatctgaagtaagttttacttgccataccctaatcaaaat

SEQ ID NO: 14017 - DNA, 9277 bp, Human
aaactgtcttgcttaacagcagatttgagccaacagagcacagaactggaagataggtcaattgagattaaacagctgggaagagaaagaaaatgaagaaatacaaacagagacttggggacactgtcatgcatttccacataagcataatgagagtcctaaaaggagaagagagaaagtcatagaaagtttaagaaagagtggccccagactcaccaaatttgatgaaaaactttacacatcctagaagttcaacagtatagggttggggtttatttttggggtgctgaaaatgttctgaaacttgatagtggtaatgattgcatagctctgagaatgctaaaaaactagtcaatcatatactttagtgaattttatggtatgtgaattatatctcaataaacctgtttctttaaaaacaaaaaaaggaggagcatgatatttatgtagggatggaaagatctccaagatatatattcaattaagaaaaaggaacttcatggtgtatatagtatgccatgttttgtaaggagggagagaaaaatttgtcatcattccatcttacattaacaaacaccgtaaggattctcaggaaactaatagatatggtcacccagagaggtggaaatgaaatgacggtgtggtttacagtgacatggatggaagcaaggctttgcattgtatgtcttttcctgtcagtttctcattttcttaaatccctgtgggaatttagtggagaaatctcatagggaatctagtgaaggaaataggctacaaagaagtaaataagtattttcagaattttccttacctgtgggctattttgtttcatgaattgatgtttattaacgtggcccaatatgtaggagataaaggccgtttgaacacctgaaatctattgtgggtaggcaatttgcagattggcttcttgttcaaaaatttcagttcaagtgagagacattttagatgctgaacacgttttcttgtgcgaacaatgcaatgagggatgagtgagtcgatcataaatgatagattccatagtcagatcacaaaagctgaccacaatatcaccgaactgtattgtaacaggaccatgagtatagaatggacttaaatatgtactgaactgactaatgttttttagagtttaagcatctgaaacaggagttggcaaactatctgtaaatggccaggtagtaaatgccttcggttcaacgggccatactgtctctgttgcagtgatactataagcccacctttgtagcagaaaagcagccacagacagtatgtaaacatctgggtgtcgctgtgttccataaagatttttacaaagcaggctctgagtttggcccgtgggctgcaatttaccaactcccgatctggaatattgattagaggtagagaaataaatgtattccagttcttaacaccaagaatacatcttcctttgttctgtcaatgggagtgtcagaagaacagatagtcccaattctatggttgtggtggcagcatggatatcttttagggaatttatcttaggtgtcagtgctgaagcaaaaatctctgaagtatgaatccttgaaggagagagatgagctgaaacttgtagctgaaagaggaaactatttgtctgagtacctagtcccctgcattcccatctttaccacttgccatgctgccataggacgcggtagggaatgacactgaaatggaattccatctgggcttgtgccacttagcagcttgatgacctttcctgggcctcagtttctctaactgagctttagcatccccatacatagtatgaagagattggactagagatgatatctaagatcccttctggctctaaagatggcatgtaggggattctgatagcagcagatgtactgcatatgactgttcttaaatcaggaacttgagatatagtgtttctgaaaaatttttgcctggaaaaatagagacatggtaactaattgtcacacatgcttattttttaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaaggtaagaaatgtttttacctattttctaacgattaaagtaaaaataacaatatgatatatttctgagatttttagattaagctgattatatgtaaccattaaataaaattttggagaccaaccacaaatgggttagatattttcatgagggttaatccctgctctccttcccttagtttaagcaaatctaactttttaataaaactataagtctagtatcgtatcttgctagatgcatattggagcatttttatgctgatattgatgagtaaataaatgcatacatttatgtaattattttaatatatgattttcacaaactgaaatgtgtttttttaccatgttttgttttttggctagataggggattcaaactcagtagttttaaagttgtttacaatcatttttaaatttcggttgtttgtacttgtcagtgactccaaggactgaacagcaaaaagaaaaaatagagaggattggggatggaagttaattaggaaagaaatggttattccataaatagaagtttagaatgcagattttggaggaaggaaaaaaggtttcagaatttgaaatacttattgcattttctcagtacaaaaggaatgattttcttacatacctatttttatgtatttaaaattttaatagaaacagtttggaggtaagccccttcatgtaaaagagattttaaaaatccagtccagaacagttttatgctagttttgtttaacatggattttgtgatttttaagtattggaaatttcactttcagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcatgtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacattacacaaatgaagtcctgaggtgcatagtggtttgggctctgaattttgtttctcttagcaacttacatggttgtattttcatgtcaaaaaaatcttgagattatgtaatatattagtcatagtactgtgcggatattcataagttatgtaaatgatacctaattgttagaccttcagattgttactcttttttgtattataaacagccctgtagtgagtaaacttttgtgaaattctgaaactttttcaagatacatttctaggatctagtatgtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagttaaaataaagggagagaggacattttaggttcttgaacccctatgatgaaagatacagaggtaaaacttccaagacagtgggaggacattgagtaaacctgcctggttagagtagaaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcacaaatatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgaaaagtgaactctaatcccaggagctgagttttgattcttctgtttcccgttttcttttctaggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttatagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcacaaagtattctttgtacagattttgtgccaatttgaagccacagaaatgatgtggattgttaattgtgttttagaacatccccggacactcagtgtcacagggggaaagaagtgggtaccacattctgtttatatttcacattttaactagatttgagtgtttttagcaagaaatcagtcttaaaatctaatgtctgggatccagaagaaaatgtctttaatctgtgagttattgtcacaatgtcatcttatttaaatgtaccaattagcattttgtaataggcaaatgtcatttagtgcttttcaccaatcccactcacccccggtgctccgccttgcctaagaaaaagaaattaaggagaagtaaactttatttcctaatataatgtcagctgatatttattgagcttttcctctttgcccagagactaggacccaaagaagttaagtaactattcccaggtttatttctctctcatatgatgtcccatgtggatgtttgtggtcagtggacagctttccacctagtctttctgcgacccaggctccttcctcttggggctctgcctttctctcagtccatagagccctctttgttgaaagagcacataggaaaagaaggaaaagtctgtgtggaaaatgtttctgggtcaggcctggaagtggtgcatatctcttccgcccatgttcctttggacagaactccgtcacatggcccacctagagagattttgggaaatgtgtccagctgtgtgcctgggaggaagggggcaccattttcttgagcagctagacagtttgccgtatttgtggtgttctcctcttgttgatgttgaaatggtgaatgagccataaagtatttcaggttatccacacactaatcatctcagtgtctttaattcttaactccaatatgaatgtttaaagcttcctctagattcttattcctatataactaatagagaagaaaggacagcttcctatggggaagacagaggcttcctcatagatgttaggaataatcaaacttgcccctgccctttcacccgtctcaaattctggtcttttaaagcagcgttatgttaagtagtcctaacattgtaatatacagtactgccacattctcctactttctattagaggaagtcagagaatatttatggaagtgaggacccaaattaccttctacagatgacttttatagttacaggacagaaagtgaaaatcaaggttacgttttctacttttgtggtagaaattgagaagtgggtggatatggttcgagaagacctttcagaaacacagagactgagtctttgtcttccatgctgtctctgcagtactgagtgaatttccttatacccttgtatcatgttttcctcccatcttctagaagctggggacagatttggaagagaattacacaagttcagttttttgatacatggattttacagtgcatgcaggttatttatgtagagaggaggtctgggagaaagatggaaactagggagatgactgagaacaaagatatttgggattaacacagatagaagaaaagtttgaaaccatgagattgtcacagcatgaaaaaagatattcaaagacactaaccaacttgaggggtgcagtggtctgaatgtgtcctccaaaattcaaatgtggaaatgtatttgccagtgagatagtatgtagaggtggggccttgaggaagtgattaagtcatgagggctctgggattaatgacttaaaaagaggtgtgaggcagctgttcagcccttctgtctcctgtccctttttttttttttttttttgagatggagtcttgctctgttgccccaggctggagtgcagtggcgtgatcttggttcactgcaagctccacctcccgggttcacgccattctcctgcctcagcctcccgagtagctgggactacaggtgcccgccaccaccacgcccggctaattttttatattttta

SEQ ID NO: 14018 - DNA, 92505 bp, Human
aagaggatatggcactggaaggagtatttgccttattattttaattcttctattttccataagcaaatacactctacatcacttagagtcagaaatcctggatgactttaagaatcagtgaagctggttaaagataaatttacaaaaactatagttgcaaccttcatacttttcacatatagacaaggattctgtcaaaaacctgacatatattggaactaaaaagaggaagtatctaataaggtgctattagtaatggtatattgcaccagagatctattcctatagaaaattacatagctcgttacatggctatgggggcaaatacaactacactttggaccctgaggcaacacaaccatcaagcttgctcctgcaggatacatgcagggctctacctgctcagccctcctgccccatcgctgctcagccaggtcctacctgcctttcaaagcacaacgaagatgtcctttcaccaagaggcctttcctgacactcaaagacaataatcatttcatcctcttctaaatgtgcttaagattttccacatacctcttatgactgacttctttttggggggatggagtctcgctctgtcgcccaggctggagtgcagtggtgtgatctcagctcactgcaagcttcggctcccgggttcatgccattctcctgcctcagcctcccgagtagctgggattataggcgcccgccaccacgcccggctaattttttgtatttttagtagagacggagtttcaccatgttggccaggccggtctcgatctcctgacctcatgatccacccgcctcggcctcccaaagtgctgggattacaggcgtgagccaccgcatccggccattactgacatttttaccttgtattctaagactttgggtacaccttatctgcatccccagtcatctgctccctgaaaaagagatgagtccctcatgggattgttattaactatatatatatatatatatatatgtaatcacatttctgataatgaaatatgactagaaagagtgctttgtttgcaaatagctctcatcaaggacacattaacagggcatttttctttggtttctgaggttgctaagagggcatgagatgggagaggttgggcagggatccttacatgtaaaaacggctagagagatgcaatagtcaagtctggaaacagcatcagaagctgttgcattccttccatgttgtgcttagaaataaatatgactgttgtggtcttagacaaatgagaagtccagaaaagtataacctggtaatcaggtccctcaactcaaagaccagtgatataagcctcttccttccccaagagtcaccaaaacaacttattttagaaagctaaggcttctcagcaagaagcagaaatccttcccctttgacagtgtcagctgaaagtgactggcccagtgaccactctttaaagctgcattgaagggccagaatggttgagtcctacctgtgctccacacaagttatggccaaggacatgctttcctgggcacaggaaagcccctggctcttaccacatgtcttcactcacagccaagggctgtctgaagccctggcacacactgtgagtgactgtgaccaaggactgcactggcttgctggcaggatggaccagcaggcaccatggctatattctgacctcttacatcaattgatattatttttagtaaaccattctctcaactcattttgcctcgcattattcaaacgtaaagtatcttaaccacaaatcatgtggctactagcaagagatgatacaagccaccttgagcaaggggcttcctgagggccatgggcatcctgtagggaagcacaagccgctggcacttcctgggacaggaagccaaaggagctacccttccctatagtcagggctctgggatgtacttctcttgcacatcagctgcattcttctctatctatgcacactggctctctctgtccaaaagcctcccattagagcattcccaattcaaacatccaacagagactgatgagcagccttgaacacaaatttcaaattcatggaagagagaatctgaggggcctgtctcaggtcaggtgacctcccggaagccatcagctgtgatgagggcaaggccatgtcccaatgccccatcttatcagcaagtgctaggagaacagatggtcagaaaaggctgtgagccgggcaacccacagattaacatgcctgtcactgcgagacttggctatccctttcctcctgaaataaaggatagggactgtgaagcagcctatgtgttcagcctgactttaaacactgcatcctgtacagcatcagaaaactgtggtgatagacctattaacagcacaaccctttgccctgaacggaccctggggaaacccaactcgggtagccacaagcagcctgtaccagcgagagaacagaatccctggttggctaaccagggggcctacaaggagggtgcaatactggcaattctcaggaggccaggcccttccctcagctcctcccaaaagtgtggcttaggtccttgaccacataaggctacatgccaagtgacttcaaataaatgaagacactatcttgaaggaattggcttgttgccaaactcaccatactctatggaccattcaaagtaggtctctcttaaatgatccaatggcattggcaggatcctttggatatcctttcaccatcactgagcctctcaccacacctcttgaaccaccaccccccttctgacttgtgagctcagcaagtggctaacattactgcagcagggactcttcccatgcaagaatgagggcttggcggtcatcagaaatgtgtcagtgtggacaatacagcatacgaagaggtgtcacactgtgtcacaatctgttaacatactcatttggggtgaagaaagggcctaaggaccaagcatatataaaataagtgccttccaaaatgctagagggtataataaaaataaatgtttaaaaagtaaataatatagtaaataaaaaagcaagcacatttgggattacaccagggaccctccttacctaacaggaataacataatattggcatctgttacttctttttttttttttttttgagacagagttttgctcttgcccaggctggagtacaatggtgtgatctcagcttactgcaacctccacctcccgggctcaagtgagtctcctgcctcatcctccagagtagctgggattacaggcttatgccaccatgcctggctaaagttaaaatgcagatgcctggctgggtgtggtgactcccgcctgtaatcccagcactttgggaggttgaggtgggaggactgtttaaggccaggagtttgagaccagcctggacaacacagcgagaccctgtcacgatgacaaaaatttaaaaaattagccaggcatggtggcccacacctgtagtcctagctactccaagggtgaggcaggagaatcacttgagcccaggagtttgaggctacagtgagccataattgtgccatggcactccagcctgggcaacagagcaagatcccaactataagtaataaataaaatgtaaatggctcaactaagctacagcaatagaaatcctaaaagtgactgtccatgaaggggtcaggaataataggaggggacacatgtagtgatgcaaataatctttattttgattggagtgtattgtgagggagaacctcaaaacacaagcagaaaaagaataagtgaaaaaatgttattatataatcattagagacagtaggaggaagaaaaatggctcttggattttatgcaacaagtgaaattaaaatatcctctaacatttgtaagctgctttacagtttataaagtatattcattcataaaattccatttagtattcataataatcccatgaggctcacataatcagcatacccatttcaagataagaatgcaggctcagagaaagctaagtagtgccccatgtcccacagtctgttagggaccaagacaaagcaaaaacccaatgtccttaatcataggccaagtcattttgactacaccatgccaggaacttttataagttagttttcttggttacttggtatagttaattgtattttgtgtatctgacttgtgctcaacctggttctctacactgtaagctctcctgaacaatgaatttattaacattatccaaacgtatagcaaccagagttgacaagctgccggaaccacaggactcaatctgtgactaacattcagcatcttggactcttccataatcaaaccatgagaataaggactaaacatcaaagggctaaaagaaagcctgttcagtcaatgctgccacaattatgttgctttgcagattacagtttcaatttgtcttgaaacttcacaaatgtccatcttgtcctcttaatagcatgcaaacaattgaggttagggaccaaatcattgtgttttacatttccaggagcacccaatatggtgtcctaaatttagtacacactcaataaatgcttattttatagtatgtttggtaccttctagaaagtaatagtgttaaaaatagaattctgtgacacaaaattttgtatcacagacaaggctgggcacggtggcttatgcctgtaatcccaggactttgggaggccgaggcaggcggatgacctgaggtcaggagttcgagaccagcctggccaacatggtaaagccccatctctaccaaaaatatttcagtaaaactcaggacaaatgtaccatgagggtttatgtattaactgcatgtgttctatccctttaatccaagtgggggaataattttacagagcttaactgaaggattttaactagcaaaaccaaccagtagaagcttctgtgttaaaagagtagtaagcataatttttttaaagtatgcatttctgggtgaatgtaattagaagaaaatctataggcagcacagccctctccaaactttgatgcctattttctcccctagtgtacccctcattctcactgaaagtcagatggctttcaggctgagttatcttaaaagatacacattagcactgttcttcctaagtggaacactgggaaatttaagctctgacctcagtgagggaccgtgaactgagacaatctgttttcccgtggccactggtctctggcaatatgaagacacaaatgtcccagaagtacagataaaagcaatgaagtacataattgcacctgtgcttgcacattctcgttcttaaaggcagaattttaaaataaatattatccccaaattctatcaccttaatgcaatttttgaaatttggggacattccactccacatgaatgcatataattacagcatgtaaattacacatcatcattcacttgaacaaggaagtaattagagcttctcaacttttggtaagcataaaatacctgatgccctcctttaagattatctggcatttcacaagttcttccaagcaatggtaattgcgaacgcactttctccaactacatacacctccctcctttggtttctgacatgcccctgctaagaacccctgttttacgtgcattcactgctcctaatatttctactctattccactgccacttcagggagagtaaaaacaaacactaccttcacaaaatcccacagctacacacattaatatttgtaggagccaaccctgcaacaaaatttacttaccaaagccatagccacatcctgtctgccacaaaatcctgcagccttttctttcttttatgaacatgtaatacaaaagatattatagaaaagctctatggtattggatctatactttttgccagattactttttccagagttttaatgtatttacaggttttttttttatagaaagtacaccaactattactagtttaaaaaccagagttttaagtctgtttgaccaataagtctggaatttatcaggtcagtaattcactgccaggtaattgacaagaagtaccttaacttaaacataaattgtgcaggcacccaaaaaacaaccctatactttcaggttcttcatatgtaaactgttgtgctgatgaaaggtttaaacagataatttctctaatatactaaccaggcattcaggtctggtaaacaggaaatgtcaaacaaaagcagtaattttcccattgctatttttattattatttatgttattattgagtgcttccaagtatttccacagccatgcacgctaccaagaatctgtaccgtccagaatccttttatgttctgaattgcctcctgagagaatctttcattctgttaagcttctagacagttataaatccagaggtttgctctggcttttgggaaaaataagcgttgttttgcagctagaaaatagtcatctccttactttctgcacagcccctcctatgctcactgttcaagagaaagtttgctgtcattcattttcttttttttttttccttcaaatcatcccttgaatacaagtttaattaatttggagacgggagtcttgctattttgcccaggctgggcttgagctcgccatcttcccatctcagccttccaagtagctgggactacaggtgcacagctttgtcattcatttgcaaatcagcaatagcagctgttttaaattgagctcttggaagaggcataaaatttgtcaactcctttgtttgcaggtctaccataggattactgtggggaccctgtcaaggtggacagacccatccaggaagcaatgggctcacagagcagcagaattagaagctcctgggaattagcaagggctccaaggctgcccctgtccctactccagccaactgaagtgatgccaaacatcacagtagcaatgagcagcctgagtaggatcaaactggtgttggtgtatgagtgcagatgggtggggtgacttcactgcaaatacggatgtcatgacattttctaaaccctcactggataccacattagacatcactgtcagcagcaagacagtgaggggcaggaggccacagtggccatgagagcaggcttaggggttgtcttcctgggttagaataatcctgttccacaccacttaccggccgggagacctttggcaagtgacctgtgtgtgtgcattccctcatctgtaagagggagtcaatgatgatcgagtacctgcctgacaaggctgatgggaggattaaacaaattgatatttataaagtgcttggaataacaccttgtacatcagaagcattcaatcaatgttagctactatcttcatcaatatcatctctagtccaaccctcacaattttacaaatgagaagattgaggcttggagaggcaaaatatttgcctaagatcacacagtgagttggaggcagagccaggactagaatccacgtcatttattcatccctacagattgcttcaaaatgtcacctttaaaggcctctaaacaacttctattacagacgggggttgagggcagtgtaaaagagtctctggggaacaaggtcagccttatcaggactgtatatagtgacaatacttaatttattctgaaaatcaaaattcattaaggaaatgcaaaagatataaatcgaaagggacactcattatctgaaaaaacaagctatgatagactatatgaagatttattttgatactagtgtgctttctcctcattcccagtaaactgtctggtcacacaaggttgaaataaagatttaacatcatagaatgtcaccagaacaacagtgcagctattccttaagctcaaggtcagaagcatcagcacttctcagcaaaatgttcccccaaacaggtgactcagaataattttagcctatacatcaccctactgaaacaaaacctctctcctgtgcatagtttactgaggtcagcacagtttgagaagaagagggagtttgggccccgttaattttattatacccactggagccatctatcctgcactgaaagcaacattcatagtgtcagagtgagagaagcacagggcattgtcaggattccacaaaccccagagatttaccttgttggtcttttacaggcaagataccaccctttctgcccctccttcccattatctctcattcattaccaccaaagcaaaaactggtttatttttattttgttttattattttattttattttttgagacggagtctcgctctgtcgcccaggctggagtgcagtggcgcgatctcggctcactgcaagttccgcctcctgggttcacgccattctcctgcctcagcctcctgagtagctgggactacaggcacccgccaccacatctggctaatttttttttttttttttttttttggtagagacggggtttcattgtgttagccaggatggtcttgatctcctgacctcatgatccacctgccttagcctcccaaagtgctgggattacaggcatgagccaccgtgcccggccctggtttaaattttttaaaatttcactccttaacctatactttgtccctttggaactgatctttttcctgtcacacccagcttccattctaacaattttgcttttcttagtaaaattggggagattttagtttaatataggctaaatctcaatgtgatgtttcagtattaagtactttctgctgagtcttagctaccaaccacattgcagacacattcccccccttgtggctttttttgctttatttacacatccttttttatatttatttgaacaaacagcccaactgtatacctttgttcatactgaaaagccctcctcctccactactaatgttctacccatcctttatagcccaatgtgggttatatcttctcccaggatttgaatcccttatactcaaacctgacgctgcaacaatacccaacaagctgcagcccccttaccaacctatcatgtaattttgtgtctttcctcatcatctgcctggacatttaagaaactttgctaaggacccattgtgcaagtttccccactctccatcccattcttccccagcagaggttctctcccctttctgggctgctggtcactgacatcatcatcatcactatcaccacagcatacaaagcactgccatgggctaggaactctcagaagcatgtatcaacttattcaacccttataataatcctacctcatgggaggtaggattattactccccattttacagatgaggaaatggaggtaaggagtggttaaataaactgcccaagattacatgatcaggaaatgccagggacaggatttgaacccaagcagcatcactgcagtctatgcttttaaccactgccctccagctgcttactcttgtagttgtttgtattatgtgattacactctatcttaatcatttacatgtgcaccttctcagtagcaggagccttggtttggtcagaggttgtttcttattgaatctttcatcctctggattttgcggcatttaagtctatttctctgagcaccatagattacaaaggccactgtttatagccatttattccttccttatttgtttcgtgtgtttaggtctttgctctccaactagattttaaactcttggagagtagagacaacctctcagctttttctgagtcaacctcagtactcagcacaataatgagcaaagcataattgtcctataaatacccactgggagattgggtggcttttttcctctcatgatggtattgtccacttgtccttattcaacatcattttgttgagtttttcaattagtcacagtcaccctgaatccccagtccaatcttgaaatgtcctagccacagctgctcaatttaatcatacaaataacctcaaggtgtgctccctttaatctctgggaaccactgcagacagggttgaagagaagctgcacattcactctggcaacacaaacgcacaccccagagcatgccggaaacagaaaaacagaaattgttaatggctttcaggagaaacatgacaagtatctactgtaaaaggaggagagctctttgtacctaagtgaaataatgattttatactttgtaatgaaaatgaagaggcagtagcagcatgaggcatcagctagtggagaaaggcttcataaggcctgagaaaaaatggtaagaggactttccaaaagactagaaggaggaaattccaggagaaaagcatttcttctttccttttccggtacctatttactctctctttcatcctacctttgctgtgatcttggctaagacctccgagcctcaacctccaatctgcaaaatgaagataatgtctgcatcatggggacaaaatgggaaagcaccgtgaaaattacataccatcagacaaaattcagaccttattgttggtgagagtttgaaggagtacatgaacaaaatttaaagaaaggatcagaaggtgaattaagaggggagagtgaaaggaaggaggaggaaagaggcacatagttcttttctaagatttcagttttagggtataccagagaagggcatcacagagagaactccgctatcgggtagagatggtcagaggacagctacttccttcagagaggggtttggactcctttcgtcatagttaactctgtcaacgccaccctgaaggtaaagataagcaataataggttcagcagttaagaacaacatacatgccttcccaagggaacttgcattactagtatcgcacagttttctttgttcttcaactacaaacacacacctggaagagaaaaccttcacttgtgaaagttcaaagcctctcttcagaactgcagacagtagaaattcttggagagggggctgcactctgggcattaatcatgctgcaaacatacttgagatctcccactgggaggttgtgtaccaagtatccaaggccaagattctacacacaaatcctctagcagaaagactgagcacacgctttggcttttaatctgaccaggcacaaaacccagctcccatgaatacctaacagatgaccttgggcaaagcctcccttacctcatgtaaatgaggataaccaatctcacagaggtatagtgggtattaaatgaaatatagctaaagtgcttagtattgtgcctgaaacatacaagtgcttaagaaatgtacttctaaccactgttattcaacctccaaagcagaatcagcctcagctcttaggaagatgtctcctacttaatgtgatttgagaagtgtgagatagatctttctccaatctttccttcctacacagtaaatgccagacttcttataatttaattttaaatgcatattctgtagttaaatgttagcattttaagagagaaaatacctttaaaaggcaataaaatagtgactcttcttaaagaatatgtgatttaatcaagtcagctttggcaagggaaggaagggcttgcttgttgaggagatgtccactgaaagtctctctctcatcacaaacagaaaatttccaggcttctccttgaacagtaaatgctgtggacaaagagctttggggtaaagttggcctgggttccatttcaggctttatcagataggtaataagtacctagctgatttgagtacaatctcactgagcctcagtttccatatctgtaaacacaataagatgcaatcttgggagttgcccttttgttctcatatttcgctattatgctatttatgagttttgaaagcgggtgaggaagaagccaggagaagcagaaacatgttaaatgtggagtccagcacagagaaggggctaaagaaatggtagtttcccttcccctaaaagaaaggcaccctaaacattcaatcctgaaaaactaaatttcaattaccttcaggcttctaaaatgcaatgaaaattcagttttcacaccatcatgttttaaacctacttctccttctcctggcatcctccttgctccatttcaaaacccatgaaggcacatgacagtaaaatatgggacagatccattgtagtacaaaactgtccatttttacttgggtatatattttttaaaatcctatctcattcatggctgagttttctagaagaatccagaaagaagaatctagaaaaatctagaagaattctggtaaatagaatcacaattagaaaataagtggtcctcatatgaaatgtggcaattacaatgaaagtgagaaaaaaaatactctcatccctttaggacatgaatcattgctcagagatgagggaaagactaagcctgaacttgaagttgccaaagcagaccccactgatgaagacagtgcatacattctcacccaaaccaaagaagaagcaatagaaccatcccataagaaccgcaacccaagaacgggtcatatttacatctaacagtaacccagtatgtggcagaatgtgatgtgccaagagagagacaaccatgtgccacaagagtacagagagcaggaaatcacttctcaccaggaaaagcaaaaaaagatttcacaaaaggtgggattcaaactagggcctacgagatagaatggattctgatggctggggatgaacaagagagaatattccaggcagaagggaaaatataagaaccaaatcagacgatgtaaagtggccatctcacatggcatatgaatgctggacttgtgtgctacgctcagtggaatcccctctccaccactcacaggtatgtgaccttggacaagttacataacttccttagtacccagtttattttttttctctgtaaaagggggatgacaacagacacctcaggggggctgttacaaggatcagatgaaataatgtaaagtaaatcacttaggtctgtgactaacactaaatgcccaataacccagagttgctgctattcttatctcattatcacacgagaagtcccttctaaagactaaataaacatgcctttgaggagactttctagatgtggctggggagagcttgctaaaacaattccttatccatataatcagtcagaggcaaagggtgtcgtaaagatagctaaatatatttctccatgtacactaggaggcttctttctacctattaaagcatgaaaagaaaagacacttcgtctttccccagcaaagtccctgcttgctgtatgtcttaaacccctgcattccagagaaaagccttgaatatccaaaatgcttacagagcatcatactgggctaaattgaattttcttattaaccaagaattaatagaagaccaatttgtcttaattcaaaaaaatctgaagcccatgagtacaccccttgccttagaacatgcagtgtggccataatttaatctgtctttaatgatttaagacctggagtgcccaaggcccatataattaaggaaggttccacacaattgaggctttgcagagcaggagctggcccaactttaaaggcaagctgatgggaatggtaggtactttgagactaaggtagaagatagggctctacaatcaggggcttccagacttgaccacgatctacataaaaaatcagatttatgctgaatatccatatacgtacacatatacagcttaaacatggctttctcaaaacaatacttaccctcactatgagcatgtattctattttctactccattgtattcaatattttaaaatgttgatcatgactcactaagatgatctttgtaacccacagtgtgaaaaacctttttataggtagcactcagattgtaccatagggggcctgccctgtgattttggagagagaaagtcacatagggtgaaggaggtaagtcaatacaatttcaattttttaaaaatgggcagaagattaaagactgtagcattttaccagaagtgggaagttagcggggagagaggtatagctccctaacgtgcagttgtaggaaggtgctcattctccctgctttgcagagttagccagggacccatgccatgccctacaaagtaggggtacatagtgtggaatccttaacactttcattaataggccaatcatgggtggctgcctatagggtgctctctggtggctccaggtctgatgtaacagtcagtgaagtcccccggggctggagcaatctgttacctcttgaggggcctatagcgtacactaatattgacacatccttctgctgcaaaataagctaaaaatcactaaaatatgaaaatattttttcacttattcaactgtcacatatgtctgtgggaaccccaagtacaccagaggcacttctccacaaagaagcttctatcaatgggaagcctagtgtgtcacggaccacccgtgtggcacagcactgccatccagggaaaataaacttgcaactaggagaaaaccattggcagccatccacgttggcaaactgctgtgtgcatgtggcacatgggaagattcctatcagcaggggcttactctcctgtggggaaagatggctgggtttcaagaggcactgggaaggaaaaagtgagttcagcagcctcaacaataactaagcagcacatgaaggaaaacaagctctgctgagctgggccacccaagggatctggggttgaactgaagcaatgatagccatgacatttctaagtctaggagcaaggacacaagattatatatctcttttagaatagactggccttgagcgtgtaaaacggaagcaaactggggagggagttttagaggaagcaaatatttgccatggtgcacaaggttaaagcaacatcagaataactgtattcatgggaacatacaggtcatatgaattaaaaacagtatttttggaattttacaggaaggaaatctgcccactagaatacccaaaggccaatttgcaagacaccaacagcagcagtaagctgaaatcctaaccaggacacaggaacttccagggttgctagctaaggaaacacctcccagaaagtcaggatgtaacaatgagcctcaattatgaaggggttatttcttacatagtcgtgtgctttgtaacatcttggctatttgtcccgtgatgtttcttcaacaggactgtagttttattagagaaattatggacaaaaagaaatccggccaggcgtggtggctcacgcctataatcccagcactttgggagcccacggctggcggatcacctgaggtcaggagttcgagacctcctttttgtactaaaaatacaaaaatcagctgggagtggtggcagatgcctgtaatcccagctactccggaggctgaggcaggagaattgcttgaacccgggaggcggaggttgcagtgagccaagatcgcgcgattgcactccagcctgggtgacagagtgagactctgtctgactaaaaaaaaaagaaaaaagaaagaaagaaatccctgccctacccctcatgctgattctgtcacagggtatacagtcttggcctctgtgggcctgcctcccaccaggtgactcagcactgtcctctactgctggtgttgtctttcacttctgctcaatatgatagccttggggctggagttccaccattttccatgatgctctgatctttgagttcattctcatccaaaacttatcttggggatttgcttagcagtctcactgatcctaagtgcaagaaatttgattttgaacagggacaactgtttgaacagaaagtaacttgcaattttaaatgtttctctacgagaagagaatgagtaacggttattcactcaaagtcagggtgatagttatgaaagaattttgtatgagcaagggaaaagaaaacaataaaagaaaatggcttctgtcctgctgttaagtaggttgacttattaaacagtggacagggcaggtatacttagctgttctgatcaacagtgagaggtttattgcactcaaatgtggcctgattctggggtatagcccccttatgttttgcaaaataaataaataaataaataaataaataacaaaatgaaaaaaaaccctaattagcaaatgcataaaattaatggggctacaaagaaggacttttaaaagtttcacctgaaaatgaataatagaatcctttgccagaaatgggaagtttgtgatgaacttcatggggtactactcataaaggcctgcacagcacagggccactcagaaccatggcctacctcaactggaagggcccacatagctagtggtaacagtgttttagaaaatgggctttggggtgagacagagttgcgtttgagtcctactctgcaatttattgctgtagaacttgggacaagttatttctgcttcaatttcctcatctacaaatgaagataatattcatacttttttcacaaggttatactaaggactgaatgaggttaacacatagcatggggcatatagtaagtgttcaatagacattaagtatcatcatcatcattttagattattccagaatttacttttcctctctttccggcaaggatgtttctaagaacaaaagagcattaattttcatcaactgagatgggaaatggtgtgaatttcttaagaaatgtaaccagagacctacatcatcttcctcaggaaatggaaatagtatagaagatccctttatgacaccacctctgcccccaaaagtcttgccaaagcctaacagaagaggtatttcatagtatttttctacctttgagggcatcttggcctcaactagaaaatccttgcacccaaggtaaaaaattcaaactagatctaggggtgtgtttcatttaaaattaacttaaaattgacttaattgactggactaattagctcctttctcttccaaacttcagggttccaagtaaaggtataatttattttcatggaaggaagttatgtcatagaagtattcccaagtacacatctatataaggcagattaaagagagagagagagaggaaggataatctgaagagacagcaagagtccaggcagcaggtattcaagttcactgcctggaagatcaccatggagtcagaaccagggctatgcttgttctcccaccccgacccaggggccacatccttctccccttgtggcctttgccctagataaatgtcttcatgcttgtgcttgggggaggggctcacttcctggatccctcctgaccatggcttcttatcaggttatgcacatgagcggcagtagttcagaaataccatctggctgaggttcaagtgctcatccttgcacctcttgagtctcaattttctcatacccctgagaggctggaaagaagttttatgaggacccctggaggctgcagagagttgtatcaataaatgtgaggtccctcatgaaggaaaaggagcaagaaggaaaagaaaatctggatgctgggaataaagtccctaagtagatggagaaattggtctgctgctaccatggtggttttctccagcccacttataaaactcagcccatctcagagacagatgaggtagaatcaggggcctagccaaaacaactggatgtagatctgtggggtgaaacacagaccagcaaggtcacagtcctaacaggagaatgagtcaagtgccaagtcccagaaacgaggaacatggttcagttttaaattagctgcaggacagatctctaacaggatatggacaaacgttttacaaaattctgcaattcttcacatatatgcatgagttgtggaatgatacaggaataagtacttgatggtgtttaccttttaaagccttatgcaggtctactggagattttagattcttaaggatgtgttccaatttgacttttcctctcccccaaatcttcgaatacctcagtagtctctcctatcaggcacccaacttcaaggactttcttgtcagttatttctttgcactaagaccatctgtatacatatttaaattaattccaatttaattattccgattcgaattaaaagtgacaatgactggtcctaaaaatttttatttacatcctttcaagcaccagccaccatgaactagaataacagtgctatcttacatcaatcttttactaatatgaatgaaatagttctgacaggcatctagcaatcatctcatgtataaatttgaaggctgtacttaacaaaatcttaaagaaaattttagcaagaataaacaagttagtgaatatcatctaagaacacagtataagaggtcgcttaagcattttcttagacaagcagcaatataatctataggtattaaaatattattccttttatggtctactttattcaaattgacaaaggacttgcaaatgtaaacagaaaaaaatttaagagaccaaatgacactaatctataaataagaaatgctcagttagctgtgaaacccgataagaagtccatgttgacatgaataaagtatcaaaatttcaaattctacaaaaaaagatggaaggtcaaaataagtgcttgctttgtcatgtgtatgttgaagaaaatgctcatagttaagttaactagttagatttacttggagaagtagctatattactatcacactcagtgttataaatacactaaatagttaacataaaatttttaaacctaacatttattttgctaaaataatcaattaaggatgtctttatatcatcatgtatataagagtattggcccagtttgtaaccttcatttgtgtatatagcttctattattggacaagctcccttaaggccaaatttaggcattacttaactttgtaaggccttaatcaaagtatgtgctcaacaactacttgacggctaaatcaattaggagaatcagctccttaatagaaaaactaaaataaatcttctctctgagaaatagtttaaattgagttggcttcagcatcacaaaagtattatggatatctttaaatatcctaaaaatctatcacatgcaagtacaaatagatttattctgctttgttacctaaaacaaaaccaagaccaaaaagaagtttcaacaagacatacttaagaaaaattcccagtaagtaaacctatggcacacactgcctcagactactgggtgaggtcgtatgctccccatctctggagcttggatgctccttgatccaggaaatggcagaagagacttctgtagttcatgaactggaccagataacctctggtcttctatcattgtatggttaaatatcctcctccaatttatcctcctacagattatctttcttcctctctatcagttaatgatctggtttgtattcttgagtactgaagcaaaaaaatctcactaatagtgatgacaacaagtaatactgaagccttatagtgttccctcctggtaacagccattttgtagatatacacatgtgtaacacttggtagagacatcttcctgacagtataatggtggcaaatgaaagtcaatgaatgttaaaacattaaattatgaaattgaaccagatttcaactttttccaagattaattcgatgtcataaggacaaccatttcaaatcttcctttctggctgccggcaggcaaacagaagtgaacttgtaaagtgaaagtagctcaacagaattagtagctgaaattaactctggtggttcttgttaacacgattctctatgcccccagctcaaacttagcattttagtgattcaattttttagaatatcttataacagtgttgcttagaaataaaattttgtataaagggtaaaaagccactgattttggagcatttgagtgtagaaggagagttttatgcaaactaaatgaataatatactagttcagaatcctataatattgtccaggagaattttaccaattagcgtcatcattgctactggtagaaaacacagatcaattgtctgcagcaacttcaggatgctgtgctgttgaaatcttaatggcattagcataattagaaggtgagagtttacgccaattaagacaagtctaattttagaatcaatccactagagaatgttctctaaatgatgtgtcttctccatagtttaacacagtcatcagacctaaaaaaaaaattgcaaaagatatatcaaagatgtgccagagctgaaaaagcctttggaagttttacacctattgaaagcattgtcctagtggggtatggtcacaatatgaaagccaagagtttaggtatgtttaactttgcataaggtacaatggatcatatagcaagaagcaactgctgtttctttaatccacatccctcacattaggaaagcaacagacagatgtcttgaaagtgtagcaattactccatttaaacctgggattctggaaaaacatcaaaacaaggaatgaaatgtgaatcctgaaagagccaatccttcaagatggatcctgagtggctaacgacctaaatccaaaatagaggcacatcatacatgtgcattcccagaaaacccctaaattcacttaattctgggacttccatagctgtctgtttctgtttacattgtttgaattaaccaatagtctgtggcctgcatcaaccaatcagaagtaagcaagtttgcattcctaatttgcataagaggatcagagtgggaactttctatataaaagacaactcctctttttgttctatctgagcacacctttgttttataccgaaggctgcatttctcaagtttgcaaactgttcactggaattttctctttcctttttttaaaaaagaaaattattttcagtgtatttgttggcagaggccatgtttattcaaatggtgtctatgcaaattgatggggcactgaaattctcaaaagaactgtggcaattcaaaaacacatccaccccaatcctcaccagttctttacatttttctcaaacttcctgccataaaatgcaccgagaccaccactataaaaatgccagaattaaaacatttataaacaatgtttaaagactcagatggtaaatatttactttcatgtttggagttttcaaaaattaagaaaataagccacttgtattttttaaattattacatctatgaataatgaagaattctagcccactgatcatttgctatccaatttaaaggggaaaaatatatccatccctctttgactcaaagaaatgtataaatggacagcacagatgaaaaggttagtattcaagatttatctagttcttggtgctgtatttctgttctcacatagcgcagaggtagaaatgagcactgttcacttgtcatcacagatggggtatttctgaccaattgtggtgctgatcactgggatcttctcaaggcaacttgggagtacaaagagatcatctggatctatcccagatcacattaaaaagagagttctaaaggttaaaagaaaaaatgagagggatttaaaaagacatgctggctccccaaatggcctaaaggtataccgtgaacatgacataatcattacatcagaatagtagagatgtatacataactaccatattacacgtatttggtccccatttgtatgtgtggatttaaaattacattatactgaggatactgctatactcataaacagtctttacctggacttaccaatgtgacatagtccccaccatcaggcctaactttgaggttagatggaggtaaattcagtcctactataagaggtagaaacaaactaaaaaaaaccttttagattaatatttgttaggaaatatctgtgtatttaccaccctttaagcatgtgggttgttgatttctaaaaatcatgaatataaagatggctacagaacagagcaatatatccattatatattttcttctagaaacaattacacatttggcaataaatcaaaatcataaacttaacagggcatggtaacactttttagactacatgaaggacacaatcattttctaaactgatctggacattttggattgaaacttggcataaaatagctaaattaaaatggggaaatttaagttatccccttttgttcatttctccttaacaacattctaaattttgaaaacatctcattcttctcaagcataaccataagaatcctaaaccttccatagtacaagattgtaaactggaagccaaactcattctggctgcaactatacaattaggccaattttagagcccaaaggaaaaaaataaaagtcaataccttttaaatgagaatggactggtttccagagtctatagacaagattctaaaggcactctatcattgtagaacaggaaatactaaattgagcagagacttaaattgatacaagtctgagtttccccagactttttttctaaaaagcccaggagaaggccaaatgcctgtaagtcctacatatacatgcaatgttagccatacttaaggagcactggaggccctcaggtcagtggaacattaaggtggaacaagctgtagtgctcttagatatttggtcctaagcatcacacctcccgtccctttttcctaagaggagtgctctaaagtggtgagtcttttatcgtgtgtatgcatccacataaatactgtctctcagagcagctaggctcaatatttctgcttagctttgctattctaaagctttttcggaaacagtatagtggttctcaacacgttttcttccagtgctactcaaaaagcaacaaggtgctaaagggtaatcaagtgaaccgtgtgataattagggatgcaatttaagtaattcaagtgtattgtcccaaatttaatcaagatgctgctgcttacaacaacaacaaagtacacaaaccgtggtggaagattctccacattgtatcacatcaccgtcttaatgctacaggtctgtgtgattcattgcactagccagtggctactgagcactcgaaacgtggctagtgcaaactgagatgtgctctaagtgtgaaatccacaccagattgcaaagaatatgaaaaacaaagaatacagaacatttcatgcatattacttatttctttttactttttaatgtgggtactagataatttaaaatcactcacaaggctcacatattgtttctattgaacaaaactgccatagattttctttaaaaagaaaacaaaaatatcaagggagaaaaacatttgaaatacacaacatggttcttgattatatctgtgttacttaggacaggcccaaagaccatccaaggcctaaaacttactggccattaaaaatagctataaaaatgcaaagccacctgcattgcacaaaccttaatatactccagtgaatggcattccttttaatgatgatgtcatcaaatcccccaaaaacaaatacctggtaaatgtgaaatgagaatcaagtaaataaattgataaataactcagttttccaaatccaccaaggaatggtcaagaggtcagaggtgttaaaaaccatcagaatacctagttgacagctgaatataacataaggagctttgacattcaactccaatattgacctgagatgaaacagaagaataaggcagatagtacaatcttgcatgcagagatatttattgtgctacttaagtcaaaatgcacgacattcatttgaaagcctccacagaggggtactatactctgcccactatgcaccggtaaggactctttccctgctcagtaaaagaggactggagttgtttttttctctttttatttttaacagaattgccaccgtaagtgttcctaagacaaaaaacaaaacaaaaacaaaaacaaaaaaaaacatatttgccaaagtctttccaaagccacatccataaataggtcctcattcatagatgtgaccaggatcactcccggagtcatttgcataccttgcttgggacttacaggatgctcctgggagtccacttaccaacacagctcccatgccccacagcgggcattgtggaggggggtataaaaagagtacttggcattaatgccaatggacccctatttctggacattgctcaggagaaaacaataggatctagaactctgcatctgaaaagcctgttctagacagtagggaagttcaccttcatccaagggagttcagagagacagcccagtgcaagccacttgaagttaggcagacttgcttcccatattcaagtccagagggctctcagcaggtgatctgaaagaaagagctatagagtcctactgtggccaccagaggacttagcaagggctgggtggagggcactgccctctagaggaagcatgcattattaccagtttagtgtctgtactctgtgccatcatatgccagatacatatgtatatctgtgccatccccccacaaggggcaaaaaccactcagtttgaaagtatactagagataaaataatttttaagagacttttttttaaaccatagggtttgagtcactttagctttggcaggggtttgagacaactacacagactttacatggtaatctggccccaacattcctcactgtggctctcatgatcttgactgggcttactcacatgcctggggactagctacctggcagtttatctatgctggaaaagggtattggactagtacacacattcacacctacccccatattttaagttgtttacaaaatgctttagaaagtattacctcactgacgtaacaatctgaaaagtgttagcatctccatttacatatgcagaaactaaggccaagagggtaagtggatcagtttcctctgaggaggctcggagtgcccactgccaatccatcagatgcctactggaacctaatgcttctgccagccaaccatcacactggcttaacttacaagtcatccttgctcatccctcagtgcaaattcttccagccatagtctcttcaatttctctctttacccactttcccaatgtgtgataaattgcaaaaaatgccccaattctgcacctcttcttacatccctaccctttgctacataattttgtgactttgaaacttagctatgtgactttcttggactaattagatgttagcaaaggcgactcaagcagaagcttgaagagcacttaagcaattctgcttgctttcattcttgtctctgtctttactatgataaggccatacccaggctagtccattgatcccagaagaaagatgagatacacacgaagcagagccaaattaccccagccaaagccagtatagattagctgacagctaggtaactcccagacatgtaagttcaaccaagaccattagagccacctaggcacccccccaccaaatctgactccagaaacatgcaaaataaagtaattattgaatgctctctaggatttatggttgctatgcagcattaatgtggcaagggataactggtactcactgcagcacccctacacacctacccaaagtcttcccattgttactcagttattttgttgagaaataaactcctctcttctgaatgtgcctttcacttcccagccctctctggaacctagatctcctctgagcgtactgcatcttttgtggccctttctcctacacccaacacactcattgccaggaggcacggttaacatctttctcatgccccagtgcaacttccggatcactgcactttcactcccgaatagtcatcctgctctcctgatgctcagaccatctggctataccatataccacactctatcacttcctattaatgtcaagtaccaatctttttatatttttaaagattaacagctggttgatggttatactttattccatgccctatcatccagggtgacttcttgcctttagcatctcagtcctgaagtattcccaatggcaatgatcttcaccttcattccatgtctgccacctactcccatagccagaacataaaatttgtcagaacctgaaagtacctccagaatagtacatttaaaatcccactctctgaccacagccctctcatttttccagctctcacttctttagtaccactatatttatttttcaatcatttattcaaagcttgccctgtcccaggcacaatgccaagcactgaagaaatagcagtgaacaagaaacagtctttacggtgacaaattcacgtgattcccatcctcaacagattcctgacactgtctgcaattttctcctttggatctcttttccactctccataagataatgttttccaaaacactatctcctcagactacctacttggtcccacgaagttcccacagatgacttatatcttatacatcacaaagaaaattgaagctatcagaaagaaaattgcctcatacgtctaaaattttcatgtatccacacttgcttcatcctccttcccaattctcaaaatcaaagatgtgtcctgttcaaaactaatgctttcacctgtgctctggatctcatctcctgggatctctactctattattttcccctctccattgggtcattactacacagtagttatcttcaggtaggactagctgctcaaacagataaaccctcaagtctctcccttaacatatttttcttgttcacatagaattgcactgtgagtatttggaagggagccatccaaagatggtcctcagttgtagccgacagatgaggaaagaatggaagatcacctggggaggcaaggcttggaggtggcatacgttacttctgctttcattatcaactagaacccagccacctgaccacacctaactctgagggaggctgagaaaggtagtctagctgtgtgcctaggaagaagatggaatgggatttggtgaatcctactagactttgcctcagtagttaagaaaaggggttttaaattcagaaagaccagggttcaaatctcaggcctgcaattactcggtgggtggtggtgagctgatcttaggatttagacagattaagggagacaataataagaatctcctaagctcaacagggtgggaaatgtatctgctccatgccttggtaactggctagatacatgttgctagttctcaggggtctggaaaagtatactgtttacaggcaagggggaactatttttcatctttatatcttccataaatgagtaaaagatatggaaaattccaagggtgtctggtctcttccagaaaacaaaaaattaggacagacctctgcaaactgctttcaagacttcattgtagaaactctcaaaccttagttgtatattaaaaatcatctggggagctttaaaaaatcctgattcctgggacacaccccaaaccaactaaattagattatctgggggtgaaacccaggcatgaatattccttaaaacccaggtgataccaacgtacagccaagtttgagaactaccactttagaggaaggaatattcaatattgtctttttgctttctaattcaagggagcaagatacagaaagattaaaaacactacttataattgggcgagacaattctgccttgattatttgtttcttcttgacttaaatctttaggctctagttactatttctaggcaatgtttcttagcttagagaacattaataactgaaacctatttcttcagtgacctgtaaggttactgagcactactaaccttacttagagaagtcaacattcattagttaaaaaacagagaagtctctcgactgttaacataaataatttaacaacctaaaaataaatacaataattgtccttgcatagtacctttcatcatgaacctggttttcagggtctcaagagatgtgtgtggtcagaaccaatctggcagcaatatttcctccagctggtaggcataatacagctttacaatgtgaagctttaaataacaacattttgatggctggtgggggggccatagcttactaggtatataacagcaatgctgaaaggcaaattatgtctcatacattatttggttgtgcctcttgcctggagccagcctaggctatccatctttataaatgactacactgtatggatctgaaacaaatgaaaacaaaacaaaaaaacactcaaaagctctcagagttgtctgccaagagaataagaatccatgcatcccaagtgtgaccttgggtctgtttcctcatccttaaaataagcacagtggatgacaatgtgggttgtgtttcagttctaacactgagatacacttatttctcctccttgtgactctaccaaaggcactgaggggtggggggtggggtccatggagaagtatctagagcataatttaggaaataaagaagtgggggtttaaggaagggtacagctgtgggcagaactggttttcgttttgttttgagggaagaaaaatctgttcagtttggggacacattgagtttgggatatcaatatagagatgctatggaatatgagtccagatttcaggagaaagtctacgagttttcaggattgagctattaggttggtgcaaaagtgagtgaagttcttgccattactttaatggcaaaaaaaaccctcactcacttttgcaccaacctaataatgtataaagtcatgagatggcatgaggtcaccaaatgagtatagaggaaagagccacagactgagacctggaacccaccctgcattaagggaatggggagagaacaagaacttgtaaaggacgctgagaaagagcaaccagtgagatagaaggatagccaagagaaggtggtgctttggaagccaggtgaagagaaactcccagaacacagtgagctttcaacttctcagtgattgaagttgaatcctcttcatgattattgggaggaatggaagctgagttccaggaaggtctttgatcttaccacatggcattaacttcagtgcttgcctcatcattcaaaaagaaagccaaatttctcagaaaccgaagggtctgctagtaatgcttacaaataggagtaaataaatctgacaatgatcacacttcagggtttacaaagtgctgcctcacatgggctctcttggatctccacaacttccctgtgaggtgagaagggttagcttcaactgtacagataaaacaacaaactacaaatcaaccaagatttaagacctaccatctaggttgtagaaaagccatagaacttaggtcttctgacctcaaatcttcggttccatcttccataccatattacttgttatgtaaatgaggagaaacccagcttcttattctcttcagtaggcaaggctatcccaaacaaacagaaatatacacacaactaatatttgcatatcattttgcagatcacactagtgcgtgatcaacatcagaaaaagaggggaaagaaccaagtctggactaaacaagtcatagaaaccaagattaaagacaggcatgagaactaggactgcttttctttgcctcaccatgggcttactttacattctactgaaggtaaactgccaacatggcactcaatctctccaccttcccaagtaggacccaattctgatctaatgcaagacatcacataccagtcagaatcctaactaaagttacagcttcttttcttttcttttttcttttctttaaatacagggtctcaccctgtggcccagccttgagtgcaatcacagctcagtagtgcaaccacagctcactgcagctcagaactcctgggctcaagcgacgctcccaactcacccatccaagtagctgagattgcaggcacatgccaccatgccctgctacttttaaaaagcatttatagagatgggggtctcactatgttgcccagactgtcttaaattcctgacttcaagctaccttcctgccttggcctcccaaaggcatgaggcactgcacctggcccaaagttacagcttcttatttagagccaaggatattcagttattctgagcctttcagtcccagtcaaatcaaagaaagtatagatcctagaactaagcatgaaacatttcaagttattttaaagaactaacttcaggaccaataaccaatatactgtggggtctggccaaggcgtggcaacttgaaatttttctgactcacctcggggatacagaagcagagtactacattaaatcagtagtttttgcctttataaattagtttagatatttgtggattattagccataaaacgccaaatggtagattgtaaatgcaaaagttacttatatacagcataccctggattaaaattctgcatctgcaactgtttctgaagtcagcctcactggagaaagtaattatagtacatcagcaaaactaagtgggacaggtcaccataatcacatcagtttggatgctatgtttctgaaacgcaagtgacagcaattattccctctttctgatcaggaagctactgcatttttatttatttatttctgaaagatcacgaatgtaatacaaaatttaaaagatacaaaggaatatatggtaaaaaaaagaatctgcctttcacccagtatccctaatctccgaatttccttcccttaagcaaaccaccgttaccagtttgtgttcaggggataatttgcaatattttgatgagaattcctctgatcttctacccctttccttacagccttacattttactagtttactctttgtccttttcccagatgagcttttgctgtattgttggttttagttattttattcaaaaatccccgtcaaaagctgtggtctgccactcttctcatatagctacaaaggcagacaacatcttattcagaggctcaggtttagtttactaggattattttctaaaagttaaaaagactaccaatgacaaaataaccaggtatacctgcccaggacttctcaaactcctgtgtcaagtgaaggtaaatgaaacaggattgtctttaaaagaaaaaataaagtgctatatgatgggctgatcatccttaaaaatcagtaaagttgtgtattctaagggtaaattaaaatgtctttccaaacctatggtatccttgctgatatctagtcctcatatcctaagccttctcactcaagacatggctgcttcttagagtacaagactataattttgtttggtaattaatagctacagagtctaacacccttggttgcttatgcctttcaagatccataggctgtcccaatctattcagaacggaaagcaccactaattctaacgggctttaagtacatatttactgggcttctgctatgtgccaggcattgtgctaaacgttgggaacagagtgaggaaaaacacatgtcctgcccttcatgagtcaggaatttcagcgtgccaaggggcagagaccaatcagaagtctccccacattctatattcctcacccaatgtagtgccaagatattcttagattccacctgccctatgtctagtccttttgcctgatggtgggttcttctctgctctgacaggttgtgggtttcagaactgggtttgatcccttgaaggtggacagtagacaacagaggaactgtccacaccttgtagtcaggtctctaggggccagatcaggccactgctggagttgaggaggggagattctgatccctttcataccttttctccagacaaaaattgtaggtctgcagtaacaagtcctctgtctcatttgtgacacagaatgaattaagataaacctggctcccaatctcaaacagaaaaggcaagcaatttctaaaccaagggccctaagaaagggattttcaaaagccacatgttcagagcctatctcacaggaaatgatttaaagaccaagatggggctttgcttaacaataagagacaagtgttaggtatggccatcccatctgctcccatgaggaggcgaattctttacagggtggtatttagggtttataacatccacaaagaggattttcctgacggcctatcatcactgatgagttagagttgcaactgaaaggcaaggagaacgtcagaactgtgtacttgtagaagtcaccctaccccattcacaactctcttacctgctttctctccatgtcccaccacttctttcctaaaacatggcttccacactgctacacaggcagacaagtccatccaccctcgccatgtccctcaggaacttccaagtgggtctaaataacaataaccacatcacactactttctctagcacaggggatagataccattgtcttagggaaaagaatgggaaaatacattatgtttaaattaggaaaatctgagtagcttcatttttggtttgaagcatatacttccttagtgatttttctttatttaatttccaaatgtaagtttataaaacttctgtatttattactatctgcaaccccaaaataagatgacttgtacaatacaggagagcctccaatcataaaaattcattcttaagttatatacaattttacagttttgtcggagtatgctctgtgttggcaacccatgaacacaaaaccgagaatgtcaatactgtagatgtcacagagctgctcagattttcaatctaatttaggaatgaagggttatgaatctaaaatgacaatatgtcctgcctgctaaacaagctcctacccttcatacaactatcagtccccttaaggcttctgtgattaaaataagcagcaaaggatcatttagagacaatgcaaaggcctttcctgtagctcttgagagggactcaaggctgagccatgccttagctaataaacactgataacctatgccatttcaggtaccatttagagtctaaacaaggtgagggcatgaacaatatcacctgcaaagaacacttgctgtgctcttttaggaagcaccaagtactcaaagcagagcgaatgcaacaagggcagcatcccaaattccacagtagggcagactccaatgcaatgggggccctggtgtgagtggggcccaaacagctggcgtggctgctgcctcccagtcaagcaggaggcctgagatatcccaggggcagcagtggccaccacctggacactcttatcacttaggctcttgatgctagcaaaaatagtacatttcttggctgtctgagatttttcagtgcatggtaacttgacatttctggcaaaattggcaggtcctgagatataatctcaggacaaagacaagatagggatgaaatccttagcaaggcacaggtgccaaagtgcaatgtcttcaaagacacagtttcaccgccaagaagaaaagccacccagcttccactataacacaactactttgttccacagtctgtgccacccagatgcctccccacctaccacctaccaccacccgcagagagaccaccaactcccaaccccatacagccaggatttgtgcccattgtccaatgaagcccctagacctaacacagcatctcacagagaatcaaatgaaggaaaatgtctgccctgtaaactgctgaactcactgagcaaaggaattaacatgaagactctcctagctagtatgaaatggtaccactctcaaggtagctcagcgactagaggtatagtctgagaagccagacagtttgagtaaaagatttgtggggaaatgaaccctccttactctcccactctctctcagacacaaaagttcccactggaaagcaaatcagagggggaattatgcctcatgcaccctgacttgacagtaacttccaaatacacgctatcaagaacacccacccaaccatctgtccgtgtgtgattcctttgcttattcgcacagagaaaaagcccagtaaaaaggaagtcagctggctgacagtctgggggctttctgaacttccccattctccggaaatgcacaagccaggtctgctgttctatccagagaggaacagcatttgatggagatgaacagtggctgacagttaaagatcagtaagaaagtaaatgtacaatggattgtgaacttaacgagttctgacttccctaacatgcttattgaagtctctgtactcctgattatttagaattcatgcttcctgttctcctagtctgtaccaccctatggtccttcccagtgatggcctgattctctccatcttccttcctccaccttcctgatgttcactgcaccaacgacttccaaggttcattcttcctccattacaaacaccttccttaatccacccaaaatatttttaaatcatcgtatcgcttaagtctccatcattttgtccttctctccgatgtgaacaaacaaatagtaaaaatgtaagatgaggctgtttttcccagtagtcaatctttccctgtcccttccaatccccacaacaaagaaaactatcacccatctgatcaaatggatgggtaagcctcacaagatgagggctgatttccctaaatcagaagagaggctcacagagcagaaggagtattctaaataaagagaatagcatacaaataatgaaccagtgttgctcaaagtgtggcatgaagtcttcctgcctgaccaatgctttgggagtctgttcaaaatgcagatttctaagtacaacatgagacctaccgaaccagtctctccagggtgcataaaatgcaaaactctgtattgtctatagagcacatccctctaggttatcaggttctaagctctcactgagtttgagctattttgcaacttcataagttgcaggcaactggaaaatattaaaaactctgtcgttgtctggttttgcctgacttccctccccctttaggggaaaaaatcagttttgcttccatttgcaattctattcctttactcaatataaatttgtgctttttgactttttccctttgaactgcttataacttctgccaggctccctcatgtgggtaaaatgaaatctttaaaacatgttcatccttatctgtatgaaagtaatgattttgccttttctgaatattatcttttaacagaggtaggcccaggaatctctacttgaaaaagatgattcttcagcacgagaaagtgggaaaaccagcactctcgggccgaatgcaaccagccaggctctttgtagataaagttttcttggaacacagccacggacactgtggctgcttttgagccgcagtggagtagttgtgacagagaccctgtgccctgcaaaacctaaaatactatctggtcctttaaagaaaaattctgccaacccctgctttagtggaatagctttcaaagtcgatatttatcaaggaaatcttttagagtcactggaaggtgattgtggacaggctggccatgccatggaaagctcagtgaaaatactgacactgagtatggtaccagcactcaaaggtgagaggaggttcataggggctcaaggaaattgcatagagtggctctgaggaaaaatacactttgtgtagcaagagtagcccacctcagtaagctatggaaagtgcttcatacatccattcagcaagcacttatggagaatctaccaccacctatagcaggcaacgggtactccatagatcaagcttgtccaacccaccttattttgttgttgttctgttttgtttttaggcttttagcagcctgaagccatggtttttaagtttctgtctttagtaataagcggaaaagagggatgaggaaggggctttgctggccaaccaaaacagaaactaagaatccatgactgtattcttgcccttggacacccctgccatagatgaatgaggcaggaactctgccctgcagatgaccacgattcagaacatcattatcagccatccctgtatagtggttaaggtatagccgttgagagagaggctctggagccagtctttgtgggtttaaagcccagctccaccacttactagctgtataaccctgggaagactctctgtgcctcagttttctcatctgtaaagtggagatattaatatagtacctaccttacagagttgttgtgaggctttggtgagttaatacacataaaactcttagaacagaagctaacaagtactaaacgctgtcaattagggctatgactatgatcagaacccacaattacacaccagttgccacagtaggcctctgatgtacattctctctaaaccttacaatagctactcaagctgcaaattatccccatttaatgatgcagaaacaggcccagagaggtcaaatgacttttccaagaatgcaaggtagagacaggattgaaacctagatctgactctgaagtccagttttctttccagtcattctcccttgtgcgaggttgtctagagtgatggtgaccccaaaatcacaagtctgccttcacaaggtcttctacatttctcacgggatttgaaatctggctttggaatagcagatttttctacaatgagacacctaaatatttctctttaggcaagaatggaagagatgatatccccatgatgaaaaagtgttaaaaataaaatattttaatactttaagcattttattcctctcaaataaaatactcatgggatatgttacccatcattttcttctctaggtaaaaggtctagttaaatttgaaaaccaatacagtaatgcagtttatagagtgtccttgtaatgttcttttaaaaacaaaaaacaaaaaactggagaggacattaaaagaccccgaatgcacattttaaagcagctgaaattggtccagtgctctttcaatccctttaaatgaaaagggttctctctaaataaactaaaaataatttggcttgacacactgtatgaaaatggaaccccagctcatttcaaggtttcataggcagaggcaggttgatattactttgcattgggggaaaaaaaagcttattttcagctatgtgtcagtattttatattacattcttataggaaaagggctagctatagttatgaaaaagaatataaacagaatcttgtacttaactaagcagccatgcttagaaagctcactgaagctgaaacctgttacaagaatgataacacccctcaacactcgaggggaaaaaagatttcattgtttagcaatatttctaatactctaatattcaaatccacccagtccatacttaaggctataggcagctctttagtgctgaaaacaaacagtttttgatacataatttggtctgaacaatttggtttgacaaaggtttacaaaaaaaaaaagaataaatctgtaaagactctacagctcccatttatggctgtattcattttgcaaatcagtgactccatacagttgcaaaaaaagcaaaactctcaatagggaaatgtgatgctggtgctcatgacactgaatgggtaatgagttacctagccttgtggccatatagaaaataagtccttcattactgcacaatatcacccataagacacacattctactgggtgggccagaaaaccatgcatgctttgttctccagatagacggcacaacagtgcccatgaatgaccttcagccacacatcaagctagcagggaggcaagagtccctgcagctggggaaagcaggtgcttctcacactttgtgggtgccccattcactttgtaaatcaaggttacacaactcaaaacatgtcagaatagttttctccttcaaagtccagttaactcatagagatcttaataggattcacaagcattatttcaactcggcccctggtgtatgggaagaactggacttggtaaaaaccttcacagggtttcaaaacacaaatcttggactgcattcagatcccagtactgccactttttagcagtgaccttggatgcactgcttaatctgagtttcaatttgtcttttgtaaactaaggataatatccattcttacttgcatctctacacatgaaaagaactcaacaacagtacctggcacaaaggtgttccataaatggtcagaagccttgggctttggatagtcaaaaatgtactggattcaataatgtaaaaaagaaacaacagttctacccttcaggttaagtcggtggaaatacatgcatctaatttcactctcttgaaaccccataaaaaacacgtaaaggaattgttttttaaaagacaaactcaggagaacaggagatgggacaataggaacaacattttggaagctccaaagcagacagatgagtggtaaccaactcagcaggcaagggaaaaagatgaaaaaaaaaaagaaaaaaaaaaaacctcaaaccagcagtgaccaaagctgaaaatgggcacagggctcctctgaaactgggggataagggggtctcaaacgtgcagaggctggaaaggaaggcatctgagaagctgttatgtctagctcccctttccattccacagagggactgcactttccccagccaggaaaatatccaaaggattatttcctaaagagggtaaaacatagggtacctatcctgggaggcatagtcaggtcatgagtattctaatgaaaatagggtcattaagtgaccaaatacacactgaagcctgaatgcagagagactgccctcaagtcctctttccccaagaagctcccagactaagcactagacctacccttcctgcaggagacttgaaggcttctctagggcatctaataacccaaggtgaaagatctaaagatatattgtcataggtatttcccaacaaatgcccaacccagatcactctatagtgaaaaaaaattcaacaagctccaccaacctgcttagcttcagagcagctttctagttcccaagaaaccaaggattaccagacatctgagaaaagcctctaccaaggaagacagatcaaaataagcaaacaaaagagcactgggaacagaaactatacacctaggagaaaaattaagcaaatatataccaatgatatccttggagacataagatactacatccataaaataagaaaatgatttttttaacccaggaaactaaagaaccgaaacaaacacttttggaattgaaaattattatgagaaatcaaaaataagagaagtgttagaagatattactccaaaattagagcaaatacgaagagacgaaaaataggagaaaacagaaaatcagataactgttatggagattccagctcctgagtgttagttgcagaatgaaaagaaaaatggagaataaatgtttcaaaaataatttcccaaaactgaagaattgaggtgtcagaatgaaatggcacatagtatgtcatagaatgcccagcatagtggatgaaaacaaacccatgtcatggcccattagtgtgacatttcagatccttggggacaaaaagactttataaacttgcagagagaaaaagaaatcaggtcctaagtatcctgtcaggaatcagaatggcttcatacttctctacagcaatagtagaaacagaagacaacagatcaacgtattaattttcctttagagctttgaattctactcccaaactcccaccacgtatgatagtagaatagacattttcaggtatgcaaggcctcgaaaaacttacctcccttgtaccctttctcacaaagttactggaagtgctccactaaaaccagcaagcaaaacagaagatataaaaagaaaagaagctctgactcaggagagaggccaagggaagctccggatgacagctgtgtactaaaagaagacaaccagtccagattggtgcaatgtgactcaagagaggggcacactgagaactttcatcacaagatgcctgctgccgttaaacctgaaaacaatgatggggtgagctggatgaggcttcttctgttttgcttttcctggcgtgggctgaggagattcctgttcttctccactgcctgaaccagcaaaggactctcatttcactccaaggcaggcttctgagaactggaggcaggcatcaaagagctgaagagtaggaaacgcagagcagcctgtgcccccaccacattcctgctgggcgctcagtaccagttccacactaagtgttgtcaaatgtcctgcctatcaggagacccatttttcctcagattcactcaaggctttacccaccaacttccccacaataagctctgaaagcagaagccagatttctcccagagacttggtgggctttcatcaaacaaaaccaatgtctctctttccttgcacagctaggtttgtgcttgctgcttggttttcaaaaccatacaatatattgtttagggatacatacataactctggatgctaaaaagataaggaagaaaatgagtgacaagtcagggtagtggttatctctggaggttatgcaactgggaaagggaacagaggaaaggtctttaaggagctgctattttcccatttcttaaactgggggtgtgggcccgttagaattttaaaattattctttatattgtacctatatctactaaacattcttttgtatttacaatacattttgcaatttataagatgatttgggtcacagattatgttacaaagagtacaagaatctataccatttgtctctgttgttccccataacagcagtggacagtctgttcccaccatcacgatcctttaatatggcccaagacagcagtcacagaacagcaattctagaagacactttatggcaggaacaaacagaaacaagaccctctgtaattagctttcatatacagccatgagaaatgccctaatgcacctcaactagtggggattcctgcaagctgacaggcttctgaaaccgaagtgtctagccaaaagagattgttctcaccatttccccaacgtgacttagtcttgtttgaacaaactggcaattccaaaataaataccccagacaacaggttcactttcccagcatgattcagatgaagcagcagaaatgtttattgttaactactgacccatgtttggtcaatttccttaaacactatgtatgctatgcgcataccaccatgactaaaagtcacttttcttgaaaggcatcttgctattcgatttcactaagctgctccaacagaaaaactctttccaaattctcatgtgctgaatattttccttacgtgtgtagtcaaagaaagaaagaagtcattctacagcattcacagaggactgaagatgcagcccaagtctcatgctgtttagccatctggctgagatgcggcctgccttccctacccaccgattttctcttacctcttttggaattcaactcaaaattcagaggcagacaatcgaaagcaactgggcactgatttgagtaagagcattatattccactcacctgactaataaagtgaaacagctggctacgttacattaacaccaatggatttataccttgacttttctaaaatatcactggaaacagcatcttcagaaagaataatttttctcagacttaaactgcctccacttgaagaagattgctccattgtgaataggctcacctctgagaaaactcagtgaagtgtatcaagacatggccacagtactctttttcatcagatgtttctgataaaatattggccatcaataatgactcttctcccagattagagcttctcaaccatggctgcacactggaatcacctggggagctttaaaaactactggtgcttgggtctcaccttccaagaatgagctactaggtcagggatgtggtctgggttgagtttggaaagctccccaggtgattctaatgcgcagtcaaaggtaagaaatatggtctattagagaataatagtgaccagtttcctcctgtcgaaaatataagctaacatttcctaaaaaccatcactgctttaacagtgtgtatgtttacatatgccatgcagcatagctaagtaattaagagcacagaatcttgagttaggctacctgggtttgactgctggctttgccactcactggctgagtgatcttggacaacttatataactgctctgtgcctcagtttccttatctgtgaaatgggttaatatgaatacccatagatcacaaaatggtatttaattagttgatatttatagaatgcttaaaacaatggatatgacacagaacatgtcttagtaatgtttgctggataaactgtcaagccagtttctgtcaagaaccccaaataatacagaatcagatacgactttctttggaatgccaatcgtacatttttagtacaaaaatctctcagattttttgtactacctcttatttttataatggaactttatccagctctggccaaaggggcattttttgaggtccaagaggaaaatttaacataacctagcgacatttctttattgctgggtccaaccctctctccagcatttcagacatccatgtcattgttaataacctggtgtgaaatctgagcactatatttgcaggaattggcaagaacggctttagaattccaagttttttattttcaaatgagtatgtaactgtctcacctagaagataaaggagtattttttcaaagagttctctgtagccttgtaggagatagaggtccttggatttttcttactttaattatatacatatatatatgtatatatatacacacacacatgtatatacacatatacatatgtatatgtatatatgctgcatgccaagcaccatgcacagaaatttattgattcaaaaaatatttaaaacaggagatcaaaactgaatgcagtcctaaaatgtgagaacagacacttggctgcacaagcttttcaactacacagataaatataaaatagtatttgaggaaaaatagtttcatacacgtagctcctaaacacagaggaaggctgatggtaaacatttcagagtctctctgtcttccactaataatagaactgatttattatcaaggcagtgcaaaaatgctgcagaaaggttgtgtgaagagagacagctccaaataatattgcccaacaccacttcaaattcattcagcttgccaatgctttcattcaaaaaccaacacttaaattctctaatgccacaaaatcgcttcttaaaaataatgaaagctcattttgaaacatgcagattactcatcagacactgctgagagagtgtgtaaacaggctcatttctacagggcaatttggtactgcatattaaaagcatttacagtgtttatcctctaacacggatttatccttaggaagtaatggacactcatgtgaaaaatgcacgtgcaagaaaggtcatcataacattgcttaatagcaaaaaagagcactgattacctagagggtggtatattcatacaatggggtcctgtagcatagcaaaatattgagtgaaatgggaaaatatctgcgataatgttatcaggaaaaggtggttaagttatttggatagcaggactccatttttgtgggaaataaggatattaatcactgaaaaaatgtatggaatgatgcacagcaaaatgttaaaggaagttatctttgattaatgggattgtgggacattttctttcaggcagtaatttttaattattcaattatgtatggctggcacaataaaatgaataaaatagctacaattttaaaaataaaatgtaataaagatatattaaataatactatgtatataaaataaagaaggggaacagaccacttttcaactttcccatatttctcaagagttgtctaaaataagttcagtaatggcaccaagttaccacatagttcttatccactaagaaatggccagaaaacaaaggcagtggaactgaacattttaaaaccaaatactgtcttctgaagtgagggctacccatattggattggagtcagcagtcaagtgttttaaaactttaggttctcaagaccctaactttggcacatgctaacagttcagttacctcaccatttttctttaaaaatatatatatatattttttggtgggggggctttctggtaaaaaccggaaagcctgctagacaaattctaaaagagctgtaacattacttttttttatctttaaacggcatctcaagaactcttctggaagtgtgaattgcccaaaggaaacagatgtttaaaggaactgaaagcttaagtgtccccaatttacttcgacttatttcttaccacactgccaccgccctcccctttgctttatttctccagttctcccatatttcctaaaggctggggtccttccctaccagggaccaggctgaatcaggaaagattcaagggaatctagggtttgggggtgcccgggaaacagctttgaagccattcaatactcatttggtaatcttaattctaactcagaattgtttcttctctttcccaccttttttttttttttttcctcaaggctaaaactagacccgagaccagtctttctgcagacactaaacatagccatgttttggtttctgcagaatcaggaagaaggtgagtcctaaaaatggttgggcaagttcaatcgtcagtgctcacctttggtctcacacagatgcctcagatgtcagaatatgaaatcacagaattatagaaaattagagttgaaagtggctttctaaatattatagatgaatgctacgaaaagtgtgctcactggtctaccagcagcagtactgcttgggtgcttgttagaattgcagattctccagtcccaccacaagtccactcaatcagcagctctgcgtgtggggtccgggtacctgcatgtttactagctctccaggtgcttgaggctcacctaagtgaaaactactattatagagtaagaagctgaagcacagtgagagtatcatttatcttcacaaaacgagagagaggaaaaaaaagcagtgagacatctaaataaagctacactatttttctgtttcaagatctgcaatgctgtacctgcaggtctctggattatctttcatttctagttgtcttttcgtttttacatcactacccttggagaaactgtggcaaccattacagagcagcccagtgcagtctctggagcatgaaggagcatttaattcaaactctttttacaaatcactagattaatgaaattcatcatacatgcgagttctggggtgtcgactgcatgcaaatcatatctaacaagctaagcgcagacttctaaagtagttcccagaaaatcagagcagcaaatgccagaataggaacttgactatatattaatgtaaaagaagaactagagtcccttatcttattttctcaggctgtccttctccacatccacaccaagactcagagaggagctctgaaatgtagggagttctagctcacaaaataatttacatttccaaaagatcatttctaaatcctttgtttgaaagctggacacatttcctcattaaacaatgttataagtggtcttaaatgtccaatcaaaatagatttacaatgaaattggcattataaaaaatctaatcatttaaaaatacttcctctggaaaaaagttcaagctccaatttaggtgtaacttcacaaagggggccccattaggcatggggatcacagcagtagcttctggtgatgcagaaatgttgggggtgggtgtctggtgttgcattcatcacttccaggttgtaaatcaccaatattatggacttaagattcaggatcccaagacaaaaagatcacacttactacatcagctactatcctagaaaactctgacctaataccttaaagaaggctgtagctctggctcgtctgggcaccaagaccaaagtcaactgatgtcttgtttttattatcttttacattttccaactctttcaccccccaagttgggctaggtcctgcctctttgtaactctagtctccacttaatgttacataaaatatattaatgtcttaagaatttaatatttttcaaaggaattagtctaatttctactcccttttaaaatattaaattcatttaagaagtgtctgttcatgtcctttgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccttttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccacattgcttgtttttgtcaggtttgtcaaagatcagatagttgtagatatgcggcgttatttctgagggctctgttctgttccattgatctatatctctgttttggtactagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacacatgagcatataatgttcttccatttgtttgtatcctcttttacttccttgagcagtggtttgtagttctccttgaagaggtccttcacatcccttgtaagttggattcctaggtattttattctctttgaagcaattgtgaatgggagttcactcatgatttggctctctgtttgtctgttatcggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccccggccagaacttccaacactatgttgaataggagtggtgagagagggcatccttgtcttgtgccagttttcaaagggaatgcatccagtttttgcccattcagtatgatattggctgcgggtttgtcatagatagctcttattattttgagatacgtcccatcaatacctaatttattgagaatttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtatccatttacgcagccaaaaaacacatgaaaaaatgctcaccatcactggccatcagagaaatgcaaatcaaaaccacaatgagataccatctcacaccagttagaatggcaatcattaaaaagtcaggaaacaggtgctagagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactatatatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcttagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacaggtatacatatgtaactaacccgcaaattgtgcacatgtaccctaaaacttaaagtataataataataaaataaaaaataaataaataaataaataaaaatacaaaagaaaaacaacaaaaaaataaataaaatattaaattcataagacactatttttatgtaacattaaagaaaccctacataccttaactgttgctcccaaatcactccatatcctccagtcctaggcaaatactaatttactttctggctctacagatttgcttattctggatcattttatacaaatggaatcatataatatgtgatcttttgtgactggctcatccatgatatagcatgaatcagtacttcatcccttttaatttccaaataatattccattgtatggatatatcacattttatttatccatttatcagttgatggacatttgggttgtttccacttctgagctattatgaataatgtgcctaaatgcccatttatacacaagtgtttgtaaggaaatatgttttcaactctattgggtatatacttaggagtgaaattactggatcacatggtaactctatgtttaaccacttaaggaaatgtcagactgtttcccaaagtgtctgcagcattttacattcccaccagcgatgtattagggttccaacttttctacatccttgccaacacttcttttttattatagacattctagtgagcattaagtggtatttcattgtagttttgatttgcattttcctaatggttaatatcatgcgtttttcatgtgtttattgaccttttgtatacttgctttagagaaatgtctatttagattctttgcccattttttaattatttgccttttaaatattgacttgtaagaattcttcatatattgttgatacaagccccttttcagatatatgatttgcaaaagtttttcccattttgtgggttgtaacatccacttttttgcttatcacacagaatgtgtctgtctgaatagttcggtagtacagaatatccacttattcccgaatactcagctcaaggggttgcagtcacacactagctggctttctcactgcttagtcccacctaaggaccttgtcattactcttccctcagcctggaacacttctggagcacatggcctgtgctctcactgcattgaagccttgcttcaatgttaccacctttgagagaccttccctgcccgttttctctaaaattgcaactcctcccgcccacctctccattctcttaccctgcttttatattatgtaagtgcaaagaaaatatatcaagaattgagatttgtcagaaacttttgtttgcctttctttgactactggttaaattgaatgttttcttggatgtttattggcagccatgtgcatatttatatttcttctttgtaaatatcccattcatgacctttgttgatttttctattggcatatttgtctttcttgttaattgttaggaatactatgcctttgtctattatcaataattttcccagcttgtgttttccttgtttattcatgctgtttgccatatgagagttcatttttatggagactagtctatttatatttattcattgcctttgatgcattctttttccaggaataaaaaaagtgattaggtattatacttaaaacacttatcataacaatccctttgtcatactgccctatgatttctcattcagaaagcacatacatcatactactgcagaaacttggttttccttcatgctcagctctcatacctcatcacagcaactagtagagttgctttcattatattaaaagcatttagcaactaaaaggtccactgtgggagatgactacattaacaaccccagtaagtcacacttccccatatctaagcccttgtgtagtcttccctcccacaatgacactgggcttggtgatgtgacttgctttggtcagtgagacatgggccaatgttatgtagacagaagcatcaagactgcttgttcattattcctgagaactcatctgctatgatgtgaaaagcttaggctggcctcctggaagatgggagagaatgtagtgtgccaccccagctaaggtccaaatgcatgaggagggctagatgacaccatgtggaacagagatgggccatcccagctgagtcaagcccatactaccaacttgcctaattgtgaacaaataaattattgtcttcagctgcgaagtttggggatggatttttatacaacaatagctaatcattcccttaccagtagatgtatcttataattcagttcaatgaagtgctatgtggccagtatatctttcaaaacacacacaaaaacataaaacatttttatgctgggttagaggaaaaacatggaggataaatatttgtgtcaatggggataaattaaatggtagatggtttatgccaatttccataattactgattgcatttatatttatttcatgtaaattttacaaggttttaaatggaaattcttttagtaaaacagcctttaagatccatctgtagagtatctattctgggtcttctcccacaactatacttaccccatggcagggaccacagtctctaccattgtgttcttagaaattactcccttgactcttgtttgagcagttttatgtgattatctaagtctcaaaataatatcatcctatctgtatgatataccctacatgatatgtacttccagaaagcgaagtatccctgcttactaattaacaactgcatattttcacatccagtttccacgcctgtttcagaatatcatggtcttctatactctaccttgtagtattgatccctgtgctgaggtattcatgaagggataccttctgcaaaagagacttgggaagggcagaccaacgtctactcaagggacttccctatatgaagggaaatttatagaattcaatctaatgtgtacataatgctggctgattccttggatgatggtgttcatgaggtcacagtttggcttaaacagacaaattagcctatttcatgaaaacaccactcccaccttctcaaaaaatcttgttctaaagccacagttcattcaaagccctgggtatgtgattttgaaagagaggtgctaatgtaatgcccattgctattagaaagaatataaagcagccttcctgcttattggaagaaaagaacatcactttttgttagaaactgcccaaattcaatcaagcaataagtctatgacacttgctagctatgtaggcaagagaaatgaggcttggaaaacaaaaaacattgctaaattataccctctcatccctcctatttataggttgtcaaattgtaagattccactcttagctgggctggacagatgagacagaaacagcatatctctggaagtgacaaacagctggcagagcttacgtgcttcccttgctgatagaagaaacagaacaaagggccaaagaagtgaatggcagtcagtaagcccgaagtgagatgcttttcacaagtgggccttccatttctgtgctttacaaaaaaagaatgtagggggttggggagaaaaacaagatcaagggaaacttaagaccctttgtatgtttaggctttccagctgggtacacagctcacccaaatatctatcctctcctgctgttactaaaaatatatggaacagctcttccaggaggaaaacggtcacatatcaccaaggagacaggaagatactcatgatatggtttttaaaatgacttgagaatccaagcaacccttgattcctctctctggactctgccaagagggtaactaaagtttctgcctaaaaagagattttcttctcagatagaattttgtctgttcacatctgatactgggaatcagctgaaatctaaagtgccttaaaactagttcattgtgaaggcagacattctggcaggaaaactagaaaatgctgccaccaaaataaatgcacattgtcttgcaccaactgctactagaaagagatttcaaggattctagcagaaaagagaggattgacaagaaattgagcatgggagtgctattgggagaaatgtaaaacaaaatcattttcaaatgaagggtatttctcacaaaattggaaggcaaagctttctttctatgatatgcaacatggaagaaacaggatgcatatttttctcacaagtctcgcacagttgcttttctttgaataatgccctttgcttgcttcctgctgccaagaaaatgtagggcaagctaatacaagcactgcaaaatgggggactccattaaacctgattgcaattcatctccacatccccagtacttgattgactcaaaaaaggctggctatttgtgtgattttcccattattttctcattttcataatgcctattgtctttgaattcaccattaatattacattttatatttggtcattttgttccccttctttcccatacaaaatatgtacaattcttacatatgtgcttaattcacattcaagagaggataaaggggtggaggctcccctaaaatttccaaataagatttttttttaaataagtgtggaacttgggtgaagagaattagataaatcctattaatcaaaatccttgattcatgaggactcatcatggcattcttgtgtttattatattaatatgcacatacacacatgaacccactacccaaaagagactagaacatggataataacttacatctccctatgtagtgatctccatttccttcccctgcctccctcatcccaggatagccactattaagaaccatgtgttgtgttgatctttgatatattcctgtcatgcaatcctgggtgacttactttaacttaataagattcatccgcagtgttgtgtattgcaataattcattcatttctactgctgtatactactcattgtatgaatcagggaaagcagaaagtaaaatttagagtatgaatacttcattgcattaatttattttacctttgttacttcttaagcagacaaatgttatatgaagcatcacttgttttaaaacaattgaccatatataacaagttgctactgtgtttattgtactttataactaatttcttcactttccttttttcatattttccaaaattgaatgctcattatgggttctatactgggttttcttaaagattagtgatattagaactggtgcagattagggctgccaatccaaagtcagtttgttataacagtagtcaaattagactcacccccaaattctaatttattcaacatttccagtgatctcatggccagaaactcctataaaagatataaggcattagtgacaccaagctgaacaaaaccattccttttcctcaaagttctcactgcctaatggaggggggaaataataattttaaaaatctacaataatacaagaggtaattgcagagtcttagcccaggaatcaacttcctggtagaagaagaagaaaaaaagggtatactaaacagagggacattatgcaaaggcacagaggtgggagagttatcaagtgatcagaggtctccaagcacggtggtaagaaaatcaagagttaaaacttagagcatcttgaactttgtcccaaagcaactttatcccagggagccacatagagatttcacagagaggagggataggatcagatttactatactacaaaatgggtggcactagagagtgggctatgggtaagaacagttagaatactagtctatgatccaagcaatacgtgatgtggacctggactgaagcagctgcatggatcatggatacaggagaggaggacacagatttctgtgatatttatgcagcaaagttgaccaaaaagaagacacagactcaacaaaaaatgagcttaacatacacattggtggtctaaaagtaactgcagtacaattgtttcaagtgccatgcctaaaagaataaaaagttgcccataggaagagaaaagcctctctggaatatcgcttccatcccaagaaaccttccaaatactgaagtatgttttcataaattaccagttattattatttgaaattatactcacagaatacaaccccaaaatttcttataacaagctaatcttgttatcacccacagaagagaaaatgtgacacccagttgaaatcttagtctaattgtgttttaaacatatagttcattctcaatattcacagcacttatgttttatgaagtcaccacaaagactgaattaacaaatactgaaccattgctcctaggggaaatacaggagtaagttcctacaagcctctggtcacaacatttttgttacctaatcaatacataaccttgttttatatgtgtttgtttaaagacactgtacttaacatatatttttggttcattatcattaactcgcagccaacactgctctaactcatacccaaaggaagctcatctaatacacaaattttctctgtaaggcacatcgcaggcttcttgtgcttaggaacactgaacagcccttcagcactatagttaaagaccaccttaaacaccaaaatcaacaacataaagcacaaaaatcaggaaaaacacagcactaaatagattacaaaaaaaaatacttgtttatagtatgagagctgaaataagaaagtagagcattgccttgtttgactttaacagggaatgtgcatgtcaggtgactcaaattttttcacttctctgtgcatgtctgtgagtgacagcaaaagcaccagaagtaccgatttgggggttacaaatagtaatagattctagcaagtcagcaaatttgcaaatatagaatccacaaattatgagaattgactatatttccaagagatcatgtcctaccttgaggcctcaaaaagcactttcgtaggtggacagagaaagtcagtaacaatgccaaacttttagttatgttcttttccagaatgagttcaaaagtgtctctcagacttcatatcaagatgacccctttgctcatcttccatgagcctggaaaaagctcagttttaaatcaggttttaaatataagaagaccaaagctttgaaaaattgagcagcaagttcttatttcagaaaaaaagaatgaaaaggaccaggaatgaattctagatggcctgattcctaaacacctaaacaaatgtcccatcttctgtggtagtgcttctcaaactttagtgtgcccgtgaatcccctgggaacttgtgaataatgtaacttctggttcagaaggtctgaggtgagacctgaggattctgcatttctaactagcacccagatgatgctgatgttgcacagacttcgggtagcaagggtgtagatcacaagctcccccaagaaatttatcagcctcaatatagacctacgtccaatagatgataattacttagattttaaaaagcacttcagtttaaggttatatattagatactaaaaagtaagtaaactttcagaatatcaacagttccacatataaagcagtctagaagtgacaatgccattgattttactgcctaagtctattagtgttgtatggaaaataaaacaaagtaattaggatctcaatactgctttccaaatagaatctcaggtttgggagtatttttctcttctctcaactgaccattagcagcattaaggaagtaaagaaacagtcatctgaaagatacagaatgcttcacttgcaggcaactgacacacaagtgggcaaagtaccacttgtccattttaacatgcagataagggaagctgttatctgcagataaaggcatttgcttctcattgcctctatgctcttacccccagatacacagaatacatcaaagactactttgtgaaataaagggcagtagaagcacagatcacacaacctgtcattttggaaggaaatctggcactaaagagccagcaagaagagcagtttgatgcaaatgccccagtggaaatttgatttttaagatataattcagaggaacgttagtctcccacaaagatttgtagagctacaaaaataaccacaaaccagataaaaagaagactgtgttcactactactgcagaggggcagacaattgtagaaggcagaaagtaagaaaggcctctgggacactcaagactgattctttcaggccactgattccaacttgatagtttgtgtttaataatttaaatttaacaattcaaagttccatttgaaaccaaacatagggttcttcaccacttgagcaagtctgattttccatgctacttgaggactgttcatagctgttttattttccttataccaattttatttcagtacacatggtaccagttgcaattaaggagaaaaaataactgtcttcatttgacttcttctcactaatgtaaccttgtttttgttgtatttttaaatctgacaacaaaaaggcaaaatgcagataattatacttcaaatgaggacatcacatcttagctcaagctatgaattgagaacatttcagaacatatgtaatgagttatatgaaaagaaatgattaaagaaagagcagagatgatagtaaaaatgtaatgctcaagggataaaagttagatattaggaggagtgtacttgaaacaatagacacattggaaaatgtcctcatctatattcctgtacaaatttgtttttgctttgctcaaaaccataggagaaaagaaatgcaaagaaaagttgttattttctgatacacatcagaaattcttcaagcaaatggagggacaaaaagaactatttgtcccaggaatcccacttttaggaatctgcactaagaaagcacccccaataaaaaaatacatatgtacaagattattcgttaaaaatagtttgcaattacaaaatattggaagcaacctaaatgtccataaataggagaatggttaactatgatacagttacatgatggagtaccaagctgctataaaaaaaaggaagaggaagatctctataaactgatatgaaatgatttgtaggataaactgttagaagtaaaaaaggcaaaatacagactttaagtgtcctcaccgccacccactccatgcatgcacaaaatggtaactctgagcgataatggatatgttaattaatttgaccatggcaatcattatacaatgacacagatatgaaatcatcacattgtttgcttcgaatatagacaatttttacttgcataaaaacaaattttattgtatttctataaatgtgtaaacatttttaaaaagcaaagtgcaaaaaagtatctgtagtatgctacccttcatttaagaatgaaaacattcatgtatcttctcatttgtgcaaaataaatacattaagaataaaccagaaactaaagatattggtatctaaggcaatagagaaagggatgaaaaagcaaggggatgggaaggggtgctaagaacaaaaaggaaatgtcacttctgtgtatactgttttgtatagccctgactctgagaagcattgtcatgtttaatgtactgaaaatataagtcagtaataaaatcacccagtgtgtttgggggaaggggacaaaatggaatataaacactaacaaagaacctaattatatcacaagtgaataatgtaaccataatgaagagagtggggaagaaaagaactaaccttattaactgtataaaacagcatcatgactggctactggctactgcattttaagacaaaaacaaaaacaaaaaaacaaaaaacaaacaaacaaaaaaacagtacccagaactactctagttagtaaatgtgtttcttacaagggtacaggttagcagttctgaaaatactccatgtctacaaggattaaagaaatacagacacatgtttacatatattgtagataatgaaaaccaggtttctcactatcagagaaagaaggctataatgaaccatgtggtattagattagaatcagaggtttcagtatgaactcatagtttttatagatgaatgaatagatggacagataaatagatggatagaaaaagagaaactcagaaaatgttttagttcattttgtgctgctatagcagaaaacctgagactgtataatttataaaaaacataaacttattttctcacatttctggaggctgggaaatccaagattaaggtgctggaatctggcaagggccttcttgctgtgtcatcccatggcaaagggcaaagagaaggcaagagagagccaaaaggaagcaacacccatcctcttgtaagaaacccacttttgaaataacaaacccattcttgcaataacagcattaatccatttatgggggcagagctctcatagcctaatcacctcttaagggtcccacttcttaatactgaatgacaattaaatttcaacatgagtttcggaggggacaaacttttaaaacatagcagataaatatagacgtgtgtttgcacagttattacactcaagtatatttcctagctgttgctagggccaagaagcaatgacactccagtggcaacaaacatacctagcacccagcccctagtttctaaataccatccttccataaaaggaaccacaaaagggtgggatagaaaaaatatttatagaattaatggtcagaattttctaaattttatgcaaacaataagcccacatattcaagaagctcaacaaaccccaagcaaaacatgaactataccaagatatattattaaaaaattgctaaaaatcattaagaaaaaaaattaaaaaccaccagaggggaaaaaaagttacatatggaagaacaaagataaggatgacatacttctcattagaaacaatataagcaaaaaaatctaggagaaacatctttaaaatacaaaaataaaaacaactatcaacctagaatctatactagcaaaaatatctttcaaaaacaaaggtaaagattttttcagatatataaaagctgaaaaaattatcagtgaatcataaaatatgttaaaataagttgttcaagaagaaagaaaatgatattagatataaatatgggtctatgtaaaggaatgaagggcactgaaataactgcttgggaaaatataaaattattttttcttatttaaatatctaaaatataactgactacacaaaaataacaatggagtgtggtggtaccccataagtacatacacctacaatgtacccacaaaaattaaaaagaaataaaaataaaatgtattaaacaatagaaaaaaaggctaggaatggagaaatggctgtattttatactatcacagggttcatagactataagcaaggtggtatactatcacttgaaggtagactttgataagttaaatatgtatactatgaaccataaagcaacaaataaaagcacaaaataaagaattatagctaataagctaacaggtaagataaaatagaatcataaaaataaaaaataaaggagataaaggaaataaagaagtgatgggacaaatagaaaacatggcaagataatagatctgaacctaaaaatataaacaattatattaagtgtaagtagactaaacatcccaattaaaaggcagagattgtcagattaaattaaaaagcaagggtcaactacatgctggctacaagaaagacactttacatataaaggtacaaataggtttaaatttggagtgggaagagatatggtttggctctgtgtccccacccaaatctcatgttgaattgtaatctccagtgttgtgggaggggcctgacagggggtgactggatcataaggcggatttcccccttgctgttctcatgatagcgagtgagttctcatgagatctggttgtttaaaagtgtgtagcacttcccccttcactctcttcctcctgctccagccatgtagaacatgctggcttcccctttgccttccaccatgcttgtaagtttcctgaggcctccgccagccatgcttcctatgcagcctgtggaaacatgagctaattaaacctcttttctttatcaattactcagtctcaggtagttctttatagcagtgcgataacagattaatacacatactaacactattcaaaaaagaactggagtggttatgttgttatgttaatatcagacaaaatacatttcagaggaaagaatattaacatggataaagaagcttatttcataatgataaagggctccatttatcacaaggacataacaatcctaaacatttaaacattatgcttcagaacagcttcaaaacacataaagcaaaacttacagaactgtcaggagaaacagacatatccgcaattataactggagatttcaaaaagactctctttattgatagaacaagtattgagaaaattagttaaggatatgaaaggtttaaacattatcaatgttgacatgacattccacccaacaacagtagaatacacaatcttttctagcacaaatggaatatctgccaagataggctacattcttggctattaaacaaaacccaataaatctgtaaaggattcaagtcatacaaagtatgttcttcccacaaataaattaatttagaaattaataaaagaaagatctctggaaaaatctccatttgaaaatgaaataatacacttccaagtcatccacggattaaagaaaaaaatcaaaagagaaattaaaaataattttgaactgaaggaaaatgaaaagacaacatatcaaaaattttgggatgcagctaaaacagtacttagggaaaaatttatagcattgaatggctatatgggaaaagaagaaaggtctccaatcaatgacttcagcttctaccttcagaaatcagaaaaaaaagagaaaactgattccaaagcaagtagaaggaacaaaatgagatcagagctaaaatcaatacaataagacaatgaaagaacaagaaagaaaaattaatgaaataaaaaacttgcttattgagaaaatcaaacttgataaatctctagttggactgatttgaaaaagcagagggaagacatgaattaccaatgtaagtactgagaaaggtaacaacactacagcttctacagatactgtaagcataatcaaagaatattattaaaaatgttatgccaatacatttaatacaaaatacaaaaatgaaaacaactatcaacctagaatctatactagcaaaagatagctttcaaaaacaaaggtaaaaattttttcagatatacaaaagctgaaaaaatttaataacctagatgaaatggactgattccttgaaagacacaaactaccacagctccctcaaaaaaccccagacaacctgaattgatctatatctactaaagaagttgaaatcatagataaaaactttcccacaaagaaaactccaggcccagatggcttcactggtgaaatctctgaaacatttaaggaagaccagtaccaattctatgtaatcacttccagaaaacagaataaaaaggaacacttaccaattcagtttatgaggccagcattctgttattacaaaaagcaacaacattataagaaaactatgcaccaacaacccccatgaaaattgatgcataaattctaattaaaattttagcaaaattaccagtttgggcaacacaatgagactccatctctacaaaaaataaaaaattagccaggcatagtagtgcacacctgtactcccagctagtcaggaggctgaggtggaaggactgcctgagcctaggaggtcagggctgcagtaagccatgatcatgccactgtactccagcctgggcaacagaatgtcacaaaaaaaagtcacaaaaaaaatttttagcaaatcgaatccaacaacataaaaaggataatacattatgaccaaatattattttgcagaaatgcaaggggttatgtcataagaatgttggagaaaagtagaatccagatcagaccagaaatttgtagtcacaataccttagaattatcaccagttaggtctttatagagaagtaaatggaaattaacgtcaacctactctatagcatcatagctatatatgaatttatgttttatcaaacgcataatgtatttagcgtctacctcataaattaaggggggaatgataaatctggttttctgcaacaaaaacaatggattggtagctttaatgtataaacattctaatgaaacaatcaaataccactaacagaaggtagaaaaagagcaaaagaacagaaaattcataaaatacaaatatttaagtttcaccttataatataaaaggtatatatcatttaccatctttaaatctatacattccaaatttttaaaaatctttgtcaatggcaagagtgtgttgtgattcacattttcttatacaattaatgggcatattggtaagcatcctttgagaaagctcttctagcaaaaattttcaatatttaaaaatattcatgcttaattctaccacaaggaaattagtttaaacacataatgaaatgcgaagacaaagatttaagtgctactaatcataatcttatattagtaaaaaagtggaaacacctacatatgcaacagtagggaaattgctaaataaatgaacctcaggatgaaaaaatacatggccatttaatggtattgttaaaggatttttaaagacacgagaaaattctgatcgaataaatatcaggacacaaatctggtacagcaagattccaaatctgtctcacaccccaggttttgaaagttttgcactgctctttaagctctttcaccaaattgtggcctgaagtggctaagcaactaaaggcttgagcaataccaaatagaaattctgaactcagaaaatccaatccatccttctaatgctaacctggctgcgacctggggtgaaatagccacagatccattagcaaaatggcttccatgtcaagaagcatgctgaaagtaaacagtagaagagtacgcagtgaagaagagtagagacaaatgggaatttaaatgcctgaggtttttgttcatattctagtccattacaatgataaactgggatcattttattagtcatttctttcaaaaaatagaataaggccatttcaaaatagcacttcaggataagacactcacttctggaactcgactgccagtacataaaaatagcaccttgggctaagaggctaaggaagaagggacagaggatgaacatccaaacaaaaaatagtcttttattggaatttgaaatattgttccaaaagagtcctgatttttctcaagttgaaaaaccattttcatcctcagttatgaaatactgaggttaccatgcagagcgacacaattcatcccaagattacatagtggaactggcagaattattcaacgtgacttttctccaacaattcttgattgatggataaggctaagagaagaaaaccagcaagcacagcattttaaatttgtgggtacattctttcttccttttcacagagtatcatttcagcactgttgatagtttgcctaaaataaacccacaaataaaaacagcaagattcctatggttattctgagccatagcctatagtattaagatgtagttaaatacctctaaatgtttcagtgctccagtgcttacctcattttttgccatcatgcaaaaattggtatattctcattacaccacaatgatgaggacacaaatcaagttagaccacccttctatctagcttttctatgtttctcctagagacgcattagcaaactccctatgaaaccttgactacaaataccaccttgatttggaaagggaattaaaaggaaagagaaaacacctgccaagcagatagacacacttatcatttcaagactcatctcaaaccatctctcaagctccaattatagcaattagtggtcaagacaaacctctcactctaagaaggtggttcagcaatggaatcaagggtttccatccactttactgcagacaactgctactacttaccaaggttaaattcaactaccaaagcaaccaacattctggaaattatcctttaggaaagaagtatatattctgtttttcccttcaaacactcagtcttgttttatacctgcaggaataaaaaagacctagaagatgcaaagagaatctaggaatttgtggacataaaactcagtattttatgagagatgttaatatagatttcctgtttcacaatatagaaactcctctcagccaatcatccaggggtcaaatcatgtccaagtaaaattaagaatctttagattaatattaaaatatggtaaaattcagaagtcagttcaagggtgttatccttcattaattaccatgtatattctacctatcagtcacaagctacctgtcagtacctgaattacttcaggtttccttctgtcctagaatataatattatttaatgaatgcatattggaaactacatgaaatttaaacatatcaaacactgttatgatggtggtcacacaactgtatgcatttgtcaacactcatcaaattatacacttaaaattggcaaattttattgtgtatatgtgtacatatatagactctccacaacaaagcagattaaacaatcatattagagctccacagatcataaatgtgaactgataattcactgacaaaacatgaaaataacagtgaatggggagaaaatgtaaggaaagataaaaacttatttccactaaaacagggtttctcagtctcagccctactgacattttgggccacataattctttgtcgtgcagggccatcctgagcattgtaggatacttaaccaacatccctggcttttacccactagatgccagttgcacctttcctcttcagttgtgacatccaaagatctttccagacattgtcaaatatcccctgtggggaagggaaaaccacccccagttgaaaacttttgcattagacacttattacaaaacctattatgtaaagtcagctaaggctggtggtgaaaggtaacaaactggcagagagggaaaaaatgaagaatattcatggctgaggggttatttaggacactttcaaatataggtaatcaatatgatcaatgccttcctccatagctaaagagcacatgctaatctggaaacatctcaagtacatttttccaggagtcatcattatactcatgtctcaagttttgtagccataaatcattgccattgaccaagtctctcaacaacttcataaattggtcatttgttccagtagaacacagaagaattaaagaattgatcatatactctgaggacataatgaaaatatgcattagactttcaataaatgatttttcaagaaatcggctttttaaaaattcaagtccctgagttcaacatttagtcaaattaaaagaaaaatctatactactcattaaactaacaaaatgcagtttaaataagcccctgtgtgggacagactctgggcaaataggtcatttaatcttttcatctcctaacatatgacataccaggttaaaagaaatacattgttttataattccacatttgggaatatattccaaggaaataacccccaaaagaaattagatgaaaaatattcaaagccttcctgatatcaaatattgaaaaactcccaattctgcaaactgaggtgaagcaaaagacacaatactttatcagacacataaatgatggttgaaagaaatctgagtaatccatctagtccaatgccaggtctctgagccactgaggggacttgaaggtagtaaagaaggctcactgggcatttttaggacttaaaagaaaatgcctaggccaagattccagttggtggtgataagctgcaagattcagagaagcaaagaaacaagatcagtcagaacactatgagtgatcctgtattcattcatttgcattgcattgctataaaggaatacctaagactctgtgatttataaagaggtttatttggctcacggttctgcaggctgtacatggtaccacatggtaccagcatctgcttctggtgagggactcaggctacttccacacatggtggaaggcagtggggagcccccatgtcacatagcaagaagagggagcaacagagaggggagaaaggttccacgcttttttcaccagttcttgcaggaactctcaggaacctaacagagcaagaacttactcattaccaggatggcaccaagccattaatgagggatctgcctccgtgatcgaaacacctcccactacatcccacctccaacatgaggaatcatattcaacatgaagcttggaggggaaaaatctccaaactatatcacatccattgaataattacatattttgtattgtattaaaattattatctgtatacaaatattttatacatattatataaaaattccaagaattatagaaataaaaaattttcttaaaaatgtaatttattaatcaaaaatctttcaacttatagaagttaggggaaaaataagatgcctcttatgggaaaatgaaatatggcccagaaactgatataagaatgggcaacaaacaaaaatatgtacttcctcattattacccagagaatgcaaattgaaagcacatctaccagattggaaaaatattgagaagtttaataagaggaagtgctgaagaagatgcagacaactagaattatcaccaatatacaaccatttaaaaaaccagtttaacagttacatattaagttaaagatgcatctatatcttcacacacgttcaacaggaaagaaaagagtgctcgtagcagcattattcataaaagcaaattgaggaccacccaaatgtccgataatggaacagataatttatggtatagtcatataactaaatactctacagcaatgaaaaagaataaatatacctccaagcagcaacatggatggatctcaaacaacgttaagtgaaagaagttacaaaatacaaagagtattattcaatttatataatgttcaaaaatacaccaaaaaagagaaaagaatttggccacttaagagttcattcataggtggtacaactataaagaaaatcaaggagatggtaaataagtttgtatggagtttctcaggaaagggaagaggggaatgaggagaacatgatagagagggagaggggaactgaagtggcttctgggagtactgacaatgttctctttcttaacctgggagattaactgtgtgagtatgtgatttttaattaaattattctctaaactgtacataaatatttttgcagccttttacacatctctcacaacataaagagtctttcaaacacaaaaaagacacacaaccatttatacatatgcaagtccacacctgaataacattaactaggaaaagcagaactccacacgtttgagatgatttgagagatcaatttggataagagaaatgagtggagaaattttcaagtttagatataaggaaaaagaagagagaaataaaggatcatgtgagtttcaggaaatggcagaatggcccaccctaatttcattagttcatcccaatcacaattgcatcaacaatgaagtgctttaaatcatggccatcttttaataatgcccatgtggacgttatctaaaacagtccttttccatttctactacattatttatatatctcccttaaaaaaaatcaggtttgccaggcgctgtggctcatgcccataatcctagcactttgggaggccgaggcgagtggatcatgaggtcaggaaatcgagaccatcctggctaacacggtgaaaccccgtctctactaaaaatacaaaaaattagctgggcatgggggtgggcgcctgtagtcccagctactcagaaggctgaggcaggagaatggcatgaatccgggaggtggagcttgcagtgagatgagattgtgccactgcactccagcctgggcgacagagcaagactctatctcaaaaaaaaaaaaaaaaaaaaaagaaaagaaaaaaaagaaaaaaaaatcaggtttatgtttcttcatgctaaaataattgattagaaaggtaaatctggcgatgctgtcaacgcagggagagtgacagcaaaccaaaaccataaactgacttctaagttacgtgcttcagcagatatcaataactagaacgatcaggttaacaatggtcagcaaatagcaaaaaacactgaattctgcatcatctgaattgtagattatggaccttcttatccttcagtactcagctcaaatgtcaactcctcagagaggccttctgtgatgactctatcaagtaggctcccacaccagcacctcgtgaactctttcctttggaacacttatcaatgcttgaagttaacatatttattttcttgtttattgtctattttcctcccttcctgacagatcatcttgttcattttattcacaattaaatctcagcatctggatttgaacaggcactcaatattcctagcatatttcttgaataaatgcgatgagtaattgaggaaggctgacaggtaagcaaatgattacgatacaacatgagtactatgatggatgggcaaagttcaaagaaggtataaaggaaagaaaatgactctagagtggcagggagagcgtgtcaaaaaaggcaaggcttcccacaaaatgtgacatttgaatgaaatcttgaagacaagcgagattcgctaagcagaggaactagagctggtgaccagaatgaaagctaaaaaatggggaggaagtacagtgaggaccataatgggtcttttatcagcacatgcatggaattttgaacttagtcttgtagataacatgaaactaccaattttatcacactggctttatgagattgttttaaaataactatttcaacagaatggatgggataaaatgaggctagaggtaggaaaaccaggaaactgctgtaaaggtccaagtgaatgaaaaaacagtggtgagatgaaaagaaggaaagggatgcaagagctactaatttaatctaagaatgaaattcaccacggcttggtgattcatgggatgtcaatgaggctgaaagaaaaaacctaggatttatagttgaggcaactggatacaatagacacaagaaaagatttgtgagaggcaggagtgagagaagaaagacaaactccattctttaattgctggagcaggtgtagggggttacttttcacacaaaaggtaacacaactttacacattctgctaaatttagacttaatctgaatgcagctttctcagtctatctgatcaatgccccatcttacaaatagattgtttttaaaatacaaatcctccaaaatccttattagtcaaacctttacaatcatagagacctcgtgcaaagggaggtcagaggccccaaagcagggttggaaaaatattgacatggttacaaatgaacactcgatttaagccaggtctgttaaagttagaccccagggtctataacacttccttctgccacttgatagatctgggacaggagaatggtatctcagtttggtgtgatggtagtaatagaagtagaatacatgtgcattaactaatataacttaagaaacattttgtgttgagctttgtatttgtaacatatgataaattattgtcattgatgttggcgtgtagctggtcttacaagcagaaaaagaggtccatctataggatgtaattttaacagcctgggaggaatttcttttttaaaacgagactttctccaatgctaataccttaaattctcaccagaggtaatatagctaattatcctgatacaggcaggaattcctgttaccattcataggcagtatacgtgactggtcaaattattttctgaaagcaggttcaggtagaggaggcaagatcatcccagctgacaaacttttacttggccatgtgccaatgagccttacctgtgtgtccgtgtgcagattactgtgtctagctagtgtcagctcatgggaaaatgcctgaagattcccattgctttcagctttgtttctttaaagcaaagcaaaagtaaaccctgcatctccagcagcttttaatgccttggcttctgtcttgttcaaagtggttgggggcttatagccataggaggcaagttcacattcttactatatttcacagcagcaggagaaataatacccaggtgtctgagccagcaatttggagagttttaggcacaaggtaattttgttttaaatgacagagtgaaaagactatctatccccatgaaagtcttcaagatttcttatgtcttacccacagcagccataaactaaaggggagaagaaatatttatagatttgatatggtttggccatgtccccacccaaatcttgaattgtagctcctataattcccacttgtcgtgggagggacccagtgggaggtaattgaatcatgaggggggggtctttcccgtgctgttcttgtgatagtgaataagtctcacaagatctgatggttttataaagggagttctcctacacatgctctctctcttgcctgccgcatgtaagatgtgtctttctcctcttttgccttccgccatgattgtgaggcttccccagccatgtggaaccgtgagtccattaaacatctttttcttcataaattacccagtctcgggtatgtctttattagcagtgtgagaaccgactaacacaagagtcaaacctttgaaagtgaatgagcagttgctaagttgctcgcaagagcactgggcctgacattaaggtcccttggaccatctccagcatccactatatgtaaaccttgagaaactaaagttttgagctgggacgatagcaaaaaatgtgacaagatggacctggcctaagttttctacaaaggagccatgtggaataactatccccactacagttgtaaactttgacctttgcggaaaacagaggcttctcccttgtgcatcaagccttggccagattttagaagccaaggctggagtcagtgagaatttatcccttggggcagcagggattctcagagtaccctctaacccatctcttcaaaggtttaccccagagaactgtactcctggaatcgtgcactgggctcagtggggctggagaggtccaagttgaaacctcactttaaacacgaccttggggcacactctggacctcagctgcctcctctcaaaatgaggagtaattacttcctcaatagactgttacaaggaataaacaagataatgcatgtggagtgcttagtactatccttgacctttactaaatgctcagtgatcatagtagtagctattaattgtagtaacaacatcacaataacctaagacagttaactgcatgcagtggttactcctttgttgctgacagaaaaattcataactctcattttgctccacatggaccacacagcccttttctctcttcaagcaataataatccactttgagaaaaactaaatcaagaataaaagtatcttctctctccaaaaccactaaataaaacatctaggaacagagcccatagctgccttaagtttatttatttttttgctaagtatggaaaacggggacaaaatatataaaagccaaattgtttaatgttcaataggctacactggagaccctctcacaaagaatgaactagactaggggttggcaaacttcttctgcaaagggccagatagtaaatattttaggctttctgggtcatacagtctctgttgtagctattcaactctgctgttttggtgtgaaagcagccatagacaatacataaagtttatttacaaaaagaggtggctggctagatttagctcacaggccaaagtttgccagcctctaaactaaagccaggtctgtcgacatggaaacatattaaacaatgttgagcaaaaatgtaagtttcaaaacaatatgcatggcatgattcatttatagttttaaaatatgaaaatactgtataatcattatagatatgtaaatgttaatatgtgtataaaaataagcccaactgataaactctgaatttatgacagagaggaggagatgtaggggcatcaactgtaaatttttcatatttctttaaaaactgaatacctgaggcaaataaggcataatgccaaaatctactatctagtaggtgtagtagtagatacacaatttagttagtagatacacagaaaattatcatatcgttctctgttttaggattacatttgaaatacatcaccaaaaaatttaaatgcctaataggaacaaaataaaattctttattttgaagagacaaggcttaaaaatcaagttaatgcatttttgctttgcattattattattattattttttgagacacagtctcgctctgtcacccaggctggcacaatcttggctcactgcaacctctgcctccaaggttcaagtgattctcctgcctcagcctcctgagtagctgggattataggcgcatgctaccacacctggctaatatttgtatttttttttttagtagagacggggttttaccatgttggccaggctggtctcaaactcctgacctcatgtgatctgcccgcctcagcctcccaaagtgctgggattacaggtgtgagccaccatgcccggccttgcattaatttaatcaaatccataaaatgcactgggttaatgaactacattacaaatgagatgatgtggtaaaaaataaaggcactctacctttgagacataaaattatatactagaaaatgtccagagtaattctgattttttaaaaaagaattaacggttctcttcattatgaaagtagttcatgttatatataaaagaaggaaaacaccttggaaaagaaaagcacacagaaagaagtagtatattaattgtcttatcacccaaccacagctgttaacatttgatgtggatccccctcaggatttgttacatgcattgttttctttacaaaaatggcttgccatatatttatgtatatgtgtgtacatatacacccacatatgtatacatatatgtacataatacatatacacatatgtacacccatacatatgtgtatatgtatacatgtacacatatgcttatatatgtaatttgtagatagctcatttgaacagcgtttttagtacaatattcacttatgtacctttcttttcctgtatttttttctctcaaaattattagcatgctatatctcagagttcacttctaacatcttagtttaaaagactgaatttccagtgatgtggagaagtgtacctttcctccatttgtcatctagatgagaaaaaagccccccaaagtgctcattgaggcaccactcaaagagcggcctgttctaagtcatttacataaccctcaggctagctaccacctctgtataccagggctatcttttgaaaaacacaacataccaagcagttacttgtttgtcctcaaaacatctctgaaggatataaactaaaacaacctgcagcctcccttcccaaatacagcagcagctgttaaggagattaataagtaacttgctcttaccctgtaggagaacctttatcccttagacaagtctctactggaatcgtaggcatccattaatgctgccggccaaatgctttgctgtacctattacacctattatcagcaagcaactcagcattaactgcatttagaactctgggcttactgtgcagttgaaaagaataccatttactatcttatgcctcttaaatgaacatatggcctttcacaactttgtatctccaccccaaccccctcctttaattccaatcctgcctttctagccacttcaaacatctacctgatcacccattttggttagccaagggggtttaagagaggaggaaatgaggtggctaggaatcatacccactcagccaggcctcatcccaactatgaaaagccactcttcaggccagaagggaaaagcatgggctacagtagagctgtccaggggcctacacagtctagtgaccaggagttcactggtccaactccagctgttcaccgctcacatgtctctgctacttctctgggtcactttctccttctgcccctacaccaaccacgtctcttttttttttttatactttaagttttagggtacatgtgcacaacgtgcaggtttgttacatatgtatacatgtgccatgttagtgtgctgcacccattaactcatcatttagcattaggtatatctcctaatgctatccctcccccctccccccaccccacaacaggccccggtgtgtgatgttccccttcctatgtccattgttctcattgttcaattcccacctatgagtgagagcatgcggtgtttggttttttgtccttgcgatagtttgctgagaatgatggtttccagcttcatccatgtccctacaaaggacatgaatatcttgagtttgaatgcctaaaaaagaacttctccattcacatcttacaaggctgattatctcaagttccactgaacacccaacaaacaaatatttaaaggtcagatctgctctccaggtcaatcaactgtgaccatggcagatggtggggagggtgaggaagtatagagatggtcaaaaataaataatttcctagggccacctctatcaatgaaaaatataggcaaacaagcttctgagaaccagcctatcttttaaatctacctttgtctcaaactaaacacatgcaaaatggaacacatcatattagtctcaaacccgctttttctaaggtctgcattttcatgagagtatcaccatcatccatgctctttaagcacagaatactggggttctctctcacaaatattcttgccacatcatgaagtagctgtcccctgtcctccattcttcattcccattgtcaccctatattagaccttcattcttacctagttaacctggtttcaccacttcttgcttttcctatttcaacccaaccaacttactacttccagataaggcctgcaaagtgtagctcccaaagttactgctccctgctcaaaagtatggactagtcttcacctactggccaaagcaggcccaaaaccctaactcatgcaatcaacccacaataaggcttatgtctacttacctagacttgctgcatgcctcactttttattacagctaaacttattcctgtcctaaacacagaaaccattctgctgatagccttcattatcctctccaagaaccacttgtcaaaatcctgtcattctccaagtgaactctgtccacgtgacctttccaaattccccagccccacaagctctctctcttacagttcattgctgtccaagaggcacatatctaactttaaattagcatattacaaagcttcaatcaaaaatcacattcaaagtaaaaagaaactggtgaaattaatcttactagtatatttaaaccactatatccaaaatattaccatttcaacatgcaattaatgtaaaaaatgagatattttacagtgttcatactaactctttaaagtctggtatttacacatagagacatcccaagtttggactatccacatttgaagtgctcaggcggttaatttattagacagtgcgttaccagctctttcaagataaaaatcatgagcctttcttcattcccactccaataggcccatattaaactttagattttaattcttgagggtaaggatcggactttccttctagttgtatcccctagaacaggaatcagcaaattgtagcccatgggtcaaatctggctgcaaataaagttttattggactatagccttactcattcatttacatattgtctatgctgctttcacactacaatggcaaaggtgactagttgcaacagagactatatggcccacaatataaataaaataaaatatttgctatctggccctttacagaaaacgtttgcctaccacttctctagagcaataattcccaaagtgtggttagtggacaaaccagtgtctggtcagcaaactgttgtcagtccacattgagaagaagtttgtaccagaaagtaaacagacttttttttaaacaaagctttctgaatgaaggaagcagtatattaattaatagtctgacaagctttttatcccactacaactgtttgactttattgtaccttttgtcacataatttttaaaaattttataaccacatttattttttatttaattgcttccaaatttccagcttacataaggcagtctctctcctaatttgtacatatggtatgtacattttctcataggattttatttttatatttgagcatttaaactaattggaagttttcatatcatctaagtgagggctccaattttattttctcacatatagatatcccgtagtatcaggatcgtttaaatctagtttctctcactgaaatgaatgctccttttcatttattaaatcatattcactagaatttatttctggattctttattgttccaccgacctatgtatttctaagcaaacatcatattgaattgattttagagttgtattaattttgtattgctccataacaatattaccacaaatgtagaagctcaaaacaaaacacatttattatctcatagtttctgtgggtcaaaaatctgggcacagcttagctgagtcttctgtttcagggccttgcaaagcttcgatcaaagcatcagacagggctgtagtctcatctgaggtacaaatggggaagaatctgcctcccagatcatttgactattggcagcattcagttgcttgctggttactgagggccttagtttcttggtagctgtcagccagagattgccctgagttccttgtcatgtggccctctctacagggcagttcataacataaaagtttgattcttcaaagccagaaaggaacagagtctttcagcaagatagactttacaatcttatgtaataaaatcatgcacacatagtcatatgcatgtgatcacttcattatattctattaattagacgacagtctcaggtctcacccacacccaagcagaggggattaaacaagggcatgaatatcaggaggtgagattatgggggacatcttatagtctacctgccacaatagtatattctgataataaggcatatacttcctttccctcccgaaaatatctcttgatttctcaggtattttttcttctacgtaaacaatacagttttatcaagtaccatctcctccccctcccccaaatcctgtcagtattctattgggaaatacattaaaaacatttttagaaaactgatatttttatgatactaaatctccccacccaagaacatctggtatcatttaatctgttcagatctcattttatgacccaagataggattttattgttcttcatataagagccttgcctttcttattaactttattctgaagtaattatgatttctgttgctgctgtgaatgaaatgccttcctctctttcctaaggcttatgctaaaataataaaaagaaattaattattgtatatttctcttacatccatccatcttatcaaattctcttagtagttttttcctaacatctcttgggttatttagtttacaacaactacatctgtaaaaagataattttatctctttctccaatgttaattttttcttactgcatttgctagataaaccaagtcataaataataatggtaaacaagaatctctgtccagtttctgatcggctcaaataattttagtattttactacttgtttaaacaaatacttactgttggttttaacatttgttgaatgaaaatcatctttgttaataaagataacggtagatactccacccttaaggaggtagaacataactcttcacataagtgtgaactgtgcattgtgattttctttgaaagagtaccgtatgagaagcgaggaaagagcaactttacggtggagaaacctgacaaattatctcaccccggtgatcaaagtcaatatcaacagtgataaataatgttggtggtatgtatccttaatatgatatgattgaaatagcactttacctctgtggtcttcttccccagagcacataactacattgtaatcatgaaaaaaacatcaggcaaatccaaattgagggacattctacaaaatgcatcagcagtagtcctcaaaactattaacagtcaaaaacaagaaaagtctgagaaattgtcacagccaaggggagcctaaggagacatgactactaaatgtaatatggggtagcctgtaatagaaaaaggatattaggtaaaaactaatgaaataggaatgaagtatggacttctgataataaaaatttatcaatactgattaactataacaaatgtatcatattaatgtaagctgttagtaatagggaaaaatggtggtatgatatatgggaactctatgcactatctctataatttttctgtaaacttaaagctgttccaaaaagaaaagcttattttaaaaagaataatggaagtcaccaattcctcatttgactgtaagtgtcagacttatatttattcatcctaaataggaatacctttatcccaatgacaggaccaaactcagtgagtcctatttttggttcctgttcaaaccactctgttaactcagctctctttggtagcaaactataaaaccctgaaagtgaatcattcttaatttccaggatagggcatattctgaccaatttattcatttaacaagtattgatacagtacctcccatgtacaagaaactaggaaagaaacactttacaccctaaggaataatgtttccaaaatatatatgtatcacactttagtttataatgcacttgaatgttatttgaccctcaacacttgactgaggtgggtaatcatagatatcctcaattctaaagaggaaactggggctcagagagaataagtgatttgcctaaggtcacacagcaaaggtactagccgagacttcacattaagtctaattttaaatcctctgcaatagaatgcaatggttaaaagaatatcaagtgagtgatacagttcaaaatatgaaacagaaatctggaggagctagaagtccgcaaaagcttcaccagaaacagaactttaactcaaatagagatggggatgtagaagggatgtttagcaacattttccacagtcttatcaagctttgggttccttttcaaccccaaaggggtctacctttgggaagtcctagtctaatccctggaaatcataaacaatcaagtatttatggagtgattagaacaatgaactgatccaggagttctacacatcatcatgatgatgtttgaagaatgaatgggaattgaggtgcagaagcaacttcatttcactaagaagaatagcagtctgaggtaagaataaaagtctctgtattactggtgagaaaaagattgattattcaatagccatggtaactagtaaccaccagcaccaacttttaaacctgtttgattgagggcaattcacctcagactaatcatcaatgacaactcaacttgcttcaggaacacacttctggaagccaattacaatgagcttcacacgattcaaggtcagcaaatcagcagcagacacactgcagtgaacatgcttctcaatcaacaacagtctcactcaaatagccatgcttctaaggtcaagttcaaccactcatgcctctgtaaccaaaacaccactatgtttcccaaaaagatcagtaatctgcttcactcacagactatgcttaacacagctgtctcttactttggtaagtaatgaattctgggttttgttttacatgttggattatggtctctctttgacagaggtttgtctttgacaaaccaagacttttccctaacttctcagaataactgtgaaaaaaaatagattccccctaaggaatggaaactactccaaactccaagagttcacttgaagacccttgccaaagaccaattaagtgggtaagaaaaatgctacattgactacatcttgttttctggaatactctcctcaattcagctttatggtaccacagatcatatcataggaaagcattcatgaggtaagaactcatttatatcaaatggcatcacagccccatagagctacatcccaggaatcagaatcaccttgggattttttttttttaactcacacacccaggtttctcttcatatcaattaaaacttaaactctatgagatagggctgagaatctgtgtttttaaatgtccttggtgattctgatacacattgctttagtcaggaatgattagcatggtctcctaagagtgcaaggccattttggtttactgaaagacactgcaggcctggttccagactctcaggcaacgaagaccaaattaatattgccagtactaggttagatactccgtagctacctgcagatccaggaggctcaagtgaaccaagcctactattatctactgagttctccctggatcaatgtttctcaatcctaattgcacagctgaatcacctgggagcatattttagcatatcaattctggcactctgtccagaccagttgaatcagaatctcttaggatggggtctaagtatcttctttagggccccttaggcaattctatgggcaaacagggtgagaatcactgatctagtacctatgtctgttcaccagtacctgtgtctgactcatctcatcatcctctagtataaggcacctggaatttctcctagaaacagatgatgatgggaaaatcccactatatcttgcagaaagcaccaaagaaaatcttccagagtcaaaatgtgatgtttaaactattttaaatgctttacactaaaagcccagacttcaccactatgcaatatatatatgtaacaaaactgcacttgtattccctaaatctataaaataataaatgtttcaaaaggcaataaacaaataaataaaatgcttacctgtttaactgatcaaataaccaaaaggaaaaacaaaacaaagaaaaccctctcctttttcctctacatccttttcttgatgaatagtggggttctgcagtaagatgaaaaaaatgttcagccaagaatgaaaatcattctgtcatggcaaggggaataacagccaaaataagaaatttaagagcagcattccaaaaatctgcttgcaatgaggaggtaactcagattggaagctgctgtaatggaactaaaggagaaaaatacataagaatatatttttaaagtgtgtttcaaatgggtttagcagtgcattagtcatctatgtcaagagtttaacatgtttaaacaaagaaacacagtcacaatgactttcaattttcagcaccttctgaggtacttacttaaagcagtatataaagaacaatcactgaataagtaatgcaactcacaataaggtcaaatcaagaactctagttgtgattagaatggagaagagtatttcattctatttagaccaaaattcagctaatttctaagcaacgactaagtgaaaaagacttaatgttccccaaatgttataaaaggtagttcacacatcctaactgtatattgcgtatagtaaattaagttgataaaataagaaaaaactccagattataatgtacaagtcccataataaccatgaagggttatcactgtagtaaaagaaaaacagccaagcaataatcagtttaacatcaaggtcctctccccaacacacacaccacactataaacactaaattaatccagcaaggtccgaattaggtcagaagacacatgggacttcatctggtgggaagaaataagaggggcagaaaaagcagcagcaaccttcagagcttcatttccatttgtccagtcgctgatgaccagacgaccttacagaggatgtgtcttagtaagtctgttccaacttagaacacttcccttgaaatccaaaagctttttaaaaattgaaaactgggtaccaatatttattagaatagcccgactattgctgttttagatgctctattcaatcactcacaatcaactgggtatttaattagtaccatctgatgtagagataaagatataaaggacttccagttaaagatgacggattgaacacatccatttaccctggctatctcccaaaactccactgaaatgacactaaaagaatgtttttaacctacaataacaaagagaggagacaaccacaatgatctcttcaaagctgagaaaaagcaaaatcttatggcagctgtgagagaagcacaaaataaaatatttgcacccaaacatccccaaaagactcaggggttagcagctccatgcacacctggaagtagggaggaaaggggagctaaaataagtaggttccagtaagagtttttcgaaaaacaattagattccccacccccacccccgccaccaacttcctgtctctggcctctactcattctactataggttcagatatttattctttggagggtgaaagagatggtccctgaactggggaatataagcacagtggacatggattctacactggaaacaggagcttaagcaaaggtttatatactgtatatagagacttctatattctcaccttctttactcagagagcaattagaagattcttctgtaggatatctgatgagaccaaaagaagagacctaaagatattgaccttggtcctaaaactcaactgcccagccaaatcacccaaattacaattgataaacacgtacttcaggctaagagcttccaatcagcttcgtagtgccccctcttaaacacgtacagaaaaaagagcaaaacatgaccagaaatttgaggtaagcctgtaatatgccagaaaacagaacagtctgaaggaaactatgcaggaagaagcaaactcaaaaaaattactaatattttcagagagatattaaaactatattacactcatgaaacaaaaacaggatgctagaaaaaaagaacattcagacctcaaaaagaagcttctagaaattaacatatgaaacaaatgaaaaatgcaatagcagcaagataaagtggaagtgatctcccagaaatagaacaagaagaaaaagaggtagaaaatagaaggggagaaaattagaggattagtctaggaggtccaacatccaaataggacagaaaaaaatgaaggtaaagaaaacaaaaaacaaaagaaaatttccccaaactcaaggaccagattgaaaggtatacagaaaatttccagattgaaagggtacccaggaaatagtttaaaatagacatataccagagcatattgttgtgaaatttcagagcaagcaagagatcataagaactttcagagaagaaaagcaggattcaagaagaatcagaataacatctgatttctcaacaccaacaacaagaacaagacttggaatagggagaaacagaaaaattctgaggataaatgatttccaaactacaattctacactaagccaaatgatcaaattaagtgcaagagaaaaataagattttcatacctgtaagagctcaaaaaattaacccccaatacatcattttttccagaaaattattaaacttgctctaccaaaatgaaaaaaaaaaaaacaccaaggaagagaaagacatgacatctcaaaaaccgaggatccaacgtaaaaggagacaggattcaccaggatgatggtgaagggagactatattgatgtccactgtttcaaaggcccagaaaatactagtccagattgaagatcagaaagctttgggagaaatgcctctgagaacaagaatctgatatgacacatgaagtgtttgaacagactgagtgaagaaacagatcttggggaaagtacagggataaattaggagtgagcacgcaactaaaaagcaaaggaccaaacaaggcaattcttaactgtagagaaaacaaaaagctatgcaagtaatcataatatacacactacatggctcagctgtgactaggtttacctagtcattaacataatgaaatcactgacgaccactctaaccaaaatatgacaatgataaaatgatatattagggtctactacaatatagggaagatacaagtatgggagaaaagggcaagagagctaaatcttcatcttccatagtgggaagacagtacataacatctaaaactgaaaagttgagaaatagaatacatgtgttattttaaaatgcaggtaaaatgccaaaagcagcagctagtaaacgttggtacacattctattgactactcaatacctgacatgtaatagacattcagtgaatgactgaattgtattgatgtgcaaaagaataactataaactaaagtatgtgcctgatatggtttggctgtgtccccactcaaatctcattttgaattgtagctcccataattcccacttgttgtgggagggacccagtgggagataattgaatcatgaaggtaggtttttcccatgctgttctcctgatagtgaataagtctcacaagatctgatggttttataaatgggagttcctctgcacaagctttcctgcctaccaccatgtaagatgtaactttgctgctcattcgccttcagccatgattttggggcctccccagccatgtggaactgtgagtcaattaaacccctttcctttataaattacagtctcatgtatgtctttattagcagcttaagaacagactaatacagtgcccaaattcaaacactctttaaaatgttaggagttgctctttaagacttttccctctatttatatcccaagtacctaaactttctggacaaaaaaaaaaattgttttaaattatttttccagaaaagattagtgatgtttctcaaatgaaaaacaaatcgctgatattttatcatagaagaatttgatagcactattgataagctaattacctccttagataatcaagaaatcaggcccaatatacacttgaattaagcaaggggaacttctcttcacacatggtggatttaaatcttagcttagaactcagatgagtatttaaaatacattaaaaatgtataaataaaacaaaaattcacctggtaagcaaaatatttattacatttctttgcttgatcttgaaacagttacattggttgtgaagaaaggatattttgttatatatatatagggcaagatcttttttattcatgcttaaaaaattctaattaaaaatttaaataaccaaaatgtctgacaaactaactgatcacaaaaatataatgattgaactatcattaggataagcaagtccttgtgaaatctgctattccatcttttcacatatttattggaggagcacatttaaatcactacaggtagactagaaataacattgttttaaaaaaactttcccattgaggtgagttgaaataaataactgagcccaagagtagtcaataaaatttcatttattcattaattcattcattcattaaggaaataagtatttagtgagtaaacctactataagcctgacattgtttgctagtctttaaagcacaggataacttactcctaggtgtgtttttccctcctcttctatagacctgaaaataaaacatacaaatcaggagaaatgaaggatcagtttacacagcattcaggtgatattatttaaccaaaagacaaatcatcccatccattcaaacacaattatataaagaggtacctaccttttgtcttcaaataattatatagtacacaatagagaatgtttttcttctcacgtgattgtgttgcgcatgctctgctacggtggttccaaacaccaataaatatacagttttgcataacgctccattttttcttcacaggacttactgctatgtaagtccagtagtgcagaggttggttacactgttgacattttgagcaaggcaattctttgttgtgaggggttgtctcatgtactgtaggatgtttagcagcatctgtggcctctacccacgaaaggccagtatcatcctcccctccagctatggccaaaaatgtctccagacattgccaaatatgggaggggggcaaaactgcccccttttgagaaccaccactttagagaaacacctcagagagagagtgtgattatagacaggagagaaagccagataaaacaataatctctctttcaaaagtgtagacttctggtttaacatatgctcaagtatgtcaacctttatgatgctactgctctaccaccattttaagttcaaatgccttctagttctaaatctaaattaaggtaatgaaagggaaaaattcctattaaaacaactcacgaacacaaaggaaataattctgtctaatctttcctccaccttccactttaaagaacaccaaggtcggctgggtgtggtggctcacgcctgtaatcccagcactttgggaggctgaggcgggcagatcacgaggtcaagggatcgagaccatcctggcccacatggtgaaaccccgtctctactaaaaatacaaaaattagccgggcgtggtggcacacacctgtagtcccagctactcggcaggctgaggcaggagaatcacttgaatccaggaggcggaggttgcagtgagctgaggtcacaccactgcactccagcctgggcaacacagcgagactctgcctcgaacaaacaaacaaacaaacaaacaagaccagtaaggtcatctttttgtaaactacctagcataatcccagaagttttgacaaatatttgagtacctactatgtgccagacatagttctaagtgctgaagaaagatttaccaactgcatttactgaactgagagataattcttataaacatttaacaggtaaatatttgtgaccttggttttggcaaaggattctcaaatatgacaccaaaagcataaacaaaaaaaaagaaaaaataggtaagctggacttcataaaaataaacttttgtacttcaaaggacaccatctaaagataacccacaaaataggagaaaacacttgtaaatcatgtatctgatgagggacttgtactcagaatatataaagggctcttactacttaatataaaaaaaccccacatcttaagatggtcaaaagatatgaataaatatttcttcaagaaagatacacaaatgaccaacaagcacataaaaaagacactcagcatcattacacatcagggaaattcataccagaaccacagtgagataccaccttcacacctactaaggctataataaaaaagtcaggcaataacaaatgttggcaaggatgtggagaaattggaatcctcatggtcaaagggaaggagtgctttgctttgtgaaacaggctggcagttcttcaaacaattaaacttagaattaccatgtgacctagcaattcaactcccaggtacatacccaatagaaatgaagacatgttcacacaaaaatctgtacatgaatgtttatagcaccattatccatgatagctaaatgacccaatcaactcaaatgtcccccaacagacaaatggataaacaaaatgtgctataatcattcaatggaatattattcaaccataaaaaggaatgaagtactgatatacactacaacatggatgaaccttgaagtaattatgctgagtgaaaaaaacagtcacaaaagggcaactattgtatgattacatttatatgaaatgcctgcaatatggaaatctctagagacagaaagtagtggttgcttagggctggcagggggtgggcatgagggtgggaagttgaaattggggggtaaacgggataacagctaaagaaacaggtttcttgtgaaatgatgcaatgttctaaaattgactggggtgatggttgcacatatctatgaatatactaaatatacagaaatatataccacttatatactaaaatatgtgctacttatactaaaactcactgaatcgtatactttaaataggtggcttttatggcatatgaatcatgcctcaataaggctacttaaaaataacgtcttgtttaaaatatcctcacacatccgaagagatcttattcttttggttgtaagtatgaaatgattacaacaaccaaagccagaactggctttggtatttaaactattgaaaatgttccaggttaacatttaagactatgaaaatcttgaaagtagaaaaaattaaaatgaaggcatcaaggaacttccggaggacataaaatgcagtgattgtttaagatgtattgggggcattaagtaattagattcataggggtggaatgtaagcaaggagagttaaagtgctcatatgaaaagcctcagcctggaagacccccttctttaccagcttgcagtgattctgaaagaacaatatttcttcatgtgcactgttaaccttatttttaaggaagataaaaatacctcccccctcccaatatgattcactccagtaacaaataggaagtcaagtaaatgataaagggccaaacaaaaagagatttaaggaaacacataaaaagctaaaccagttcccaggaatggctactgggaagtttcagcaatcagcatgtgttactgctttttacaggcagagcataagatgatatgatctgtgcatagctcacaattccactactgagacatttcaacctgtgtcgttgtcagtccaaataaagtccgtttctgtgtttgccttgtgcaatatgccagttaatctatcctagctcattgcagagctcctggtatgtgtggtctggggagtccataccttccctgacttgaagaaccaccaacgccagcgataaggaaatgtccgggtgcattaggaatatttttgatcctcaataaatctctgcttcttccttgaccattgcaaacagtccggtttgccatctagctgattctcggtacctcatacagcactgtgctccagtttcaaagcaaaaatagggctaatatatggtggtgggtgaggggcgggggtgaggggtgcaagaagaaaacaagcaaaggttgaactggcttttcctacagagcctcagatttcaaaatgactgccgtagaagctaaaatgacccagatttgggggacaaggggggaagagggtcgatattcattcccctgcggggtagctgtagcttgattatgggcgtaaggaactagggaagacggggtcaccgacatgaaaagagaaataacagggaatggtctttaagtaccacgcacctctctcagtgaatcactgcagtgtcagccctgcactgattccatgatttgccaaacaggatgaggtaaggcacaagcctggagccccctcctcctcctcctcctccccctcctcctcctcccccctcccccgcgcagaaaggcgcatccctccgcgaggtgcaccacgcagccccccgcggccctggctgaggggtgacgtcacccttctgcattgagcttcaaggaccggcggcagcactggatagatggggagtagagttggggcgctatctctatcaccaagtggaggggaccctctgccagggcgctgcggattgtgctcatgcagtgacagaaccaccagatagggagtgtaaggatgcagggaggtgggaaaggaatccaaagactcatctcttgggtcaccaagaaacctcaaagatgcccccggcttatgtaagaccctctccctttcgtgcgcctccacgcggtgacaacgcctgctccccatcgtgcgcttgggagacttcggtcgcccttgcccagccaggcaggcacggtgcttctggtgcctccctcccgcagccccgtggggtcaggaataactgggaatctgagattaaaccccacgctcccgtgtcctctcctagcccgccacaggttagctccaagaggcgccgcgaaccggctggtaggggaagggagagaaaggtgtacagcgaggaaaacagacgaataaacccgcaactttccccaggagctgaccctatcccgggagattataaaagaaactaatgcattaacattttttttttggaaggtcgacaacctgcagtcaccgacactccgcagccccttgcagcctgcgcggagcgaggtctagggttccagcagccccgacccgcaccctgccatcctgcagccccgacccagcaccccgcgcctgtctccttaaagaggggtcccagatttgatttttggtttgggttttcctccccacttcttttctcagagcatcatcatacggaccgatggacagcgactcggccaccggcccggcgtgggcacttacccagaagacgaaggagtagatgatgaggagggttttgagacaggttatcacaggtttggtctccattctcctcgatgccatactacagagctccggcggcggcggcggcggcggcaggcggcgggcgggcgcgcgggagggggaagaggcggggcggggcggggcggcgcggggcgggggcgcgtgccgcgagaggcctcgtgagcgcgcaggcgaggccgtgcgcgtgcgtgagcgcgcaccgcgcggggctcctactgaaaaagccgggccgggcagtgactgcgcatgcgggaaacgccgcccgcgttcgcaatactgcgcaggcttagacccccagcggaggagggaggcgaggccaggcgaggccaggcgaggcgacacggggcgcggcaggacagtggggagggaatgggagaatttagaggccgggtcagaggtcacgggaacctctcccagtccgccctggcatttagatttctgctttgtacacagttgggcgttacatttgcaggtatgcctgcacctggctatgggaagtttatgggtgccccgctgcccatcagtcacgtttctgcattttgacaccccccagggccttctcacatggaaatggccccgtagtcatgtccttggcaaccagcaggccttgtttgtgccaggaacagacaggtggccagagatacagctggagggatgggcaggaacgccggagctcagacagaccccaaatcctcgccaccacaggtatctgcaggctcctccatttttcagatttgtcttacattttgaaataataaaacgaaatgacaagaaaggtctgtatgaggcgtcattcttgctgcgcatacaatgtttaacagaatacagaaaaatgtttaatatgcctgagaatcatttgcagcgcgctaacaagtacagtccacctccctcctgtaaaggaaagctgcattgaggtcaaaaaataatgttcacaaccaatttggagttcctcaaaaagttgaacagagtttgcatatgatctagcaactccattcctgggtatttacccaagagaaatgaaaatatatgcccacacaaaaccatatacatgaatgtttatagcggcattattcacaatagccaaaaattggaaacaactcaaatatccgtcagctgatgagtggatgaccaaaattcggtgcctccatacaacggaaaattattcggccacaaaaaagaatgaagtactactggtaaatgctgcaacgtggatgaaccttgaaaatatgctaagcgaaagacgccagacacaaaagaccacatattgaatgattcatgtataggaaatatccaaaatagacaaatccatagagacaaaagagattagtggttgcagcgagtgggaggcaggaatgaggtgacttttaatgggtaagcggcttctttttagagtaatgagaatgttctagaattacatagtgatgatggttgcacaatactgtgaattactaaaaaccactgagttgtatactttaagaggatgacttttatgatatattaattatatcacaataaaaacgtacattccacccagatatggtttgtagaggaacacacagattcagtgggagatttagcttgattgctaagagactagtcaaaaacagcaacactatcacaggttaactcaatcgtggatgatgatgttaaggatacatatttgtgaaagagtgaaaaacagagtcaataaggcttgggaaaagcctgccaaggtcagttgttacaggagtaattattacctctatccagttatatgtggtctcaggtcaataaggtaactgtatgaacaggacaaaaatatgaggaagaggagaacctgtttaaggaaattgtcaactataacaaaaaggtatgtgggcatacaagggtggaatataggtgcaggtgaaagaagggacaggttgagcaaggtgtctgttataaaggggtcttggcacactgattctcgatgctgggtgctcatttgcatcacctggtgttttaaaacaattatgaatgcctgtgcccaatcccagctatttggagtcatttggtgtggggtgaaagctccgctt

SEQ ID NO: 14019 - DNA, 6445 bp, Human
ctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgacgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagt

SEQ ID NO: 14020 - DNA, 22294 bp, Human
attacaacgttgtcttagattcccggccaatggagctgcttttgtttgccataacagtacacatttaaaataaatgaagttcaagatatttctctggcttaatatttatattgcctttttgtgggttcttagtatattagaacgaatagcacattaaacaaaacactgtcatgagcccttaggtaccttgaggaataatggagggaaaagagtcaaacactttactcccttctctccttgtcaccgacccctaaatatacacaacttggacactaaggactaaaactccatcctctttccctgcccctcactgatacggaagaggggaatggaagtgctggaggggagaagggtgtggtccctgactagggctctacccccaggcctgtggccacggacctaggtgaggacaggcattcctgcctttgtgcccaaatattgcatttcccaagaccaccctggcccaccacgcccccatcctgtgcctataaaaaccctgataccctagcaggcagagacacaagctgctggacgttgagaggagagcattggcggacacacaaacagctggctgtcgagaggctgtcgaggggagcgggtcggcaaaagagcacactgaagagaccggcaggccagcaggccattaaccggtggaataacgcagtttggcctgggtagtcggaggagcgcccaggccgctgagaggctgactccaggcgaaaaccatctcccttctggctcccccttctgctgagagctacttacaaatcgttctccaaggtttctccaatccttgcactctttctccaagcctatgtgtgatgcgattcttctggtacaccaaggcaagaacctctgggatacagaaagccctctcttgcttgcgataagtcaggggtctaattgagctaacacaagcctcctacagatggctgaactaaaaaagcaccctataacacacgcccactggggcttcaggagctgtaaacattcacccctagacactgccgtggggttggagccctacaacctgcccgtgtgcatgctcccctagaggtttgagcggctgggcacgaagaagcgagccacaccccatcacatgccctgggagagggagaagtgaacttttcccgtttcatcacaatttactttcggcactaacatgattgttcagctgtcttcatcagcaggcctttattccaggagattcctgcccaagcaaactgtttaattgttcattatgggaacttccacagagacccatcaaattttcaatctcttccaaagaaagtgtcaatagattgcaatttaagattctttgcttcaaaaatccttgctatatccaccaatcctggactgtagtatcatgatcattatgcaatactaataaaatcccttgcattgaaagacccgccttaaacatccagttctcaatcagttccaaccttgccttgacactttgctctgtgaaggtgccaacgctccgtcgaagtgttgttctccattactgcaatcaacaataaattctgttttttgtcttatcaacaggttgagttgatgatatttggggagccggcatttgacacaagtttgagatctggtgttccttaacgttcagcgtccatcggagctcagcctaagtcacttttacgcttcccattttagcctaccctctgcttctgcgaaaaattttggtttctaacttattttaataatacaagctgcacttttcatttttatatgtcatcactttaaaaattttacaattattttctcatgagcttttaaaaatgaataaaacaaaaacgaatctcacagtagtagcaccagagaagtggctcaaacccaaccggcttgagtcaaaacaaagcccagctggtgggaagcgctgcccttggagcattctgggaactgtagtccaggagtgagagaactctgagacgcttccgcttaggaattctgggaagtggagtccacgaaccgtgggcactcggaggcacttccgctccaggaaggcgaggtcggatctgagatatctcccagggaggtgagtcagctccgggtctccaagacttctccgagccctctttgcctaggcgtggggccagcaatgaacccgtccttggcttggggaagagaagccgcggccagcgctggagggcggggttgggaggctgcgggagtttgcgtcccctcggcagaacctcttgcgtgggaggcgggctcgcgtcgtccttcgaggttgagggtctgctgccctagccgtcctcacgcacctaccagccagtcctgcctgctcctcgcagtaaaatattgggcaagttacttaatctctccttgtctcagtttcctcgtgcctgtaaagggttagtgcgttcccagtgatgttcttgtgagaattaaatgaggttttatagaaataagcttaaaaccagtgcataggaaaatgttggatgccaccgttaattctgttataatactgaaaaagacgcctgttgtttggaaactcctctgagtctaggagatccagctacggagccgctgtcccttctctaatccttgcctgatgtggggccgttcctggattcttggacttttctagcctcttgtttaggagacaggaattagttccagcggagcctggggaatgtcctgtgtgttttatctcagataagcgatcgtcattacggatttgcagagtgccagaggtgtcctgaggccctaataaatgttcagtataatgtggttataaccaataatcccgtgtggttaacttaagtgtaacaccatttcttagagagttttaggtttttattagtcattgctttcatgcatgtggaaaaagagactttcttgaggctcctccagcttagtaacatttgcaagtaattacatctgttggaggaaaaaaaaacctgtggcagtttaactatcattaccaacggaactaattatgttagacaaccaatcacagttacagacttttctgagggtaatggtaactcacaggacagagcaattatttttgagttctgggtttcttaaaagattcattttctagaaagcatactcaaaagggcagttttatgaagcataatagcacttgcttgtcagaagctgcaggaaatagagaatacaggcattattattgtccccattcacaggtaactgaattaaggcacagagagattaataattcgcttaaggtttatactgctgatcagttgaaaataggtagaaatgccaaaatttgaagccaggcattttggctctgttacattcccctgcctgtctgtgtctcatttccttggaaactaaagttcagaaggagtacacagagagctgtatttgatttaggtctgttaatatgaaatgttcatgaacaaaagcagctggttgagggggccgaggggtagctgggagctagctcccgttctcctcactaagccgtgtgcaactgtgtctgcctagagacagggggacctttctctgaagtgtcacataaaagtgccatggtgactaatgccatccctaacctatctcatgatgcctttccctccctcaggttcacttccccggaactctgccttttcccagaaggaggaggggaaaaatgaccaagttccaggtaagtttggtttgcctttgtgtttcttaaaatgacatctcatttcacaaagattggacacatttttcctgtttgggaacagtaaaagggaacgaaaggcacttggaatgttgttatatgccaggttgttgccttttatttcaatataatagtataaaaattaacagagagatatatatatctgttaatttctaaaatatatttctatataattatatatttatatatacgtatatattttatatttatatacaaatatatatgtatatatttatatagaaatatacgtatatttgtatatatgtattatatatacaaatatatacgtatattttatataaatgtatacaatatatacgtatattttatataaatatatacgtatatatgtatatatttatatataaatatatacatatatacgtatatatttatatatacaaatatgtatatataaatacatacaaatatatacaaatatatacgtatatatttatatacaaatatgtatatataaacatacaaatatatataagtatatatttactcatatataagtatatagttatatatatataagtatatatatactcatatataagtatatagttttatatatatatatatgtaaatataaatctctatatatatttagagacagagtctcaccctgtttcccaggctggagtgcagtggctcactgcagcctgggcctgggctcaagagatcctcccaccttagcctcttgagcaggtgggaccacgggcacacaccagcacaaccagctaattatttttagtagagatggggtgttcctgtgtttcccaggctggtcttgaacttctgggcttaagagatcctcctgccgtggcctaacagatatattttttaaatggaaaacaactctcacattacaaatatgtttacaaatcatttcccacattccttttcatttgcactcaacatatataatcatactttaggtacaatttcgaattttttaaatttaattttatatcacctgctttttaaatgatcacatcattttccatcatttacttgtttttatttttcctcattctccatgtttatgtaatctatgaattttgccattttaaggacattgacaatagcagtttttccccatgtaacttctcttcccaaataaggattctgagaattctaccatttttttaatctttaaagttttagactcattttctcatacacagcacctcattttatggagagaataaagtatagcttagtgcagtagcatctgactgatgccaaactcagagaaagtaattttagtttcaaacgagctagatttctttctttaattctaagtaaaaccttgtattatagttaagtatctgttttattcattaacatgttattatattttaaagatgcacatacttagtttaaaagtcttatagcactaggagattcaccaggaatttgcaccatggaacagctttgtgaggatgtagatggccttatctgtattttaaacataaagagacaggtgtgaacctttagacacttattgaagtccactcaatgcccagctgacgttaaagcttccagtgcctaagccagaagtttcaggtgttccatttgggtgaaggccaggcacagtggctcacctgtaatcccagcactttggggctgaggtggatcacttgaggtcaggagttcgagatcagcctggccaacatggtgaaagcctgtctctactaaaaatacaaaaattagctgggcgtggtggcgcacacctgtaagcccagctactcatgtagatgaggcaggaaaattgcttgaacctgggaggcagaagttgcagtgagccaagatcacaccactacactccagcctgggtgacagagtgagactgtctcaaaaaagaaaaaaaaaaaagagactattcagggacttgaggctatgctacacatgtatgtgtccctggcatgtcctggtggatgaagggctccagaaatcacattgctcttcaccagattccctttctcagtgcatggctctttgccacatgtgtcatcgagttgtttggtacatagatgttcagaactccagccaaaacaaatgcagggatgtgcagtgtcttcagataaaaaatgttaatttccatacagaaaaacaccatatacaaactttatgagacaagtaggaaacaggtgcggggtaggaatttatatattctagaaaatgacttaatattcttaatagtaatgttactgatacatgaaaaatcccagtaggattaaggaaaggcaatatgtgaagaaaagtaatatcagatcatctttaaaaaaattaaatagctgtttatatcactcaccaaattactcaagatttaaaaaaaaaaatgtccagttttggccagagtatggagaatcgggaatacttataatctcttacgggaagagttaattgagaaaattaacattataccagcaaaacaaaggtatatatatttttttacaatgtaattaccacttcttggaacttaccttttttttttttttttttgagacggagtctcgctctgtcattcaggctggagtgcagtgacatgatcttggctcactgcaacctccgcctgccgggttcaagtgattctcctgcctcagccccccgagtagctgggattacagatgtgtgccatcatgcccaactaatttttgtatttttagtagagacagggtttcaccatgtttgtcgggttggtcttgaactcctgacctcaagtgatctgcccgtctcgacctctcaaagtgctgggattacagaagtgagccattgcccccagctggaacttatcttaaggaaataaccatacgagctggctaagatctatgtaaaaatatgttttcttgtggcattgtcatttttaaatttaaaatgatcaaatgtgcattatttagaatggttaaatatattgtagatcatgtttatggactatcatgcagctatgaatgggatgaaatagatgatggtgatgataataagagttaatgatcaacatttattgagtacttactgtatgtcacacactgtcctaagttcttatatgtattcactcatttaatcccttcaaggaccctatgatataggtcctcttatacagatgtggaaattgaggttttgtgaccagcgtcacaaaactagcaatggatagacccttggaatgtgaactaaggcagtcaaactccagagcctgtactcttaaccttgaccctaaatgctgctgcagttgaccaagacagcatgttcctgagaacccagagagtgaactgcgtacttgtgccagagctttatgaaggcctgttggattgacaaaatagtggtagtactatcaaacactgttgggaagaaattaatgcaaaatttcttatcaaatttagtgctatcagtcaaatggtaaaatgtgtgtatgccatgatttaacaatgacagttctaggaatttaactatataaagggcaccacgttacatgtacaaggtgttttccttcttccccctagcatttttggtgtgattgtggaaggggaagaatagtaactctacagaaagagttgcttaggtgccagtggccattgggtgtgagattgaggttacatgtgcttgatgttctaggaggcagtgacattcaaggatgtggctgtggccttcactgaggaggagctggggctgctggactctgcccagaggaagctgtaccgagatgtgatgctggagaactttaggaacctggtttcagtgggtaaggacaggcaccctctgtaattcagcagggtttctcaacctccatgccattgatgttttgggccagataattctgtgttgtatcaggctatcctgtgtattttgggatgtttagtggcatccctggcctctgtccccttgttcaaggctttgggactgctcagagactagagtttttctatctctttagagcatagagacaagatgtttctgacctttgttccaagacagatgattttcttttagacatgaactataaaagaacagttgagcttggctcctcctgattccttatttcgtatatcttttttaaacttgtgggtcatgatccattggtgggtcagtaaattagtaagttacataagcatttttgtaataaaatagagtaacaatatcagagccccttagccagaatggtgcacattgtggcaataactgctgctgcttgccgtaagggatgtgatgaaaacagatattgattagaaataggtcctttaaccttttatttcaatagtttacacagggtaatgtatttccagtgatagtaaatgtatttcttataatgtgtcatgacaaaaaaaaatgttccctaaacattgcatgctggggcagggaggagacttacatcatgtgattggaaccagattttttcagtactctttgcctttaacattttcacttaaatactatctttttataggacatcagtccttcaaaccagatatgatatcccagttggagagggaagaaaagctttggatgaaggagcttcaaacccaaagaggtaagcattcaggtgagtactgtgcagccggaatcgtagttaacagctgttatttttcctttattcaggataatttcttctccactcagctacctgagagacttttttaaaaaacatctgtcatggttgggcgcgatggctcaagcctctaatcccagcactttgggaggcctggcaggtggatcacttgaggtcaggagttcaagaccagcctggggtctttaacatagcaaaaccctgtctctacaaaatgtaaaaaaattagctagatgtaggtgtgcctgtagtcccagctactcaggaggctgagatggggggattgcttgaacctgggaggcgtgggttgcagtgagctgagatctgctactgcattgcaacctgggtgatagagcgagactctgtctcaggaaaaaaaaaaaaagaatgaaaacatctgtcacatcatgtcactctctgcttcagatcctccactggcttcccatttcatgagtaaaatccagtgtatttaaggagcttgtaaggctgtataatgtttgcctattcacctagctttaccattctgtttttccccctccctttgtctctgccaccctcacttgttcctcagatatgacatctgcatcacagccttttactttctattctctggctggaatgctgttttttcttaaacctttgtctttctgattgattgattgattgagatagggtctcactctgttgcccaggctggagtacaatgacacagtctcggctcactgcagtctccacctcctgtgctcaagcaatcctcccacctcagccttctgagtagctggaactacaggtgtgcaccaccacacccagctaatttttatattttttgtacagacgaggtttccccatgttgcccaggctgctcttgaactcctggactcaagcaatctgcccacctcagcctccccaaaatgctgggattatagatgtgagccactgcgcccagcccctcttccttatttcattcatgcttctgctcagaaatcatttcatgagaggctttcttaaaataccatcttccagctgggcgcggtggctcatgcctgtaatcccagcactttgggaggacaaggtgggcggatcacctgaggtcgggagttcgagaccagcctgaccaacatggagaaaccctgtctctactaaaaatacaaaattagctgggcgtggtggcacatgcctgtaatcccagctactcgggaggctgaggcaggagaatcgcttgaacccaggaggcagaggttgcagtgagccgaaatcgcaccattgcactccagcctggacaacaaaagcgaaactctgtctcaaaaaaaaaggttagattcctttcttctgtcagtattgggtttaatttggttttgttttttgcttttcacatttttattgggagccactggggagggtcctcctccctgtcagtggagatgctcacagtttcttcagccactccagggttgggccctaggagtcctgggggtggctggacacataaggcatgctcccatcatctcagacaggcattgggtaattgtagggtgtggcctggttgatcatgatggcatacttggtgtaggggctgagtgggggcagaattatagcatggcctgcaatggtgaaggacacagccagcactggctgcttggcccaggcattcctgaagaaggcagcaagtcttgcagccatcttggtcttggtaatggcgatggcttgttacttttttcatttccttaaggtataaggttatgatgttgatttgagacctttttccttttcattgtaaccatttatagctatagatttcccccttagcactgtttttgcagtggattcgttttcatttatcccaagatattttctagtttcccctgtgatttcttctttgatctattggttgtatgtgtattgttgaattttcacatatttatggaattttcaggttttattctgctattcattgctagtttcatttcattttgatcagcagagatactttgtgtgattttaatatttttatatttattaaggcttttttgtagtttaacatatggtgtatcctagaaaatgttctgtatgtacttcagaaaaatgtgtattctgctgttattgggtggagtgttctgtataatcatagtctacgtgtatatatttgttaggtccatatacttcaaaaatgtataaaacatagaaaattgattaattctaaaattgcttatgtcctttgttaagatatcatctaatccaccaaactgagggagatatgtgacaaaaatgacttagtaggatgccatttgtaatcccaccattcagttcagttttaacattcattttacatctttttctgttaatgaaaattgactgatagtttaaatggataatttctgcttctccacccttcccccaacatacacataatttggatgacctatttgttttcctatgactttaaactttttattttgaaaacttaaaaaacatagaaaagtaaataatgccatagactctgtatatccatactgtcttagcagttatcaactttctgctgttcctgttttatctttcccttttattttttgctggagaatgtcatatcacccatagatttatcagtgtctatctacaacagtaactccttattgtcacttactatccattttataatcagtatgggctcctatgtatttatttatacttcgtgttataatccagtattgcattgtttattttgttaccaagttatttctactttgaccacttggagctttttcaggttgcctcctgtggttgaaatcaccagtgatttctagaaatgcaaattaaaacaatggtgagatatcatcttataccagccagaatggctattattagaatctgttatggatctctggagatctcaggtaatgaactcaagatggattaaatagcaccatttattcaataggatgtcctttccccagtgtatgtttttttcgactttatcaaagatcagttggctgtaggtatgtgacttatttctgggttctcttttctattccattgatctgtgtatctatttttatatcagtacgatgctgttttggttactatagccatgtagtgtaatttgaagtcaggtaatgtaatgcctccagctttgttatttgcttaggattgctttgtctattcaggctcttttttggttccatatgaattttagaattgtttttcctcattctgcaaaaaatgacattagtatttagatagccattgcattgaatttgtagattgctttgggcagtatggtctttttaacaatattgattctgccgatccatgaacatgggatgtttttccattttttttatgtcatctgcaacttctttcattattgtttcataattttccttggttagatctttcccttccttggttaaatacattcctaggtattttaatttttttgtagatactataaattggattgtgttcttgatttggtttttagcctgatcattattgtcgtatagaaatgctactgacttttgtatattgattttttttaatcctgaaactttattgaagtcatttgtcaaatctaggattcttttggaggagtctttagggatttgtaggtataagatcagattgtcagaaaacagagatattaaatgacttactcttttccaatttagattggttttctgtctttctcttgcctgattactttggctaggacttccagtggtacgtgaaataggagtggtgaaagtgggcaatccttgttttattccagttcttagggggaatgctttcagcttttccccattcagtatgttacctatgggttgtcatatatggcttttattattttgaaatatgtttcttctgtgcctagtttgtcaaaggtttttatcatgagaggatgctgaattttgtcaaatggtttttatatatctgttgagatgatcatgtggtttttgtttttaattctgtttataggctgaatcacatttattggtttgtgtatgttgaaccattctcgcatccttggaataaaacccactcgatcatggtggcttatctttttgatgtgctattagatttggtttggggggttttgtggggggatttgtgtttgtttttggaggatttttgcatctacattcatcagggatattgctctgtagttttctttttttgttgtgtctttatctgactttggtatcagagcaagagtggctttctagaatgagttagggaggattctctcctcttagattttttgaaagagttttagtagaattggtaccagttctttgtaccttttgtggaattccagtgtacctttgtctggtcctgggcttttttgttcttgggaggttttgcattgctgattcaatctcactgctcattactggtctgtttaggatttctgtttcctcctggctcaatcttgggagccagatgggctcaatcttgggaggttgtatgtttccaggaattcattttctctagaatttctagttttcaagtgtattgttcataagagtgtctgatcatgttttttatttctatggtattagttgtaatgtctcattcatttctgattatgtttatttggatcttctcttttcttggctagtcttactggcagtctatcaattttatcttttcagagataaaaacgagcttttcatttcattgatcctttgtatggttccatggttctctattttatttagttctgctgtggtctttgttatatctttcttctgctgactttgggtttggatttttcctgtttttctagttcctggaggtgagacacaggttgttaattttttatcttttttttttttagtgtagacatttaacactataaacttccctcttagcactgcttttgctttatcccagaggttttggtatattgtattttcgttttcattcatttcaagaaattttaaaatttgtcttgtcattaacccaaagattgtttaggatcatgtttaattttcatgtatttgtatagtttctagagttcttcttggaattgatttctagttttattctgctgaggtgtgagaagatacttggtgtgattttggtttttaaaaatgtattgagactttttttgtgacctaacatatgttctatcttggagaatgctccatgcactaatcagaagagtgtatattctgatgttggatagaatgttctgtaaatgtctgttagctccatttgacctaaaatttaatttaagtccagtgtttctttgttgattttctgtctcagtctatctagtggtgtctgtggggtgttgaggtcccccactgttattgtattgctgtgtatttttttaggtctaataatatttgttttatgaatttgggtgccctgatgtttggtgtgtatatacttaggattgttatcttatttgtttattgatcactttatcattatgtaatgactttgtctttttttactgctgttgatttaaagtctttttttatctgatataaaaatagctactcctgctcgtttctggtttccatttgcatggaatatctttttctaccgctttaccttcagtctgtgtctttatcggtaagatgagttatgttgccatttgacttatcttctttctttgtgtaattattttataaggcctgcaagttttatacttttgtgtcttttatcatggcaagtatcaaccttttgttttcatggttagaactcacttgagcattccctgtagacctggtctagtggtgacaaactccctaagtatttgtttatttggggaaggcttatttttccttcatttatagagcttattctagtaggatacaaatttttttgttttttgaagcaacttgaaaatagaatccaatctcttctggcttgtaaggtttctacaagttgaattgtgtgatggagcttcctttataggtgactaaacacttttctcttgctgattttaggattttatccttcatataaaccttagtctgatgactgtatgctgtggtgagttccatcttgcaatgtattttcgtggagttcattagatctcttttatctggatatctaaagctcttgctagattaaggaagttttcctcaattatttccttaactaggtttccaaactttttactttttcttctccctcaggaatacctatgattcataggtgtggttgctttatgtagtttcatacttcttagaagctttgttttttcttccttattcttttttctttactttcgtctgactagattaattcaaaagacctgtcttgaagtaccgagatgctttcttctgcttgtctagtctattgtaaaagctttcaactgtattttgtaatttcttcaatgattttttcatttccagaagtttttatttgtttggctttttaaaaaaaagatacctatctctttctctttggtaaatttctcattcatatcctgaattgattttttgtattgcttttcaaatttcttttgtatctcattgagcttccttaaaatcagtatttcaaattatttatctggctcattttttcctttatgatctttatttcttttatgttgtttttttcctgtcttactgcactgactagaacttcagtaatgttgaataaaggttgtgagagtggatatacttgccttgttcctgattttctgagggaagcatttaggtctaattttagaatactaaatcagccttgcattcttgagataatcactactttgtcttgatttatcctttttatacattgttagatttgatttgatcacattttgttaagaattttataaatatgttcattaggaatgttagtctgtagttgccttttcttggaatgtcattgtcttattttggtgttagaataatgctggcttcctaaaatgtgttgagaagtatttacaccttttcatttttctggaagagtttgtctagcattggtattgtttcttccttatatgtttggtaaaattcatggatgaagccctataagcctgaacttttgtttgtggaaatatttgtaagtatgaattctgtttctttggtagataagggctattcagattatctgtatgttctcaagtaaacttattttgtgtctttcaagaaatttgtccagttcatctgcattgttgcatttattgccataaagttcataagtcccttatccttttaataatatatacaggatctatagtgatgtcacctctcatcctgatatttgtaatttgtatcttctttctgtttttatcatgagtgctagagtttattaattttattgttctttccaaagaactagctatttgttttcttattttctatttatgcttactttgtgtttaatttgttcttgtgtttttagtttctatgacacatttctgctttataaattttgctctaagtagaaattttgatatattggttttttattttcactcaatttataaagtctgttttgaattatttttgatccacagtttatttagaagtatgttatttattctctgaatatttgaagattttgcagagatgtttctgttcataatttctgatttaaatcagttgtggttagaataccctttgtatgacttgactccttttgcatctgttagaacttgttttatggcctagaatatggtctatcttggagtatgttccatgtgcacctgaaaataacattttctgctcttactggatagagtgtcctagaaaggccaagtagtcaacttggttgataatattgcttcaagcctgtatcttcacttattacctacttgttttttgttgtgttttgctttattttttatataatttattgtttttgttttgttttgttttctgactgctgatgctgctgcagctaagaccttttttgtttcttcagcttttgcacattctggaaaacctgaattcacagagccttcttagtcagaagcgacggtcagtgggctgtttggtaattcagaggggaaaggtgtcttcagtccccagttccctgcatgtcttcccagagttgtcataataggttttgtggaggtttttgagcatctttttcctctggttgatgcttatcagcagatagcatttgtgggctttgtcctttcaatatgtcagcatgtgtttttcataactgcagatcttggccaggtgcagtggctcatgcctgtaatcccagcattttgggaggctgaggtgggaggatcgcttgaacccaggaggtgggagaatcgcttgaacccaggaggcgggggttgcagtgagccgagaacatgccactatactccagcctgagtggcagagcaaaactccatttcaaaaaaacaaaacaaaacaaaacaaaactgtgggccttgatgttcaagtcgataattccagcctctgtggagctggtgtcctcagggcttgccatgtccttttttatcaactattctggcttaatttttggcttctcctggttggccatttccaaagacaagtgtcttttcccaatgtcatcaaccctctcaatcctgggaaagttctggtagtctttgagcagcgtataaggggacaggtcatcatcttggctgggctggactggtttctggatggcatatccacaggtggcctggaggaagaaacttggaggataccagcaccactggttggaaggaagcctggtgctccctccttttggcttctcaaaaactggagcttgggtctcagtggaacttagcacctttcacacagcccttggcatggtgacttctgacccccaaggggccagggcagctgtccctttcacagcacggactcagttacatgagtgccaccacatatcttcctacttggtttactagctgttggaaaggggtattgaaatctccagctataaatatggatttgtctatcagttattttgagcatgtttctagatgtgcaggttgtataatgagagcctataattgaggcatatattttgcctgatttatgtagttgctacttacgattcagttgctgtagccaaagaagaggtgacttttaatttaccattcttataggcaaagaagtcaatttttcctttctaagtacttactgagatatcattttgttgttctgcagttggctggtttctacctcttgtcctattcttagatctgtagttctgtgtttcgagaggcaaataaaatccaggaaaatctgtgatggtaaagataagctgaaagtttccatcatgaactaaagcctgataccgaaggaactatgtgtaaaatttggaaacatctggacaaagcattcactttggagttgtgtatactggagaatacacacaggcagcaagactcatactcagaaaagacccaagatacaccttaaccataccctgggctgatctcaaattttctatcttaaatatggctttttaaaacatttggtgttctcttggttgcagctgcttttcagagttcctataaatttatttcagccagtctagttgtttttttgacgtttccatggggaaaatgagagcttagatcttaattctctactttgctaatgtcagtctcttggtcctttattccttattctctctatcctttcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaattatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaatacttggtttcctttcattattttcattcaggttcaggtcaagttgcttttctatgtgtagtctttcctccatgtaggccgctttagaaggagctttggcagatttcaggcatgttaatttgtcacatttatccccttaaaaggaagtggcagggcaagaaacctgttgagtctttattgaaattgtatcttattgtttatttattttgtttaatagagccttgcagtgttgcccaggttggtctcaaactcctggcctcaagcattcctcccaccttggcttcccgaagtgttgagattatggatgtgaacctctgtgcccaaccttgaaattgtattcagtgtaatgatttagatggattaccacttacacagcattctatgcttaagacctcttggtattagtggacaataaatactctttgccctggcagtcctagcactagaaatttcacttaggagattgtgacaaaagcgagaaagattgtacacaaggatatttatcctgaattcaaaaaggaaaaagtaaaatatttgagtaagtcttgatatatccttataatatacagccattaagatgatcagaggtctgtaatgactagagaagacattattcatgagaaaactaggttagacccttcctgggattatccaattaatagaagtatgtccacctaatgatgtgattatatgcatagaaataatagaaggatattaatatgctaacaattgtttactgtggcatggaaggttgggatgatattttaacttttcaaaaaattacagtgacatcaattttaccaaagtaaaagtgaaacaaagttatgcataaatgaaaatcccttatagctaaatcttgtttgttttatctcattatatggcatgtaatcctgtgttatggatgtgtaactggcttaagtccagctgcttgctactcaaaggctgaaaacatgaaaagcaaaatgtagtaaaaggaaagcagttttactaatcaaatgttagtaattgggaaatggccaggctcataccttaaaagaccattccaactttttgggctgagtgaaggagtttaagagggaaaacttggtgtgggaaatacgtgggagcggtgcagtcgggtgcaggtcttgcatgtcttcttctgatggtttatcttgagcagtcacccatttggaggtctggtttgcatcttcttgactttggcccaggagtggtggatgaactgttcataactgcccttaagtgggaggattgtgcagctgatttatttagtctgtgtctgttttgctttaaaattagtgcttggaatttctaagcaagcacaattatacaagtgagcactgtgcatgaagtacctcgtgggaaagggagagatgaagagttttaacatataaggccacattctgagattggggaggaaagggagaaaagttttaaaatgcatttcaaagctggagtactctgtaagaattccccactgtcaaacttcatcctatttttatggaaagtgggcaacgcagttaatctggctgcttcctgctgaaagggggcatagttgggaagtaccagaatggaatctattcacttggagttggaaatatatccacattcccagatctatagc

SEQ ID NO: 14021 - DNA, 36760 bp, Human
tttgtcacttgaagctgaagctaatcctgatagaagctgtaaaccacatttctgaaaaataataattggaaaacatacagtgttctgcagtaagatgtctgaaaaagatggataaaattatgaaaacatcaagcatatgttgcagtgaacatcacggcattgacagtaatgctttattgcccacatctcccataactggaaaaggggagctgctctcctttaggagcactggacagactgccttggggtgtggggtgctgtctgattagagagagagcagctcttgaatgggggaggaaacacctccactgtgactttttgcacattgcatttgcacaaattactctctgaaacagtctcaaaggaccatgtcattttataaagcactgtggtcatttgaaaagatggaggtagactgaaattttgaattttggggaattttcctacactatgcatacttgtgaagtttgtattgttaaatttcatttgatttgacaaatccgtgttaagagtatacgatgtccaggtacagaggctgccccagaaacaagacagaagtaggcagggacccatggctctcatggaacacgcttttggttagaggcaacagataagggtaatacatttatagcatgccagtaagttctatagtacggtgtgttgagtaggtgttgcagagaaaaaggtatgcggtgaaggccgggtggtgacggcctaggccacactgaagaggcaacatttgagcaaagactgaaagagcaggtgggaagagtcggggacaagagccgccagaaagtgtttccggggagggaagagtcagggactctgaaccaggccagggcagctggagtggagtgagagggagggagggtctgggagtatggcggggtgaccggaggcagagcaaagcactgcaggacttcagctttactgagtgaaatgggcggagcagagtgtgaatgtgatcagacttcttttcaagggatcatctgcaatgctggaaaggaaaagacaaatgatagattattgcaacaaacagccaggcaagagatgcaaactttttttgcaaaggtgtgtgtgtatatacatccttgcaccggacagccacgaagcacctactgtgctgtgaagtcagtaaggatgtgggttaaaatcgctcacctcacagcgggtcaatcgggaaagcacacccactcactacagccattatgggaaaaagggctcgccccttacaggatcctcaactgtggagaggccgggagcccacgcggggcgctggggagtctctcagcaccccaggggttcgggcagggacctgagccgcgccctctctcccgggggtgccctggggtcgaggctgctcggcagagccggcggtcagttcgagccgcgggcccgaacagggctctccccgcggctctctccctcggagtagaaggtgctggacccgaactccagcggagccgcacaacacgtggaggaaaagcgccaggacagctaaccttcccaccttttcaaacctgaaacccggccggctggggacggttggaatgttcagtgcgtacccgcacctcaggccccttgtctccagccccagaccgccccgcgaccatcctccccaccccccgacctcttatctcgtccccgccctgtctccccaacctccatcctcccctccacaacccccgtcctcccgcccttcggccacgcgcggctggcacagaacaggcagttagcgcacacacactggaacaggcgccaccgttcaggaagtctctacaagaccaggaccctgaggcctctggaagtgccgggaccgaaccaaccccgcagagcgactaaggcgagggcaggagccaagagaaccgtagccgcggtcgcgggttgagctcccaccacccggacagcgcgcctcggcgatcgcgcacgcgccacgccccggaagagttcctgggcccgcgacggtggcccggaagcagtccccggtgtcggggcaggaggcacgcgcgcggctgaggcgaggtcgctcggcgcagctgttgcggggccatggcggggaccgcgctcaagaggctgatggccgagtacaaacgtgagtctggggacccgggccgtcagcagcgtcccgcgttcctgctcccgggcccgcgtcgtccggcggggctggggcagggagcctggcgggggagccgggcccggggcctccaccgtgagcccccctgtgggtcccgcggagtgccgcgccctgcgcccgctgcccactctcacgcgtgaagtcgtgaagagaagccttcccagcatcagtaaaggcagcgccggcgccgtgttagttgagagcacacacagttgagtctttgcgggcttgtttttttctcttctattttttcttttcttggcagccttgagaacgtgcagtgagagcttgaggaagaaggcctgacttgctgctgcggaattaggagggaaaagtgtatgcgttaaaaggggaaaggctcgttggtggagctttgaaaggtcagattttggctttccctctaatgaaggaaaagggtttttgaacagtgccacctgtcactcctcctaggtagtgttgaggaaacctcttgagtgctttcctacccggtaaattagatatttctaatgtctgaggagagcgaagggagaaatgagaacctaggaacactcggcattccatcgttttacaccgaatgcccgcttggaagaactgctgcgagaagtcttggaataccattgtgttgaaagcgccaggagcctgagtcgccgatggagacgagatagtagccggctaagagcagggcctgagttcagacccggcctctctgcttgttagctctttgaccttgttcctctctctgtctctgcagtttccttgtcttaaaaggttaaacttgatactgcaggtgaagtgcttagcaaaatacctgatgtgtaacccttaataaagttagctgctgcttttgtaattagattgaggataattttggaagaaagttaagctaaaagaatgaatgtgagaaaaaaaataagtggtgaatatacatgtagcttgatttcgtaaaactattggtgacaccgcccagtaagagttgatgtttggcttaagcagaccaaaacgttgcaaatacaggctcactcacgtatggtcattcttcccttggtatctggaggggattggttccaggccccgctgcagataccagaatcctcggatgctcaagtccctactataaggtggcgtggtatttgcatttaatgtatgcatagcctctcataacttttaaatcatctcaaggttacttatagtacctaatgcaatgtaagtgctgcacaaatagttacactgattttttttacttgtatttttaaatcgtcattttttattgttatttttttcaaatattttgtattcctggttggtcgaatccatggatatgcagccgcagatacacagggcctcctgtaaacgttcaaataacgctcgccacctagtgtctgctaaagcagaacataaaggcacacctcagtttcccgcgcgctttgctttattgagcttcacttcgcagatcttgcattttttacaagtttacaagttttttacaagcaaccctgcatggaagcaagtctgttggcaccatttttgctcgcttcgtgtctctctcttacattttaatctattactgtgatctatgatcagtaatctttgatgttactattgtaattattttggggcatcacaaactatgcccataaaagatggtagtcctaataaatgttgtgtgtgcttcactgactggctgtttccccatctctctcccggcctctctcttccctgagacaaaacaacattgaaattaggccaatagtaactgtacagtgggctcaagtgttgaagtgaagagttgcactctacccacttcaaatcaaaagctagaaatgattaagtttagtgaggaaggaatgttgaaagtcaagataggctgaaagctgggtctcttgttagccaagttgtgaatgcaaaggaaaagttcttaaaggaaattagaagtgctgctctgttgaacacaatgaatgataaagtgaaaaagccttactgctgatatggagaaagttttagtggtttggatagaagatcaaaccagccataacattcctttaagccaaagcctaatccagagcaaggtcctaactcttcagttttatgaaggctgagagcagtgaggaagctgcagaagaaaaattgggagctaacagaggttggttcatgagattgaagtaaataacctgtctccataacagaaaagcacaaggtgaagcagcaaggtctccagaagatctagctaagatcaagatgaaagtggctcctaaattaagcaatagatttacaaggtacgtaaaatagccttatacggtattgggaggagatgatgccatatacaacgtaaacagctagagagaagtcaatgactggcttcaaaggacagggcgactcttgttaggggctaatgtcggtcactttaagttgactgagttgaagccagttctcatttatcattcagaaaatcttagggcccttaaaaattatgctaaatctactctgagctctagagatggaaaaacaacctggatgacagcacatctgtgtacagcatggtttactgaatataagcccactgttgagacctactgctcagaaaaaaagattatcttcaaaatactattcctgacagtgcacctggtcactcaagagctctgatggagaggtataaggagataaatgtttttgtgcctgctaacacaacaccaattctgcagcccatggatccgggagcacttttgacttatttaagaaatacatttcataaggccatagctgccatgaaaagtgatttctttgatggatctgggcaaagaaaatcaaaagtcttctggaaaggatttatcattctagatggcattaagaacatctgtgattcatgggaggtcaccatatcaacaacaggcgtttgaaaaagttgatttcaatgctcatggatgactttaaggggaggaagcaactgcaggtgtggtagaaatggcaagggaactggaattagaggtggagcctgaagatgtcactcagttgctacaatctcatgatcaaacttgaacagatggggagttgagtcttacagatgagcaaagaagtgattcttgagatggaatctactcctggtgaaaatgctgtgaacattgttgaaatgacaaaagattgagactattccataaatttagttgataaagcagccgcagggtttgagggtattgactccagttttgactgaagttccactgtgggtaaagtgctgtcaaacaacatcacagactacagagcaatcttttgtgaaagtaagagtcagtccctgtggcaaacttaattgttgtcttattttcagaaactaccacagccactcctgccttcagcaactaccaccctgatcagtcagcagtcatcaatatccgggcaagactgcaccggcaaaaagattatgacctgctgaaggctcatatgattgttagcattttttagcaataaaaattaagcatattttggcaaataataattatttatttatttattttttgagacagggtcttgctctgtcacccaggttggagtgcagtggcacaaccacagctcattgcaagccttgacctgggctcaagctatcctttcacttaatccacctgagtagctgagactacaggcatgtgcccctacacctggctgatttttctgtcttcatcttgacctccctctatgttgtcagggtttggcgaaagtgactccattttgattctgacaatgttcatactcgaacagagggttggatgtgggggactattacttctgtgtcctcatgggaaacctggctggtgggtcagatgtgtgaacacctaccatttcttggtatcctggtttgtgtttgtgtctctgttttagttttattttagccctatttctagggttaggctagactgtgagcaggtattttctctttttttttttttttttttttttttttgagacggagttttgctctgtcgcccaggctggagtgcagtggcgcaatcttgactcactgcaggctccgcctcccgggttcatgccattctcctgcctcagcctcccgtgtagctgggactacaggcgcgcgccaccatgcccggctaatttttgtattgttagtagagacggggtttcaccgtgttagccaggatggtctcgatctcctgacctcgtgatccgccagcctcggcctcccaaagtgctgggattacaggcgtgagccaccacgcccggccttctcatttttattgagaagaaaatcattaaacccctgcataggaaattaagttcaggctgctgcttcaggccagtctttgcattgttgaacttgcattttctaaggatatttgcattagcaaagatatgttctcccttttattgtcctgacagaagcttcatctgttatttcaattatattgtcaattagtttgcagtaataagacctaaataatggttgatttccgaaggtttgtcacggaagtgtgttgtgtgtttttacatgttaacatgaaattttggactatgtgtagaaggtagaactctaaacatacctcactaagattcccatgcccttgttattcaagcactttctagtacttcggtggagggactttggagatgcaagtcaggttagtaatcagcagacctaaagagtgggagattattctggattaccgtgaaggatccaataataacataaggctcaaaagcagtcagtgaaggcaggatgggggtggtcagagagattcaacatatgacaagatctctaccttctgtggctggctgtgaagatggaagaaggagccatgacctaaggaaggcgggcagcctcaagaagctgagaatgatcccagaccaacagacccgtggaagtgaattctgtcagcaacctcaatgaacttggagtggcagccctggtgagactctgagcagagaactagctggcccatgctgtgtccagacttctgacgcttggaaactctgagatcatcaatgagtattgttttaaatcactaaatttgtggtaatttgttacagcagtgacagaagatgaatacagtgtgttattgaggggactttgtttttcctgtatcttaataatgtgataaaatttagtgggttttttttgtgtatcatttactggttttttttgtgtgtgtatcttaacatctagtttgtcctcataacgtattttaaggtagcacattccagtgtaaaggtggacttgacagaatcaatctctacatagaaggggtttagataaatttggttagatgttcatgcacactttattgtatttgggagtagtcatataactgcagaaattcagaggtggtgggaccttggctatgattctgttcaagccccctaattttacagattttatggaattgagcaacagacaagatgattttgcctaggttcataaacaggaaaaaaggagagccaggaaagaactcaattgttgtaaactgctgtcttgtcttgatgttctgtcttcattcatcatccagcctttcctaggagtgtcagagatagacccaggtagaagtgggctgcccatggggggcttagcacaacagaaatttattcttttactgttctggaggccagacatctaaaataaaggtgttgatggggtcattcttcctcttgagggctcgaggggagaacccttacttgcctcttccagctaatggtgattgttggtcatccttggcgtttattgtcattctcttgcttgaggtagtgtaattctaatctctgcctccatcttcgcatggccatcttccccctgtgtgcatgtcctaaatgtacatgtctttctgtggatatatgcttttatttctcctgtgtaaataaccagggttataatgggaagtgtgtgtttaatttttaaagaaacggccagttttcctctagttcacatttccctagcagtgtattaagtgttcccgttgccccacctccttgctgacacttcgcgtggccagttgttttttgttttcttttttctttctttctttctttttttttttgagacaggttctcactctgtcactcgggctagagtgcagtggtgtagtcatggctcatggcagcctctgcctcctaggctcaagcaatcctgccacctcagcctcccaagaagctgggattacagttgcatgccacctcgcttagctaatttttgtatttttagtagagatagggtttcgccatgttgcccaggcttgtctcgaactcgtgggcccaagcaatctgcccgtcttggccttccaaagtgttggaattacaactgcgagccactgcgcccttccagttttaaaaattttagccattctattgggtgtatagcagtcttactgaggttttgttttatttatttatttttttttattttttatttttgaggtgctctctctgtcatccaggctggagtgcagtggcatgatctcagctcactgcaacatctgcctcctggcttcaagtaattctcctgcctcagcttcccaagtagctggggctataggcgcgtgccaccacacctggctaatttttgtatttttagtagaaacgggatttcactatgttggctaggctggtctctaactcctgacctcaggagtttgcctcgcctcccaaagtgctgggatttacgggcatgagccacagcccccggcccttactgaggttttcatttgcatttccataagactcgtgatgttgagcatcatttcacgtgtttatttgccatccatatgtctttttagataaagtgacttgagtctttgcttctttcaaaattgtgttgattttcttaagttttagttctttggctgggcgcagtggctcacgcctgtaatcccagcactttgtgggctgaggtgggcggatcacgaggtcaggagatggagaccatccgggctaacacggtgaaaccccctctctactaaaaatacaaaaaattagctgggcatggtggcggacccctgtagtcccagctactcaggaggctgaggcaggagaatggcgtgaacttgggaggtggagcttgcagtgagccgagatcacgccactgcactccagcctgggtgacagagcgagactccgtctcaaaaaaaaaaaaaaacaaaaaaagaagggtttttattatttcgatgaaattcaattattgacttttaaaatatttcttgctattgtgttatatttaagaaataactgccaaacatcaggtggcagtaggattttctcctatgatttcttctagatgttttatagtttcagctcttgtatttaggtttgggatccatatcaaagttttccatatggtatgagataaaggccaaggtttatttgtaaattatttgtaaatggcagtgcagttgtttcagcactgtgtttgctagggctgctctaccacacaggctgggcacggcttaaacaacagaaatgtatttcctcatagtcctggaggctggaagtccaagatcaaggatagggcagggctggtttcttctgaggctctgtcctctatgcctgtgtcctcatctcttcttaaaaggatattagtcagattggattaaggtccaccctaatgaccacattaattttaattacctcattaaaggccctagtcacacacttttctccaccttcttttttttcatgtaatatgtcctgaagtttgttctgtactagcatgtagaggtatttatagctgcaaagtaccccactggtatatgtatcataatttgactggtcctctgttgatagacactcaagtcctttttaatttctttttgtttttacaaatagtcctgaaatgaatagcctgtgtatacattttttatcttcaccaatgttatctgtgggatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattattttgtgtacgcgtgtatatgctttggaagcaaaaaacaaaatggaaaaaatcaagtgccctgaaccattccctccagcctctgaactcatttgctgcaattctttattgaccagtagaggccactgttgaataacaaagctggcgggaaggccagcgcacacccgggcaggtctctgtgctgagcctgcattgccaggagcaggtctggagctgcagtttttagaccaccctttcccctccctaagggagggtgtcacgcaggggagtgccaaaggggaactccagatgaagaataaagccagctctctttggtacgagctcttcttcatggtcccacgaaggtgatttgtaaagcttttgtgtgttctgctgccaggcctctacttagttgcccactgacattgtgtttctcccgcaccccacctgcttagcagtttacagtctatctgccttaatctgttatttttttcttataattaggcggtttggcttgagacacaagaatgggactagattttagatgactgggtgtaggaagcctagcaaattaggttctgtggttatttctcctgatctactccacatgaagagacacaaagggagaacatcagggtgtggcttgtgaaatccaaggtcttagtcggcttggtacttgacctcattcacattcagttcccacccacccctgaaatgtttaatgcacttggcccttggggccagcacttgcctttggcctgccttgctggcccctccttgccactctgccttctctcactgctgggtgtcagcacacccttgtgacagcacttaggtctcttcaggacctctgtttcctggatcagggcttctcagcaggtgttagtggtattttgagtgaaataatttttccttgggtaggccttgttctacccaaggttgtgggttcattaaacggttaatcggtacattagtccgttcttatactgccataaagatactacctgagactgggtaattataaaggaaagaggtttagttgactcacagttctgcataactgacgaggcctcaggaaacttatagtcatggcagaaagggaaacagacctcttctcaaggcggtaggagagagaagagcaagccaaggaagaacttgccacacacttatagaaccatcatgtctcctgagaactcgctatcacgagaacagcatgagggaaactgcccccatgatccagtcacctcctaccaggttcctcgctcaacactttggggattacaagtcaaggtgagattcgggtagggacacaaagccaaaccatgtcatttctccccctacccctcccaaatctcatgttcctttcaaaaccattccatttcaaaacaaatcatgccttcccagcaaggcccccaaagtcttaactcatttcgtcattaactcaaaagtccaagtccaaagtctcatctctgacaaggtaagtcccctctgcctagcagcctgtaaaatcaaaagcaagttagttactttcaagatacaatggaaatacaggcattggataaatactcccattaccaatggaagaaattggccaaaacaaagggctacaggcccccatgcaagtccgaaatccggctgggcagtcattaaatcttaaagctcaaaatggtctcctttgtgaccccgtgtctcacatccagggcacactgatacagggagtggctttcatggtcttgggcagctctgcccctgtggctttgtagggtacagccctcccacacccacccccttcagctactttcatggtgggcattgagtgtctttggcttttctaggtgcacagtgcaaagctcttggtggatctaccgttctggggtctggaggatggttgtcctcttctcacagctccactaggcagtgccccagtggggactctgggagctccaaccccacatttcccttctgcaatgccctagcagatgttctccatgagggccctgcccctgcagcagatttctgtctggacatccaggcgtttccctacatcctctgaaatgtaggtgaaggttcccaaacgtcagttattgaattctttgcacccacaggcccaacaccacgtggaagctgccaaggcttggggtttgtactctctgaagcaacagcctgagcggtaccttggccctttttagccatggctggagctggaacagctgggacacagggcaccaagtaccaaggctgcacagagtagcagcggggctgggcctggcccacaaaaccatttttccctcctaggcctccctgcttgtgatgggaggggctgctgccaagatctctgacatgctctggagacatttaccccattgtcttggcgattaatatttggctccttgttacttatttgaatttctctccagaaaatgggtttttcttttttattgcaccgtcatgctgcgaagttttcaaacttttattccctgctttcttttaaacacgagttccaatttcagatcatctctctcaagttcaaagttccacagatctctagggcaggggcaaaatctcaccattctctttgttgaaacatagcaagggtgaccattgctccagttcccaagaagttcctcttctctttttcagaccacctcagcctgggcttcattgtccatgtcactatcagcattttggtcaaaagcattcagcaagtctctaggaagttccagactttcccacatcttccttcttctaagcccttcaaactgttccaacctctgcctgctacccagttctgaagttgcttccacattttcaggttatctttatagcagtacccctggtaccaatttactgtattcatctgttttcacactcctataagaacttccctgagactggataatttataaaggaaagaggtttaattgactcacagttccacatggctagggaggcctcaggaaacttatcatgacagaagccgaaggggaagcaagcaccttcttcacaaggtggcaagaaagaagagtgaaggaggaactttcgaacacttataaaaccaccagatctcatgagaactcactgtcatgagaacagcatggaggaaattgcccccatgatccagtcaccttccactaggttcctccctcaacacctggagattacaattcaagatgaaatttgtgtggggacacaaagccaaaccatatcaatggacatttgggttgtttccagtttggggctattacgaatttagctactatgaacattcacacaaaagtctatggcaacataagacccagtagaattgctgggtcttagagtcaatatatatgtaattttagtggaaatggtcaaacttctttcccaaagggtaaccaaaccattttgcattcccatcagtggtgcatgagagatctacttgctaaacttgccagcactttaagtctttaattttggccattcttttgtgactaaagatactgataatgctgaagctattgagctgtatcttattgtggttttaatttgcattacccttatgattcacaatgttgagcattttctcatgtgcttatttgccatctgttttagtcagttcaggctgctgtaaaaaaataccaaagaccagggagcttaaacaacaaacatttattgctcccaattctggaggctgggaagtctggtgagggctgtcttcctggtttgcagatgactgtcttctccttgtgcccttacatggccagaggcaaatctctcgtttcttcttataaaggcactaactccattcatgagagttctgccctcctgacctaatctcctcccaaaggtcccacctcccaataccacatacattaggattcaacataggaattttggggggacgcaagcgtttggaccacagcatcattcgtgttgactctgacagtggctcttttcaactctgcctccatttttcttcttacctattttgatttttatatgtggtgtgagatggggaaagtttgatttttttttgtcttagagatgagcatcattcatggaaaagactgccctttgcctctgggccatagctctgtgttccctcgagtcagggtctctgttggtacaggtatgcttctgggctttctcttgtgccccattgttcaatttaactttgagccagtgctacgttgccttaatttccatagctctgtaaggaaggcttggtaactcatagatgaagctttctgtttattctttttttttttttttttttttgagacagagtcttgctctgtcacccaggctggagtgcagtggcgcgatctcggctcactgcaacctccgcctcctgggttcaagtgatcctcctgcctcagcctcccaagtagctgggactacaggtgcatgccaccatgcccggctaatttttctatttttggtagagatgggatttcgccatgttggccaggctggtctcgaactcctgacctgaggtgatccacccgcctcggcctcccaaagtgctgggattacaggcgtgagccaccgcgcctggccctctgtttattctttttaaagatagtgtcttggctattctggattgtttgcatttttatatatcttttagaaagatatatatatgcctcatattcagcaactgtgccaaactcacttttactaattatctttagattcttttgggctttcctgtatatatggacatagcatctgtgaataatgagttttatttctttttcagtccttataccttatatttatttggcaaggatttattaattttctgtctcttcaaagaaccaccttttggtttcattgatttttttttttctgtatgtttgcttactgttttattaatttccccagtctcactctggttgcccactggactccagcctgggcaaccagagtgagaccctgtctcaaaactaagcaacaaagtaaccagcaggaacagtttggaaagacagtgtaccccttatgtttgcttttgcatttgtaaaaagaaaaagaaaaagaaaagtctatgttttgttggtataaagaactatttgggccggcgcggtggctcatgcctgtaatcccagcactttgggaggccgaggctggcggatcacgaggtcaggagatctagaccatcctggctaacacggtgaaaccccgtctctactaaaaatacaaaaaattagctgggcgtggtggtgggcgcctgtagtcccagctacttgggaggctgaggcaggtgaatggcatgaacctgggaggtggagcttgcagtgagctgagatcacaccactgcacttcagcctgggtgatagagtgagactccgtctcaaaaaaaaacaaaaaaaaaacaaaaaaactttgtgtagttgttatcagaaccgttattgtactaggtattcactttgggcaaacagaattttcacttgttaatatgcatattctatggtttataggcttatatattttgtaaaggtgttttgttaaaatgacaatgtaacatttattctgtttggtaatggttttacttattaattttatagaattaacactgaatcctccggaaggaattgtagcaggtaaggtaccaaagttaacttccttataatttacttttaattgccaaagttccttcaaagttaaaatgttgtgaaattttttctcaccctacaggccccatgaatgaagagaacttttttgaatgggaggcattgatcatgtaagttaattttaggtgtactagtttttagggctttgctggaagtcagatgtaagaatcacatcagcagtgtgactgtgtccaaaagcatcagctggaaaaaagactgagttctccagtaatgcccagctctcgtctaggctgctggtctgaaagcagagaacctgagcattgatccaaaagaaatgagtgtttccttagagccagtcaaaggtttagttataattatgtaatatatgtattatatatttgagagttttaaggtggtaattttggaatgttgtatgatcgtggttaaaataacctcaaatggcgtaggtggctttggcttccagaagtagccccttcaggtgtgaaattttgacgagaaaagggtcctcaaagatgtgtctgaccacaccaggcatgttagcgcagccttgcctgccctgcctttgggccaggacttctttttcttctcctttcctcccagttcgtatcttcgtgtgctgcatctcctttttctgttgccttgtctggacttgttggccttgtgttctttccgacccaagacatggcttagtaagtgagcagtgtggttctgggattcgtggcatttaacttagggtgacgttgcttggaaagagaaacacatggacccctgattttagagtgttctatggccttgactcactttgctttttcttctttctaccttagatgtgcaatttttggccattcttagtgtattttcagcaaagtgaggttaaataaaatttaggaagttgaaatttgtaatcagtctctgttttctttcttttctttttctttctttcttttttttttttgagatggagtttcgcccttgttgcccaggctggagtgcggtggcacaaccttggctcactgcaactcctgccccttgggttcaagcgattctcctgcctcagcctccctagtagctgggattacaggtacccaccaccgtgcctggctaatttttgtatttttagtagagacagggtttccccatgttggccaggctggtctcgaacttctgacctcaggtgttccgcctgccttggcctcccagagtgctgggataacaggtgtgagccaccgcgccaagcccagtctttgttatctcattagtgaggtcttttaatttgcagcaaggtcttgggttggattttgttgcattgagaagtgctctagagggcaaggaccggaaaagtgagggctgtgaaacaagtgtgggctctggcttgaagtgatcttaagcttcatgatgcttttggaattcgccagttgcttggatcacattaattcttaatgctctatgggttggtctgagaaacagattgcagctaagtgttgtctgtggaggttaaattgatatgaaaattagtattttggataaacaaaatgtttttaaaaaatcatcaaacgctattcagatggtacagcacgcctgccatttcctgatcatttgtaatatcctaattgcttgggcctatggcacatgttttttcggtgtctgaaggtttctggaatctgtgtttgtgtgtaatgtggcccccaaggcagttatgagatggatggcgagtcccacagtctgggctgtcctcattagtggactgtgcggctgtatacttgtatcggggcagctctttttatttctgtagaagcaggagatcatatacatgaactgatgtgtaacctgcttgtttcatgtgttaatgcaggcgcacctgcactcatgccagcggggcagcacgcctgctgcaggggcccagagtggcgggaggcctgtctgtgtgtagaggttgaaggcgcctgtcgtgtctgcagttatttgtggggtgttggctcctccgtaggcctatttggaagctcattaaaggaacagttgagccgtccagtgtggttttaaaaaaatgttcattgttaaaaatcgattagggtaactattaccaattttaaataaacagtgtaaaattaaaccaatattttgaaaacctgtcttaaaaagtaattagaactatttttaggtagagcacttctgtgtttgaacaaggctttttgcattagtttggaattcccctgcttgaagatcctagtgagtttgtgggttttggtcctgttccagacccttcacaaacaagaggccgtttacaagtgcacttaaaatgcctattagggaattaactgtcctcccatcgatttgtctcaccctgctattttggcagacatctggccaagtctttgctccttggtgataagtttcttctttttctctttattctttgatggcttccagggccgcctctctaccctagtatttctaaaacccgtgcttgcctcacagaagtcgaacggctgttggtttttgctgttgtgcttgccttaagggccagtgaagaaaatgtcattttagatatctaagcaacaaacactaagtgcctttgatatgttagggcccttgtctgaagatacagacatgtcaaagatgcactgaaatctttaccttggaagaccagggttgagggattaggatggagaatagaacagattagtgaatgagaggactaaataatgagagtccgcaggctgtgtctttaaacaccgggaataactctgctgaccctgccacgctcatggtggagtctgagcctgcaatcaaatcgagcgtggctgggatggcggcacaccaggggatgtggccaccgtggctgtgggtgctagcatggcctgctgctcttggcccagtcactttgcctctctttgacttatttggatcaaaacagagaggtttatcagcatcttctagacagatggttacaggtcttgcccagctctagggtccatggcccgtgaccccattgccactaagccacggtgacgggggtgtagctgcagagagggtgggtgccctctttcattgatgcacttatgtgggacagaaggagtcctagacagctgttcatccccagtggccggacaaggcgtggagtcccttggcgcttgctgtcctctgtgtcctgccccagcattcccaaatcagctggcttggtgaccttcttgtctggttcatgcctgactgctgtcacctccccagaccagtggttctagaggctgtggtgaaataagaaggaccttcctttactgaatggtgtgtttggggcccagttggtggatggatgctcccaggttctccagctggctcatggcagccagcttgagggctcccaggctgccgcggcttctaccaggagcccttctcacactgggggccagtgtccggggcacagcagcctccctttatgtccaggtttcttgttgactgaagactgtcacagggcatctcttggcagtattatgccttgctgaaataaacccgagataataaaataggtgtttataatttgtattgtatgtaatctcaccatagcattttcttcaacaaaagtgtcacaaagatccctatatgaagaagttattgccacattcattgcagtaataataataaaaaaggaaacatcactgttccacataatttatggagcatctatatagagtaatgccatgtagctgtaaaacagttcaggtggaattttcatcctggcatggaaagatgtacacaatataaatggaaaaggcggattctagaataataggtctggaaccgtctgtccgtccttccttcctctcctctcctccctcctctctctcttcctttctcccctcctttcttccctcccctcccctcccctccctttcttatggagacatggtctagctctgtcacccaggctgaagttcagtggcctggtcacagctcactgcagcctcaaactcccaggctcaaacaatcctcccacctcagccccacaagtagctgggaccacaggtgcacaccaccacgcccagctagtttttaaaatgctttgtagagatggggtcttgctctgtttcccaggctggtctcgaactcctggcctcaagcaatccttctgcctcagcctcccaaagtgctgggattacaggcaggatccaaggcacccagcctaaacagctttattgagataatttacatactgtaagttttacttgcattaagtataaaagttagtggttttagtaaatttctagagttttgtagtcatcaccacagtccagttttagaacatttccaaaaagattcttatgtctatgtgcagacagttcccattccaacccccaggcaatccctgctctttcctctgactatagatttgccttttctgacttttcctatgtgtggaatcatacactgtctaatcatctgtgcctggcttcttgtacttggcagaatgtatttgcagttcatccatgttataccatgtatcagcagctccttccttttccattccccagttgatggacatttgggcttcctactttttggctcttttgagcaatgctgctgtaaacacttgtcttgtcacactgtctgtgtggacatggagttcatttctctagaccagatatagaggtgtggaattgctggggtgtggagtaaatttgcgtttaatgttttaagaaactatcagactatcttcctagagtagctcaccattttgcattcccagcagcagtgtatgagcattccagtttctccacttccacaccaacactgctgttgtctgataacagctgttcttgtgggtgtaaagtggggtctccttacagatttgacttggatttccttgacgactaatgatgttgagcatctcttaatgggcttattggccgttcatgtatcttctttggtgaacttcagaacttttccccatttttatattcggttgttttcttgttgatggaacgttaagagtttttaaaatatattttgatacaagtccttcattagacataggatttttaaatattttcttccaatctgcaactctccattttgttttcttaatagagtcttttgaaactaaaaagttgttaattttgatgaagtgtgattttgcattttttttcttatatagagcatgcttttggtgttgtatataacccaaggttgcaaagattttctcttatgtttgcttgtagaagttttgtgttttttcacttttacatttaggcctttgatctattttgattgacttagtgtcatgtatggagttaggtgggagtctgtttcattcttttgtatgtggttatccagttgtctcagcaccatttgttgaaaagacagttctttccccattgcataattttggcacctttgtcaaaaatcagttgactataaatgcaaggatttatttttggactctgaattgcattccattgatctatgcctatccttaggccattactacactgtcttgattactggagcttcatggtaagttttaaaattgggaaatttaagtccgccaactttgttctttttcaagattgtttactaggccattgcatttccattacattttagggtcagcttgtcaatttctacaaaatgcctggtgggattttgattgagactacattgaatctttagataagtttgagggatattgccatcatatcagtactgagtgctctaatccatgaacatggactgtctctccatttatttaggtgttttaaaattctcagcaatgccatgatacatttgaatttttagaaatccagttttgtagattagagtatgtgaatttatacacacatagagaaaagctggaacaataaccaaacttaactctggttacctcaaggaggtgattttgggagggggagtgagggaggtatttgctttttattttatatacttctgtatttgaatattttccaacattcttttattttcctagttaaataaggtcaaagtttatgttgtaaaagtgattgtctatgttagaatatactataaagttcttataattgatgaacttatttagtacactttatagttcaaatatattagatttaaaaattttaagaaacatctatattgcaaaaaataattagggtatggctgtagatgccttttggacaggtttaactatgaaaataattatatggagcaaaagctatatttgcccctactatgatttcataaaatggaaatgttcccccttttcttccgagcagttcttagcattggttatctacctgagtatcgcctggggtgcttagaacaccacaaaacagaaaggaaacacaggggatctctgggtttaaaccagagccagggccctgctctgggggtgagggtcaaatatgtcatcctggtggagaccaagtgctggaggaaagtgcaggaaggcacttccccaaatcacggcttcttacagcctcgtcctcttgctacgagggtattgggatcagtttctatttaactcctcactgcctggcacagccacaagcacaacctggcatagcagagccagtgtcctagggcttttaaagtgcccagtgtgggggctgtgtgtgcagcccaccttggtcctgctgtcctgggcattagtggggtgggaacatcggcaagaagcttttgctgaactgcagagcagggactgaaggaaggagacgcacccaagctcagatgccgggagccctcatgcccttcctgctgggtgccctctgtcgattctgtagcgtaagggaggtgcttatccttcccccagagtggagggtgcccatgaagcagtttgcccttcccgtctccagctcagctggctccagcttttggagggccatcgtcccttagtcatccacttcaggttttaaatactgatggatgagtttgcattctctgtgattttaattctttatcacatgtgcgttggagacttcttgtctatgtgctgtgacaaacttgataaagagaacagcagcaaaagcagtcggctttcccaacacctgcgtgcagctgaagtggcgagcgcaccagttcctggaacaccgcttgccggcgaagctcagggcacccacttgccctgggtgctccataaggcactctgacctgcctgctgcttctcttatctagaaagtaaaaagtgttagaaaggcaatgcaaagaagaacaatctctcccttgagttgagtgtggaaagacagaagaggctgatcttcgcttttcactggcatataagtgacccacactgttgctgaggaatggtcacaactctggaggaggacagtgacaaggcagttgtcctttgtgaggagggagaattgctagtcaggagtaggccatgggtgttttcaatatttgcttttgtatctaattcacccacaagacagcaaaacagtctgagctgttgcaagcgtgcctcctgtgtagagtgcagggtcattatgatgcttaatctaatgcttgtccttagctcagctccgaaagagtttaggtcatgatttcaatcaataaggcagcataatttgcaggctttgaaaaatttacatttgctttggatatatttgtgtcctccttgttgttgtttcttttgaagattcccaggtgaggccatcttcggtgaaagagaagtgaggttgtctgggagtatggcaataaaacttgtccaaaaacagcactgtggcgtctcccactcctggctcgggagttgcctggaaggcatgttccatggggtcaggcatgctgctgcacaccactgcccatctgccctcctgtctgggcgccaggcgttctagaaaagagaaagaaatcccagtttcaaaccagtagtaaaccggagcatttgcaaataactttgatatttaagatgtgggcgcacttcaggaaatgtttggtcatgcttctgaggctaggaacgacctggtggattaaaaaaaattttttttaaagaaagccctattatgagaaacaaagaactgttatcaaagtattgagcaaataccatttggctcattccaaaaacactacccagacattttttcttattctggactcagaggtgccagaaatattgagtgctggcaagcattcctgacatatgaacagtgttacttttaaagatagtatctttatgtgcctgacttctgatttcgcagtttgaactgtgttctcttaactctaatactaaattgatctaggaccttgactaagtcatttcatccttggattttccagccttgcttgacagtaaaatgaaaaccacaatccttggtgccctttcatcagagggcgtgtggagaatgaatgggtggtggttatcgtttgctctgagctcttgtactggacaggaggctcggggtggccacgcctcactctgatacatggtgtgtgcccaccctgtgttgagaaggcggggcttcaggaatgtgtttgttcaggccattgcagggggagcagagtaacccaggcttgaggcgtccccaggctgccgggcgctgggtgccagtgtgggccggggggggtactcatccgggcactgtcctctccagcgcggctgttgtaccagtagcaagagctcatgctcgtgcctccctcggtggcgttccctgtgctggtcatgctgaggctctggggactgtcacacagtaccccccccccaccccagctccccaaaacaaagtggccatattcgctatcttcttctgaaaaggtagcaaagacagttttcagaatcaaaatttgtcttttagattgaaaaatcttgtctccatgaagcaatcactgctttgttctcttctgactgttgcccgcagatcagccctgctagggccatgagccgtgctggcatctgctgttgctgccgacagccctgagtgccgcctccaggtgaaagctaaagctcttcgttcagtttctttttgatttttgtctttttcctttaattatagagataaatatttccaagtctgttgttattaatttcactgaaccaagataattttaagatttttaaaacaaatttttacttttaagaaatctattttttaactgaagatttaaaacgtatatttttttaaattatttttttcctgtgccatatcctggattctttctgaaggcagtaggtctggtgtggactgtcctctgctcatccaggcctcggcccctgcacgactgttctttctgccttagcctttgttgttagaggagcagagctgtttaggaagggacttgttctttcagttcgtagacggagaacgggtttactgacctatttattgatctgatgagtcacacccagtgcaacttccactgtttcgttgtctgccgctgtcattcagcagtcctgcttccttatcaaagaaagatggtgcaagatcttttagaactcctccaatgtgtgttttattaatgtgatttgtaggagaagaggagttcgtccctggtgtgaaggtacaggcatagtggctgacactcttcctctcctgtggccatcatgccttgaactgttggtcaagatagtgttaatttatacttgttgggttttaaaccttaagcaggatttctgaaatggtttcatctatttcttccatttacacgtgaggaaagtataggtccagggagactcagtgcctgtgtctgtgcccatgacggggagttgctccaatgttgcatcagtgggatgaggcacagcacatgggcctgcaggtgcagcctggagtggtggtgcctgtgtgcctagcctttcaccgagcatgcagcagtgatcacatgtgctcttcatctgcttcttgaaggttgcaaagatgccttcttgggcacgtttaaaaattaaaaatcacctttgaaatacaactcttagccccacatctgttgaaatacaatgtaatcttgctataccctgtgccgtaattcatacccttatcctaaaatgtgattgtaccacatctgcagaaaaaactcccagatcttagagcattgacattagttcttttctctgatccccttcttatcaagaggttctgctgcttgactcttaaccttcataaatgtgaaaactgcctggaattcagtctttgtacttgtacctaagatttagaccagattgaaactggagaatgggacattgctttccactgaaaagaaagtaccaattcattgttacttagataatctttttgtgtgcatttttattatttatttttatttttgtttattttttgagacggagtcacgctctgtcgcccaggcttgagtgcggtggcgagatcttggctcactgcaacctccacctcccaggctcagacgattctcctgcctcagcctcccaagtagctgggattacagtcatgcgccaccacacccagccaatttttgtatttttagtagagacagggtttcaccatgttgcccaggctggtcttgaactcctgacctcagatgatctgcctgtctcggccttccaaagtgctgggattacaggcgtgagccaccgcacccggcctcacgtgcatttttaaagtggtaaaaatgttcttaacccatttgtcaattgtggtcgacgttgaaaaatgtactttgaagttcagtctacgtattttatatcttctaggggcccagaagacacctgctttgagtttggtgtttttcctgccatcctgagtttcccacttgattacccgttaagtcccccaaagatgagatttacctgtgagatgtttcatcccaacagtaagtgcttttggaagtagtttttgtggtaccaggataggtacggagataatattatcagccacctgaaatgtggtatattctatatgtctatgatgtagatctttagaaaacacttcttatgttttgaaattcagccaagtaagcatggtggtattaagcacatgatttcaattttgaaggtcagtttaatatagataaaagacaacaggcacctaaaaccggatgccatttgacccagccaccctacttcactggggaggaagttttacacatgggtgtgtgctcagaaggggttatgctaatctttgtcatagtgttatttgtaatggtgaaaattttgacttaacctgggtttttaacacaagaataaattaagttatatattgtattagtctgttgtcacgctgctaataaagacatattcaagtctgggtaatttataaaggaaagagatttaatggactcacagttccacatggctggggagacctcacaatcatggcagaaggcaaaggagaagcaaaggcacatcttagtggcggcaggcaagagagtgtgtgcaggggaactgccctttacagaaccatcagatctcgtgagacttgtacactatcacgagaacagcacgggaaagatgtgcctccatgattcagtacttcccactgggtccctcccatgacatgtgggaattatgggagctacaattcaagatgagatttgggtggggacacacccaaactatatcatatatgttagaatgtgatgtagattttttaaatgatctaaaagaagaatcaatgatacaaagtagtatttgtgttatattgactgggaaaagcagtagcactgttataatttcctcttgaaaaagaaattcacatgtaaatgtatatataactggaaaagtaagcacaaaaatgttaaaagtgattcttttttcggattgaaattttttttcctttttgtaaatctttttttgccctaaaattaatatatattaattttaaaaggaggaaaaaaataaggtcatttaagtgaattgtactgtagcttatttgaaaatgtgtccagtagtaggaattggaatttctgaacagctgtagtttttattttttccttttacattcttccttttacatctttgccataggggttttcaggactacccccccacccccggccacttcactggtggaaatgccgtctgccaatagacttgctgtcctaaccctcgtttaggacttctcatttactgcagatattggtacacataggtagtgggcggctgcctgagagagaccatttggtacttcttttcttatctcaaagctgcttcagtcttgtgtgcacaggggatgctcagaagcgtgccttctttcagggagactggccatgcgcctgagttagatgataacatggaggttcatcacacgctgtctacttgagtgtgtttttggaattctccataataaaaagttaaaaaatacaattgataggtaagagtaattgaagtagtttcaaattggttagctataaaatgcaactatgaagaggattgtaggtaattaaaatactaagattgtattgaggagaaatatattattcagaacaatacctgtgacatggcattagtgacaaatatgaccaataaactgattaccttatgtgactatgtactacaggtggtctgattattatttttaatgttctggtaattatttttaatgctcagataatataaatttttgccttactgtaattggattattttgattttttaaaaattatctttgagaactataggtctaccaatatcataaaaactagtcaataaatactttaaaaacaattcaacacacgtactgaaagttgctggtatacagtggtgagcaaataatagcagaccttcaggagcttatattccaaggacagggatggacattgataggagaatcacacaaacaaaatgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactacctcaggccttttggtcaatactgaaggttttgatgttttctcctgggagtggcggaactccattgaaagactccaagggagtggcatgaccagaatgatctctgacggctcgctctgggtacagtgcaaaggacaggtgggaggaagccaggcaggccctcggctgtagtggtctagggtagagacaccggcaacttgggaactaaatgtgggcactaaagataaagagatgtgtgtggatccacgagaggtttaggacatggcactgctgggacttggtgaaggaggggctgtggcagggacacaggtgcttttgatgcttctgtggatgcagtgtcaccctatgggaccaactcctggagaaggcaacacagaagtgggaaacttcctgattttgtggatgtggatcttaggtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaaggtaagtgatcgccattcacatttgtgaattttcatgaaattcagagcttattaactcaggtgagttaaataaatgtattttaaaattgctatttctattattataactttaatggctttataattttacagttgagtctatctagatggattactgcatatctgagtatatatggagccatctgagaattcctcccaattatatgtaaaagaggactgattaaatgctgtgaattgaaaatttatttctctttatcagaccttgtgtatctttttaatgatgatatttggtggaaagggatttgatttagacacattgacctacattccaggttgtactgatgataatttacttattattagagtaagctaccaagagaaatcctggtgcctttctttttgtagatatttacataattccagttgcctttatcatagccatgtgaacatatattttacacagaccggttcagggatttaatgatagaattagaaatagctaaggaactagctctgaaaagtattgtaaataatcctaatcacattagatattttgataaaatatttgccagataacctttcatttagtctttttgtatatattgcttgaaaaaaattcatatgaaagtggattagactacgacagctgattagaactggctgggtcagcctggagcctgtcagtgagtgagcaggccccaccgggattcctgcagacatgaagcgtgacactcagggccccaggctatgccccagctgtgcaaacagcttggttgctgtgtctgcagtctttgttctcattatctgtggagcctgcccaagcgcggcgatgcctcgggcaccattcctgggctcacttggctgcctctgacccttgcagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcaggtaaggcccgagcctcctggcaggagctgccgtggacacccaggctgcaggtgttctccagccttgcgtcatcctgtctttagaatgtccttttcctcatttgcagttagtttacacatgctattgccatttaatgttatctgcctacacttttccaattgtaagcataccttctagcatagcctggggttgtatattgtattgtcggccataattaactggtctctggtccttgatcgtctttttccctcagtaggtgtttattgaggacccactacatgccacacactggactgggggtgtaaagcttcgtgtgacaaagaccccaactctttgttcctacgttctagggaactgtccaagcctaccagcagttagaggccagtgggatgcaccctaagatcagacacatgcagggactctcgggccacttcctggtggggctgtctggggtgtgtttaggacatgtaggtgttgatgaggtaggagggagggaatggggttttggggcaaaggaagcagcctgggctgaggcccagaggcaggaggtggctgacttgatgggggcactgccagctcattttggctggagccaaggctgcagggagaggagccccagcagaccctggggattggagttgggggtgtgatgtcctgtgagctgtgccttcgaagggccatccttgcagcagtaaccaatagtgtgatggaagacaaacagagacatcgtggtgttgcagtagcctggagagaaaagagaagggctgagtggtcccagggctaagaggaaggggtgggtttgggagaccttgaaggtacaggctctgggactcctggttctttgtctaccagaggtgctgctctgggttcaggagacagcaggatttggggaatagtttgaggtgtgtgggacaaggggcctccatccacaaaagggggtcagacatgagagtgaagatgtggggtcatttctggatgaggcagtaggtgatggagtaggacggagggtgacagcatagcagggaggggtcttccagggcagtcaggaggaagggtgtgggaaaggaaggcggcaagtccgaaaggaaagagcagacccagcagagggccaggggtcgatgccagagtgaggccactcagctgttctctgcagagcctttgggtgccgtggagtggggtctagagggatgtgaggtcagggcctgtgacgcgagtgtgtatcctgagagggctgaggcgtgaaccctcttcatgtgctgagtggagggagccaggccaggggattggagattgggagggaggcagtggctcaggctgtcctcagatgtcagctgtgggttttatcctcatcaactctgctctgaaccggtccccacgtgcattctgagcagcgccaccgccgcactgcacagctgctgcctcagcacatgtcatccagttctggtggtctctctccgttctgccttccggcaggccctggctactccctccgtgcctcctaactgcagttctgcagtgactgccagtgccgctggctagggggtgggtcaggtatcctggggtcaggtgtctaccttaggctgcacatttgcttgggattgtcttggtaggagctgtgaggggcagttttgctgagagggcgctctgtgagagagaagccacactgcagagtgtcttgagaaaggtgaaataagcagcaggtggtccccgtgtagcttgtccgggtgccagaagtgcagtggcccaggaggctgctgtgggaggccgtgtgggcctgtgcttaggtggttgtcgcatgttccacagcaagacagatgacaacttgtcctggtgtcttcagacactcagaacgcaggagtcatgagagtggctttcgttgagacctgcgtggccagcactctagaggtggggccgaccccatgcagttctcaggttctttgtttctgggacacagctcttgaaagcccccgccagtgttttaaataaatgggagaccttgccaggctgcttacgtataagactcccttttacatggagggtgttcccttttctttcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaagcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcagtgtgtgtccctttgtcgtattgtcagaggagcctgtggccactgcccccagggagcacaccagatcatcccagctgggattcctcacggcgggggcttttctgcagacttgggttagctctggcacgttttcttctgtttctgatctcccttctgtcattctgtggtcttcctctggaattctcaggttagttggggtctgtgagacggatgtgttcactaacctataaatgacattttgcagctttttcagcagatgccattgtgtgagtggcacatttgaccactagaagccagcaggctgttccgactgcgcttccctcctgcagttgcttagaagcacagctccctgtcatcactcctctgtggtcctctgtggtcacggttggttgcgatgagacctgcctctgcgtcttgttacttagcatgtcaataaagaggcagattcctgtgtcagtgatttgctgtttctgttttggtagttggcggtcagctttcctttgtaatcctgtgaggcagggtccccaggcttccccaggtgctggcgcctcgttccctgggctggttcccaggctgctcctggtggggtgcactgggcgagtgcctcagcacaggcccccaggcatgtctgttctgccctttgcccagtgttctcactaagcattctttttaatgggtaagaactctaatgtgatactgagttggggtccccaagaccacccagggcggcgattctccaggaggacagaggccatgcaggtcacggtagtcacggctgtgatttcccacagggaggacactgagcaaaatcggccaagggaaaggttcctggggccgagtccaggggcaccatgctcagctttggaggcctctcctggggtgggggtcacgcaggatgcgcctcactcccctgcaagcagctgggactctgcgtgtgcgatgttggggatgccctgcctggtgatgtacccgggggctggtcacgtgagcagcttctgcctgggctgcgctacaattccagactctcagcagggatgtgagtgttctgcctaaaccaccttgtacaaatagcacaggcccagtgaggcggggttcagggagcccctcggaaatcccagttcccagacgccagccaagggccagcccggccagcgggcctcaggacggccgtccccactgtatggaccctttctgcgcagataaccttgggggttgacagtgatttttaccatttcatttgctctgtgtttctgggttttgtctgctggcactggtttgccacagttgtttgcctgtctggctgagtgccgtccttgcttttcccatgcaactgtctgcttcctgggatggggagggctgctggggtggccagggaagctctagggtctcatcttctgggtgttggggcttttcacccttcctgggggttagcggccccagttcactgcttgggccacagcaagggtggcgtccacagctctgactctcacttctgggattgctgcacctgctggggcttctccagtccagtctctgtgtagatgaggttgctaatttttcagaggagtgctgttctgtaccagtttcttcataggatatggaactgctccagctgcacagaaaggcaccccagggcagccccagcttccctcccctgggcgtgccttgcaccgtggccccctgagctgacaaggtttctgcaggctggaatttgtgctggaggcgagggccctggggatgctacctggacacaaggaggggacaggaaacaggtacaaaaattcggggctgccaaggggcagtgaacacactaaggacaggtggattctggaaaccctgccctggaggggaccgcggggccgcttggggtgggggcagggtttggagaggggctgtgaacaaagccagcccctctgggtgttggcctggggcctggaccctgggctggggggggcaccctgggaggaggtctcgtcgtgctgatgtggcgtggtggcccc

SEQ ID NO: 14022 - DNA, 9798 bp, Human
gagagaggttgagttgggtagttgttggtatttttgtttttgtttctttgcttattcagttgaggtttattgtaaaacttgacaccagaaaaaggaagaagtggcgtttttgtgctgtgagcgtgtgacgtgtgtcctttccagagaaaggacagtcatggtgcttttttatcctctctgcccaaagaaggaaagctcttaacagccagcaggaggctttgtagggaccagcgttatcaacgccagtcgcgctgaccaatgatgagttaaagcagttaggtcgtttctaagagcaaatcaaaagctaaggttctgtgattctgaaaatgagacacggacagagactggagacccagagagaaagtgaaggactaaaagacagtcatagggtgggagtttgctctcctctgttttgttctgggtttttttgtttgtttgtgcgctctgtctgaccgcttttcttttttttctttttctttcttttttttttttttttttttttgagatggagtcttgctctgccgcccaggctggagtgcggtggcacaatctcggctcactgcaagctccgcctcccacgttcaagggattctcctgcctcagcctcccgagcagctgggattacaggcatgcaccaccacactcagctaatttttgtatttttagtagagatggggtttcaccatattgaccaggctggtcttgaactcctggcgtcaagtgacttgcccgcctcggcctcccaaagtgttgggattacaggcgtgagccaccgcgcctggccctgactgcttttctccttggtttgtttctcaatcccccttcctctgagccgaattccctttttgttctcattttctctctctgtcccctctctctctccttctttctctccttccattcctcctagatgaagcaaaaactcagataaaccagcacagaggccaggtatggtggctcacacctgtaatcccggcactttgggaagccaaggcaggcaggttgcttgaggccaggagttcaagaccagcctggcccacatggtgaaaccccgtctctactaaaaatacaaaaattagccggacatggtggcacgtgcctgtaatcccaggtactcaagaggtggaggttgcagtgagcggagatcacagccctgcactccagcctgggtgacagagcgagactccatctcaaaacgaaaaacaaaaaacagcacaaagttcccttgtcctgtgactcattctctctctctctttctaccatttctccttccctgtgtcttttttttttctctctgtgggttttatttaagcaatagaagttcttagcaaagaaaaactttatggaattagattgatccacttcatatgtacatatatgaactcagttcagaaactctcttctacccctgcctgatcacctatttggaagtctgttccttcaactcttcttctctttctgggactctttctagcttgggcttcctgcccctcccgtccactctcctgctttcacagcctctccttccccctgcccctcccctgcactgcatggggatgggccccaggtgtccaaggtctccccaccctcctttgtcactggagtcaggattagaacccagctccctagtcaccttgagtcatcagtcctggggctgctgacgggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaaggtgagaaggaggtaggcgactgccaatgagggagtgacacacaggggagcaggtagagagaggacaagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcagggtactgctcacctcggtctcccctattttttgatccctcttcccttctgtccctctctgaatctctgtctctccatttccctcctatgtgtaagcatctttctccctgggtgtctttgatgtttcatggtctttttctatcactgggtctctctctctttctctctctttctcgtctctctttctcctctctctctcctgcctgtttctctctctcactctgtgtgtctctccatctctgtatcttttcttcctctctctgacccatgcccctgtctgtctccagggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaagaagctgatcctgcaacaagagagtctgaggttagaccaggagtggaacttccttagcagtgggcctggggtggtgctgggcagggtgaggtatgttgggtggagggccggggagggtcctggaacctgccctcctgcctctcccattcctgcatgtaccctttctttcctatatgacatctgccactcaccccagccattccttgacccagtctgggcccggggcccaggtctcacccaagctctttttctttttcttttttttatttttttgagacagggtctcgctctgtcgcccaggctgctgtgcaatggcgtgatcacagctcactgctgtctctgcctcccaggttcaagtgattctcctgccccagcctcctgagtagctgggattacaggcacccgccaccatgcccagctaatttttgtattttttgtagagacagggttttgccatgttggccaggctggtctcgaactcctggcctcaaatgacctgcccgtcttggcctcccaaagtgctgggattacaggtgtgagccactgcacccggccaacatgacccaaactctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcacacctcagcctcccaaggagctaagactacaggcctgcgccaccacacctggctaatttttaaattttttttgtagagacagggttttgctatgttacccaggctggtctcaaactcctcagctcaagcaatcttcctgccttgacctcccaaagtgctgggattacaggcatgagccactgtgcctggcctggaactttttttgtgaaaggggagatcagatgcaaagaaacagagactcagggagagagagggccagcagcaggatgcagagaggccattcatcaacccactcgttcaatcatgaacccactcgtccacgcatgagcatggagggcacatgctccgtgccaggcggtgggaataaggcagtgaacaaggtccactgatgtccctgccttcatgggcttcaccagccgagagaatcagaaagagaggcctggcgcggtggctcacacctgtaatcccagcactttgggaggccgaggcgggcggatcacttgaggtcaggagtttgagaccagcctgacacacatggtgaaaccttatctctactaaaaatacaaaaattagctgggcatggtggcatgcttctgtaatcccagctacttgggaggctgaggcaggtgaattgcttgaacctgggaggtggaggttgtagtgagccaagatggtgccactgcactccagcctgggcgacagagcgagactcggtcttgaaaaaaaaaaaaaaaaaaaaaaggagagagagagacacagatgcagggacatggtaggagaaacagggaacacccaagatggaaagagggtgatggaggttgggaataagagcctgtaagagagactcggagaatgagagttgcgggtgagaggacagacagtgaggggcagaacagtggggagcggcaggagcgcctgagtgtccgtggaggggtgcaaggtgggggactgcgtgcctgccacccgctcagccgtcgccaccggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagtaaggggcccagggccaggggtcaggggtcaggatgggtacaagtctgggatgcagggcgagaggtcgaatcatgacacctcagaggaaggatgggtaaagggtcagggtgtgggatgggacatcaggatcatggtttggggtcagagattatggtggattggggtcttgggagccaaaggggttaaaggactgggtatgaagtcagggatcagaggtcagaggtcagagtgtgtcagaggtcatcacactggagcaaaaggcatatatatatatatatgtatgtataggatatgggcattgtgggtcatgggtctggggttagaggtcaccgtagaattaaggtcatgggatccagaggttgtacaatctggtcaaaatctgaggatggaaattgggattctatccaaaatcacatatctgagattggaggtcatagcgtttggggtgtggggcccgaagtttggggtcatggaggctggggcccaataaactaggatcaggggacactggcgttggaagcagtgaggtttggaagatgcagagctgaggttggaggttaaggtaaagacagggacatggggtcaggagacagaagatatgagatcaagctgggatcataaggtaataagacagaaggtcaaagatcacagtagctggcattgaagagggtcaggtctggattcgttgtctctgacgctggagagacaagaaagttcttgagttatgccactcaaagtcaaatgtcaaagatcaaagagaccgtcaatcatctggggtcatgattcatatgaaattaagtcataaatatgtaacttggaggtttcgggattgtagtacaggtcggtgaggggcaggggtattgacatggatgggccacatccagggaagagggacgtggcctcaaagtggggagatttaggggaccctgcagcacgcatgttctctctccagacccattcccggatctgctccagtgcctcaacctctccatcgtctcccatgccacctgccatggtgtgtatcccgggagaatcacgagcaacatggtgtgtgcaggcggcgtcccggggcaggatgcctgccaggtgagccagtgcaggcagcgtgcgtggtcaccaggacaggaagtgaaggggaggggctggaagcaggaggggaactgatggaggatgaatcagggaaaggggatgctgcagagagacggggtcaaaaaggaagggagaggctggttacggaggctcacacctgtaatcccagcactttgggaggccgaggcgggcggatcacttgaggtcaggagttcaagacaagcctggccaacacggtgagactctgaatctactaaaaataccagaattagccgggggtggtggtgcaagcctgtggccccagctacttggaaggctgaggcaggagaatcgcttgatcccgggaggcggaggttgcagtgagctgagatcacgccactgcactccagcctgggcgacagagccagactctgtctcaaaacaaaataattaataataataataataataataataataataatggaggagaggcccaggataagggagggagagagacagggagtaaaagggaggaccggggaatggaggagggggaggggcagggagagagagggaggaagggaacagagaaggaaagatggggcaggggttacagagagagacagcaaaacagacggagaggactgggagcccagacagggaaccagctgtttctggggctctaagtctttcccataccatcctccagttggtgctgtcccagactgagagagatttgaggatggcggtctctcccctcattggtcagggccccagccattgtccttgagagaactctgtgcttttgatggagtcctgcccaccttccctgggattggtcatttttgatggcactctctcccctcattggtcagaaccccaggcattgtccttgagagaacctctatcctttatggagtcccaccctcctcccctgggattggtcattgataatagtgttctctctcctcattggtcagggccccagccattgtccttgagagaatgctcgactctttatgttgtcttgacagcctcccctgagattggtcattaatgactgtgctctctctcctcattggtcagggccccagccattgtccttgagagaacctctgtcctttatggagttccacccttcttccctgggattggcccctagagacagtggttcttctcttttggttagccattgccattgtcctccgggaaagtgattatactcttttgtctaatgaccagacttggagccctccccaaggcccaggactgggttgaagggttggggaggaaaacagaaataagatgtctcccttgttcagacagtacttctcttcccttccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggccatgtctgtccatttgaagtcctcatgctggttgagactggaagaaggactcagcagtttccctatctcataggagtagaaacagagctcaaataaggccaggcacagtggctcacacctgtaatcccatcactttgggaagctgaggcaggtggatcacctgaggtcaggaactcgggaccagcctggtcaacatagtgaaaccccaactctactaaaaatgcaaaaattagccaggcatggtggcgcatgcctgtaatcccagctactcaggaggctgagacaggagaatagcatgaacccgtgaggcagaggctgcagcgagccgagattgaaccattacactccagcctgggcgacagagcgagactccatctcaaaaacaagcaaacaaaaaacccagtgctcaaataggatgagggtcttccctgagtagttactcagaaatggagtagaaaaagttacttttaataatataggctgggtgcagtggcccacgcctgtaatcccagcactttgggaggccgaggtgggaggatggcttgagctcagatttcgagatcagcctggcaacatggtgaaatcttgtcactacaaaaacacaaaaaattagctgggtgtggtggtgcgtgcctgtagtcccagctacttgggaagctgaggtgggaggatcacccgagccggggaggtggaggctgcaaagagccgagatcatgccactgcactccagcctgggcaataaagtgagaccttgtctcaaaaacaaaaacccagcaatataaataagacacatgtttcttcatctggcataatagaaatagtgcccagagcttataagcttttcaagagtccacaaaagacccgaaaaagaaaaagaaaattgttagctccaaaataccagatgaaagctgcaaagtcaacatttatgaccatttaatccaatgtccataaaacgtagcattctttccactagccaactgcagtttactttcttgtaatgaagcatacattgtatctttaatgtgggacgtggctttgttctaataagacgaagggtggagtgcaggcttggaaagcaggagagctcagcctacgtctttaatcctcctgcccaccccttggattctgtctccactgggactcaagaggtgaggagagaccatctccccaaatgcactgaagggaaactggaggagggagggagtgaggggtgatcataccagcggaggcacatttgctgagcccccctgcagtctgctctttccaagtggaccctcctggaagcctgatcccaacctcccctgcaagcaggtctgtcacccccatctctcagatgaagaaactgagccttgcaggggtggagtcccttgtccccacgtcataagggtagtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggacttgggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttca

SEQ ID NO: 14023 - DNA, 9571 bp, Human
gagggagaggagtagcaggggagcggtgaggggcactttctggaggagggtatagggcaaaaactgggaggagaagagggacaaggttcaatagcggagtgcaatggagaggaccgacacagccagcccgattcagagccacagagtaatgggaccagatgatcttcacagactccctttctcccatagatcttgcacaccatagtggagacttcccatgtacatctatggtttgccacttacagagttacttggagccagctgaagttagagctggcttctcccctttgagtcttcaattctgtgtttatgtgcaggcccggggaccatgccaggcttctaagaagtcttcgaatgaaagtctgcttgggcttctagtgtgtccagatctcagtgccactattatccactgatattgatcaagtgctgctctccaggaagacccctgaggtttcctggtccattgcaatgcatgctgggtactcttgcacttggatggaagtaaaatctcctcactaaactctgtgccaccaaaatctccttctcagtgtgaattgaagaaacattttccaagacttgcatgtgccaggagccaaggactcagagtgataaaacaggccttctgccctcagagctctctgtggtggggcgcttcctgtgctgtctggctttacacacagcaggcagaatgacttgaattcggctgctgtgctgtcgtacaacatgctgtttaggatcttgcacatgatagctaggtattcttgcttcaaatcgcaggcaccccacttaccaactgtgtagacttgatcacgttattcaacccctgtgtctctgcttcctcattttacaaatggggagaaaaatagcatctatctcaaagttgtgaaaattaagcaagttaatacatatgtgctacgtagaacagtgcctggtacatggtcagtttttgatacatgttaggtattatcattattatcacctccagaaacaatttaaacttctcatataaggctctccagacacctctcattgtcttcccttccaaatctgcatttatctctctctctttgcagtccagtgtgaggcttgaatcacctatcaagcctcacctccacccctgtgctttacaaaatgtcctagagcttctatttactcgtctcactgctctgtgggctttttcactcaagggcgtttgcatgctatccattgctacctgttttctgttgctggtgtctgtctcctgctctatctttgaagaaaagaaacaagaaaaggaataactgagaaacagagaaaaaaaatgtctctcccttctggttcttccagaccacccactcatccatcttgttcaatgacagcttctcttcctttaattaatcactgtggtatatttataaagcttatatttatgaaagaccttttaattttttagttattaaagccctttctctttgtcaggttgtaactgagtgagctctggagtttggaaagaagatcttagaaatgggccagagagctccttctgagatccaagcacggggaattgcacctgctgtgcatggtaagagagtgtgcttggtagctcacaagggcaaggtgagaatagaaactttcatgcctttttgatgggggttatgaaatcctaccaagaaacaccaggtatcagatgtggggtcctgttttcccaaagccacaaatgcttgaaggaagatcttgtgtgataaaataattaccacatgaaccaatcttgcatgcacagcaattttgagagcccatcctgggagctaggtgtgtagtgtttatcgtattgttgaggctcgtaaaaatcttgtatggctgcaggcaagccaaacccttgacaggcactgcatctccgctgactctagaagaccaagcccaatttcttccctgtatataaggggaagtctctatgcttggggtagaggagtgtttagctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgagtttctctctcattgcactggtagggctgccgctggtccacttgggattggtgcagtcaaaacacagtaggtttgaacctcaagtttccatgtttacatgattaaaaggatgttttgtggaatggtctcctaggagatatgttagatgtatgcttgtgaatggtgttaatgactctctctttgacaaagggttcgtggtcgacctaaaggtgggtcagtgtgacattaacatttaagtgctttttattcagctcttgagcggaattgggactcatatctgttgaatgaagataatagaaatggggctaactgaactttccagggtgcaagtgagaaccctggaaaggtcttcctaaccatagaaagggagttgagtgtgaacatagtatagagtgttattgtagcagaaaacatgtggtcagtcagtgccaaacatcttttgctgtcagaggggagctctgccttctaataattttacattggtactggatgaggctagagtttttttatactaatatctccaaaaatcagctctaaaaaactcagataaaccatttttttaattttttgcttaatcattaatagtgccaatccaaggttatccacaacaaatttcaaatccaattttgaattttcctgatatacttttgaaatgtgtgtgtgtcctggggatgcaaaccagtttttatggtaatatacctaacaaaattttggaaggcaaatctcttaaataccatgcacctatttcaaaacataattgcaataattctgtatgcgctttgctattggtatttgtttagttactcccttccaagccctctctgaattaacaagttgggttttattatgcagatgatattaacttgatcatcttcttcctatttctctgtcatggtcagaagataggaattgaggttcttttccaaatgaggcacagttctccatggctatgagactccatttatgcatcaggagtaaaggggtcttgtgtttttaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtaagggaccctgtctgggcagttcttaacttttgctgtaaaagagttccagaaagtaataagctaagatcatgaagcagcatgtagctatgtcttttcttaggttagaggcacatcagtttgacattttcagaaatcttcattttctcaggagatggaaatagtctagtggttttattgctcagtagaaagtagtggccaatatgtcctaggttcataatagaaaggcagtgataggcaatgccacctttagtttagaatgctggacttcaggtcttaccacctctgaatctcctaattgtttctgctttcctgcaggtatgaggatgaaatcaacaagcggacaaatgcagagaatgaatttgtgaccatcaagaaggtaagcaaattctgtaggacggaactcacatttgaaataaataagggaagagggtctccaattactaagcagaaagcagccatgatatggagagccaggtagtagacctggggagtatatggagtggggctatattttcacatcatcatggacctggactgatccaggcacttggcttctccatatttcccagcaccttacatagtaagtggagtggcagattctcagcaagccaggcacactcccttgatggtgctatccgggggtgggacagttagggaactgtgatttacctggggcaaaaaggagtggagtagacccaaagctcctttttttgcttggagaatcccctcacaggtaatgagagggacctgccctggagagaatgtgccttcatgatgtcccttgttcctctaggatgtggatggtgcttatatgaccaaggtggaccttcaggccaaacttgacaacttgcagcaggaaattgatttccttacagcactctaccaagcagtaagtcttccagtttcaaccaagtttatctaaatggagagtttttaagcctgaacccacaacgattcagaagaatagatatttatcttttatttcctgactgctttctctgtctaagttgttttttgttttagtgctgtaagagtcactaacctattatgtcttgcaggagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaaggtgagtgggctgaaagcctagccagtttccctgaaatggcttgtcttgctatcctgtgttatctcatgtatgtgtgcctgtgccatgctgagttctgcctacatttaacaaacgctatctaccatctttagtatgaagagctgcagatcactgctggcagacatggggatagtgtgagaaattcaaagatagaaatttctgagctgaatcgtgtgatccagagacttagatctgaaatcgacaatgtcaagaagcaggtatgtgctttctccttctaccactcagctgtatggaatgggggtaaccctcaggtaaagggcgagtgctttcctagttttgaatcttgcaattcatcccaaggctacattattatccctggttccttttgtgactatgctagtttccagaatgcagccatcatgctgggttctctttagggaaatctgtgagaatggcctagtagagaaagatgggatggtcaatgtgagtgatctagcctatgacccaaagtggacttaagagttggggagtgagaggaagggcagccaggaggttttagagtaggtgtttagaagaatgtcaagtctgtaagggttgtaggagccttgactcagggccaagagaggctgttgagttatccctaaggtcttttaaggaagtcaacatggtgatgtgttatctggaggtgggtgtgagatgacttaaggccaagtggttctgttggactcattattggcctcactggagtggggagaccaattgggatgaggaggcctagtggggaatgcatattatgagagggtgtcatattctttttcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgtgactaccaggagctgatgaacaccaagctggccctggatctggagattgccacctacaggaccctcctggagggagaagaaagcaggtgaggaagggacgctgggagtcgaacctcttctcatggtcttccttccttgcaagctgattgttgttgaagatgcagccatctgattgcagcttgtgctgggtatggggaaatgaaaagtacacggagcaggaggaaggacctagttttactttgggagctggagtcccaagctgtttatttttttcttctagggctgtaacatatctagaaagagctttgaggtggagcaaattattctttatctgggctgcctcagatggcagctggcctaaagtcggcatctttagagggggccttcattggctgcaaggctcttgtctcgtttatatgggaatttctccgtgtttgtactcttgctgagaaaaaatgacaggtctgggaggccagaggggattggattaagtttcagattaagtgcattggagaagacccagatggggaaagtcttcaaggtggtggagcggggaatggggaagcggtttgggaagctggagtgtcctgaggaattttcttattttctcctacaggatgtctggagaatgtgccccgaacgtgagtgtgtgtaagtacaagtcgatttctcaggggcatgtgcaggctttgttgggctggaaacggagttgaggttgaaaataactgagcttcctcttgcagctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattctccatgtctcgatcgcccttgtttacggcactgtctaacctggatgggtgttttgtgaggtaaaagaagacactagagccacatggcatatgggaaagtcatgcacacaaacatgagaaaaatgcagaggccaaccaggcaacatttcaccagactggaatcacagagagagcaagcactttcccagatggtggggatgtcatggagaaatggagagaccgggtgacaggttttgttcatttgagaaggctttcttgaaaagggcagtgagcaagcaggttgggaggaagaggtgtggcattgagaagaagggaaagtattgcatgaaaaagtaattcttcacgtggaacagccagtaaggaggggcatgagtaatatagggtcagcagttactggagccagaatacagactttggcctggggagttcaagaactaagagtggtaatagagagttggatattccatttcccttctctttttgtgccaccacccaaagctctgcataatctaagaagttcccttgttgacacatagctcatacttgtgaagttgtacaacaggatagcatagtggccagaagcatggacagttgaactcagatatgcttgggtttgaatcttaccatcaccatttactagttctgtaatacagtgcaagttacagacatctctgcacctcagttttagtatgtctaaattggggatgataatgccttccttgtgggaatagtgtgaggattgaataagatgaatacacatggctgagcacacagcaagcactaaataagtgccagttttaatgataacggtgatgatgatgatgatgatgatgatgacgtaacattgcttgtgggactccatacagctcagtagatgcttgctcaaagaagcaagttaccaaaatttttgtaatggttctatgaacgtgaaaaaagcagtcaacttctctgaggatcaatttccttagtttccaattaggaaaagtcttcttagctccagagtcccacagggctaatggaataaggagaggatagatcacacatgtattatgcaaacacaactcaggtgagctctattcttccttctcagttatcccttctgtagggaccccagtgtcccctgctgtctttctgtgtcctgaccgggaaacacagtgtgccttgtctactccatcacttggccagctgcatgctttcctttgcaggcttgaagcaaagctgggtctcggacattctcaggcactgacaaagctgtttagttgttgctgggaaacactgggaaatagcccttttgttaaacacacagaaactagccttcgccctgagccaaattccttaaactcgtctatgaaattccataacctgactccttaactgcagacatacccagctagaacatccctcatgtccctgtccaccgtgagaatgctgcacttcactctgaacctttagtcctccttttaaatactgcacactgatcaccctggtgtttagtgctttgttttttggaatcccacctggctccattttgggatggttccgggcacttccctatggaaattcccctgctgtcactgtcagagtgagtccagcagtgggtttagctggatgaaacaccaccatgtccatttccattcagactaatgtcagaatttgaaaggcactatggtagagtagaaagaacaaggaactgtactatttaaagggcaggcaaagaaaaggcatctatagcttataagatgtgtggatctttggatgtgacttggccatcctgagcctaagttgtcttgtaggagaaatgggaatgagaatattttcctctagacatcaagaggaaaagaaatataacgtgaaaacctttgtgaattgtgaatgtgttatacagagtagctaaaagaattaaaaagggagtgacaaaaaagtaaaaggcagctggctgctcagggcctccatggagggaagtaccttgatatggtcact

SEQ ID NO: 14024 - DNA, 7548 bp, Human
catactcttcaaaccaacttctttatgacactgggggaaaacattaaatcaaaaggcaatttaaattaaagcattaaaaatttacctgaaaaatgtcaactccatcctttttctttcaatgcttgtaagggaattcttacaagctttcccttacaagcattgaaagaaattccttacaagcattgaaaaaatcccttacaagcattgaaagaaatgtcagcaaacatgatgtccatttctcattaactttatttcctacttgttatcagaacgaaattaatagctacctgattcaaacccttcacatatttatttaactattactcctctttgacagaaggggaaactgagacacagagtaacttgtccaaggtaataatttctgccaggagatggtggagccagaatctgaaccctatacacccaaattaatggacgcattttaaaagggatgggatggaaaaggagcagttaatttttttccccaaaatagcttgcaagaaaagattgttgtgaatgggaacaaaccgtttaaattacaaatgcaggtagatgagaatgcagagtacacaaactttacccctaaaaaagtaggggtatatttgttatatttgattacaaacactttgaacaacatcaaacccctgtgacggtcgactgagtaaataatttaatgtcaccgttcagacactgtattttacaggctaaataaaatacattatatattgaaggatgaggggggttggtgatgttaaccggagcaagagtttaaggaaaattactttcattatgagcagttaattagaaaagagtgcgtgtgtcaaccgaaggaggttaaaaaaaaagacaatcacattgccttaacgcactctctgtccgaaaaaagtaactaaatcaccgtgggtcagcgtctacgccaactggagaaccggcccagcgggatcttgtgaggggatgacaggagaccctagaagagggggaacagtggcagtgacaggaaagatggcatgtctcccatcccggaaaaaaaggggagaacacggggggcaatcggcggagaggggaaggcagaaaatgttaccagaggtgccaaatgaggtgagaaagaccagggtaggaaacataagaaaggcgggactctcgggcaggaaggtctgtttggggtagggaaggcatgtcaggacagagctttccggacagccgaccttccttctttccagcccctccatccccgacaaactcactttctcagcaaccctaagcccgtgggtcaccctcgccttgctccccgccccccaccccaagccggataagtggaggagggagcttcagcctcaccctccttgttggggaggagcgggcactggacatagaccagattcatggacgagaagaccaggagacgcagagaggcccaggacccgggtgacaagtcggggcggccaacggacgcctcacctgacagaagcgtcggcagtaatcccgactgctgattccgacgccgccgccgcagttgccgctgccagcgccgcctctgccgtcgcccgcagctctaagccccacagggcccagcggggactccacaatggccacaagctcttctccgaggcgttcggcctcttggtcgctctcttcctccgccatgaggctctcgccgcccagcgcgtaccagcccctgcgccgccgccgccgccgtagatgcctaggctaacctcctcctcctctctagttccctcccccttccctcctccctagccggacaggggcctctcggctgggctctacttccggctccgcccacccacgcccccagtttttattggaagacgcaagctgccaatcatgttcatgcccgcctttccactactattggtgaaatcgacagtctgtttgataaaccggccgtctgttggtcaatgctgctcggcggttgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttgcctaacggcggcctcgatcctacggtaccaaggagctagggaggccgagggtgggcccgaccgttggtgcgggctctgggcccggggccttccgtccagaagctggaaccgggggcggggctggggcacagttgtcggcgggaggaagagggaggagacgggaagcttgacagcggccgcctccgccaggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctagtatgtattcatggaatactccatcgtttctgattacacttatgagacataattcttcagagcacacttagaattatttctctaacatatttatgcagacagaattccatcttgaattttatcaaattcactttaacttcttaagtcttggttattgtaagagcccaaaggtatggccccagggaacaattaagacttgatgatttgtcacctaccaaaatatgttcattatgtaaaggtttcaatgcccataaggctgtcatttggtatttagtgcagtgctcataaaagtgtgttattaggataaattgagaaattaattaagctgcttctagattaaataaatataaatatttggacaaatattgaagatacgtactttttccatcaaattttaattgaggttctgctgtatactagactctatgttcttgattttgttcttactagttaagtaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggttttttttttgtggtttttcctcagaacaattttggaaactatattcatcttcatatagaattatggcagtttataggcccacctgtttgaaaaaactttatccacagttgtgttcctaaaatcagttgtcccagaattgtgacaggaaagaagctcttttgaacttgaatgcatatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaagttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactccta

SEQ ID NO: 14025 - DNA, 63544 bp, Human
gaaatgcctttattaacactttggtttgtaaccctccattattttctctagacatatagatttatgaggcaggctaatgtgctgagacactagcttgagtttcatttggccttgctgtgaatatacctgggccttcctttgcttcaggatgccctaaactgtggcaaagcagagctgaactgcccaaaggaaagtgtgaagaggagaggcaggccaagcctggagaaaggctacccaagagagaggaaaggaaactgtggtgagtgcacctcactcctaaagaaggacaggaactctggtaggtgaggtgtgttttccatagatactaaaactcaaagccacacaggggacatatgtccattcctcagccagtcactgtggccaggaacagagggtcaggtaagagaatggcaactcctaaggaaaccacatgcctggagccgtgggtgtagaagcagatccccagaggaagcacgggtcccacagacacagtcccaactcttgccgtctaggcagccactcccatctgtaggtactacacagcttcgtagtacttcttaaagtacttcttgttcaagcgatgggacgaaaagaggatgcaggacaaggaggaggaaaggagatccttgcttttgtagaagaaacaaggaggcagggaaggcttagaggacaggcaaggagagatgttttcttaaaaacatcctctgtctgagtgttcagccccacatctctgctggtcctacccctataagcacaaggaaaagggcgggaggcagcaggagaaggattgatcattcaggcctatattcaagtttgccttttcttgccatgtggttttaatctcaccaatcacaagcctgaaggtatagtggggccactgaggtccgagttcaaattcagccatgcaactaaggaaacattgtttgatcttggtcctgttttctcatgtgtaaaatgggtctaactctaaaccacacattgcactgagaatgaaatgaggcactatgaaatgaagtgaggttagttgaataatgttccccccaaattcatgtctactgaggacctcagaatgtgactatatttggaagtagggtctacgcagatgtagtctaaatgaggtcatactgcattagggtgggcactaatcaaacggatggtatcctcataagaggagaggaatgtagagatacacacagaaaagaatgtcatttgaagatggaggcagagattggagtgatacaactataagtcagggaatgccaaggacttgaggtcatgtgttacagaagccctaggaaatgagtcaatttcctggcacagcactaagacatgctggtattcttcattccatccctttcccctattcctaaatgtgctccagggacaatggggaagctggagcacatataagaataggggaaagagagggaataaaagggtattaaaaactctcaaggtatgttaaaaaaaagactctcaacaaaccaggtattgaaggaacatacctcaaaataataagagccatctatgatgaacccacagccaacatcacactgaataggcaaaagctggaaggatgccccttgaaaaccggcacaagacaaggctgccttctctcaccactcctattcaccatactattggaagtcctggccagagcaatcaggcaagagaaagaaagaaaaggcatccaagaaggaagagaggaagtcaaactacccatgtttgcagatgacataattttatatctagaaaatcccacagtctcagcccaaaagctccttaagctgataaacttcagaaagtttcaggatcccacatgaacatacaaaaatcactagtattcctaaacaccaaccatagctaagccaagagccaaatcaggaatgcaatcccattcacagacaaactgctaaaagcaaaaccaaaactttccaaataagccaggctttcgtcagttcctcagaactagttctggtttgactcactctcatgttacggcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatgtgagtaacgagtgggttgagatactctcatactattatgttgtggaccatgatgaggctgccagggtgggggaagggtggcctaccttctctccacaccatttgaggcaagagacattctgcctcagaaattgtgctgaggggcacaaataagctaatgtcctcctgccccagatttctctcacttgttcctatgcatattgttcttgttgctcagttttataaggtgagatattttctgcaccaaatatgtgcactgtaaaataatataactattcttaagattgtctctcagcttagagttttcggaggcttaatggtgaagaacttaaaaatctgttttcctatgactgacatctgtttgtgattatccatttagcagacggtgatccctccaggctggcctttgtttacaagctatgcctaagaggcagctgttggtggagggggaacaaaaacaaaaaacccaaaactattatcttaataacttatagaggtaatcattattgaacaaaagcatgatttggggactatggaaaggcttattctttccatataaaatgatcagcgaaaaggtagaaaaattaaacagaactgaaataattgctattgattgctcaccgcctggatgcactgagtagaagagcaaaggcaatgggttcatgtggaggggatggaggtggagaggctaagcctgagtgagattaccaactaatcaggacttttaacccaaaaatactatggctctgaggggcagggaatgagagacctaaattgacaaaatgcagagtaaaaatattcagtgtgagcagtaatgagacagttgtatcagggtcaaatacggagttggcctggatgtcctccaagctcctttccaagcctaagattctgtgagtggatgaacaatcctggtcctgctgctcttgccactggaacctgatctatttgccttcattatttgaggtctccccatcatcaggctctttgttgtctgctgcttcagggtgtcttctccccagatttctcctgttggtgagcttttccattgaactggagctcctcacaggcaagaagcacacctttaaggttctctgagtcccaagttcctagtgcagtacctggcaatacacataggtgcttagtgggtgcttgccgaattgttgaatggatttatttgatgaaatgtcaggagaatcaccagaaatgaaatgttcgtgtaatggacagggggaagtttgaggttgatttgaaaaaggagatggtagagacagtattatgggtcatgcttcagagtttatttgctttacaatacattggacagcaaccagtagattgttgtgtgtcattttaattccacatgctaatgtccaaatatgtcatatgtcttaattgttgcatacgtgggttactctgtaaaggggcaactgtagtatcacctcctcatgccacaccctgctccactgtagctgggctcgataaccttcaaatcaactcacagaattccaggacagacaagagcatctgaaaggttatctagccccagtcacctctgatgccttccagctgtctctaacacacctgtgggctgacttccagttcttagtcttcacggctccctatgatgaactgcccctgctttgagggattttcctccattgcctcagaagtactgccctgggggagcttctgatgctcttctgaccaccttgtctctgcctttttcactagtcctctgttcctgctctccaaattttgggacgttcctgagttcagatcttttctttataatctttcttttatattctccccatcagatggttcattcattcctcaatattaactaacatttccatattagaaataacttccttatctttagccctaaattttgtcccaaactctggacctacaattttttggaatgcttatgccttgcccagactaaaaccaaacttactgtcttccctctaaaatcagctccccatcttctatttctccctgccacccttcctcccccatggctccaatattgtcttgccagtctggtcttaaaaccacagtcaatcttgttgcttttctctttgtctcttgtgcatggctgatcagcagtcaattgttttgtcaattgtcttatatgtttcttcttcctcttccttgcttcctttttctgacctgaagttagggccttgttaccaaacatctagatgaatacagtgaccccctaattgagaggctgtctaccaattccacccaccctcaattctatactcaaaaaaaaaattagatgtaatctttttcagatactcctttggtattgtcacttagtttttgagtgactgccactatttcccgattggcagctctgcctggcattaagctcttgacattctcaacctaagtgtccagccaagttactctgttcattgtcccctcaacacgcctgtgcatttgcacctctgagactgcttctgagtcagctatgcactgccctttagaatagcttcaaccccaaatcctaccagtgcttcaaaggcccagttcaaatcctacccctctgggaagtctcccttcctttagtcaacttctagggcttttgcaattttatcacttgttttacatcagttttactatttttcatgtgtgagagttttaaccttccaattatggtacaatgtctttaagggcaagggccctttcttagaggaaaccctctatgaattctccaatgataaattattctatgaattctcacaactttctaatataaaggcttataaaaagtgggaactcactgtttattgcttaaaaaattgagatttaatttgaacttaaatgctctattaaattgagtagaatagcatcttaaggctactggtagtctatctatgccacagatggtttagagatcaaataattactcatatacctatgacagcagagtactggctgtaagatccccccaaaactcaaatacctattgggtttgtcaggcaacaaaaataagtgaatccagctaggtctaatacaatggaaaatggtaggacctggggcaaactctgcataacttgcccaaaggcattcaaattcagattatgttcagacattgctaattacaattagtgtcttagacacttggcttcaaaacagtggttagttcaggtatttcagatcaattgggtatgcatttatctaggtcttcatggatagccgggctctactagacactgggagagggaagaggcaaatgggataagactggcagtatttaacaaagaatgaagtattttacaaacatgatcctttaggctggttattgttacacaaaggaatgatttgctaggattcttgagatacttccatagaatgtctatgcctcacttattgcacagaccagagaattccataaaagcactggctgtgtcttatttacccttgtatactagagcttggcacatagtaaataccaagtaaatgttttgaataaaagaaagagataattaaagcttcagcaccacaattatttgtatttcatctatcagtttggaaatagatctccacagacagtagaaatggcaagaaactaggcctatagcaaccaagaagtgaaactgctagaacctaccatcatttctgatcctcttgcaaattttgcttgaaaaaaatttcctcattttctgtttacgaacttatcctcagaatttacagatgtttccttgatttctctggaaagatacaacttcctaatgcaattgagtaaattgatacttcttatgtagaaataagcagaataagctgggcaaggtagcccacaactatagtcccagctacttgggaggctggggcaggaggatcacttgaagccagagtttgcttgaggccaggaattcgaggctgcagtgctctatgatcacacctgtgaatagccactacactccaggctaggcaatgagtgagacctagtctctaaagaaaaaaaaaaaaaaaaaaaaaagacaaaataagatcaaaattgagtatgaactgataaatacaaggtagacaagaaatatcctgagaggcgcaatcgttctgcagacatttgcttgggaagctcaggggaggatttatgaaggaggtagccctgagtgagtcttaaaaaatgggtagacttttaccaggcaagatcttagtgaagttagtgagaggagtggtcatataggaattcatgggatttttagaccaaagattaccaccctcataagtgataatgacgatgaatgtgaagaatgtttaccacttgcaaagtatttttcacataccttgtccaagttcccacaagcatttctgttcactacctgtggtttggtcaagagacccagatattagagaacgtgttgatttctagtttctaactccgcccaataacattaagatgaaaatggatagccacataggaacagacatcaataaacatatttagaaaacacaagtgaattttaaaaggggagacttaagaggtggcatggttgtttgaacatgttcgtttttgtctcctggagaaaagtcagcacaatgctcattcagctacataagtgtttctgttacagctctttcagtccaccattcggcaggtcctgaattcttgtcccttgtccagaaaaaatgaggtatgtggacaactggagggtgagcaaggcggagaggagcttcgttgagtgacagaacagctttcaggagacccaaagtgggtagcacttttccataggcaggaaatgagtgttcaactctcagcagagaggagacccacaatggatagctccttaccacaggcaggtcatcccagagaggtgaggagacacaagccaggcacagtggctcacgcctgtaatcccagcactttgggaggccgaggcgggtggatcacgaggtcagagttcgagaccagcttggccaagatggtgaaactccatctctactaaaaatatgaaaaattagccaggtgcagttgtgcacgcctgttgtcccagttactcaggaggctgaggcaggagaatcacttgaacccgggaggcggaggatgcagtgagccaagatcacaccactgcactccagcctgggtgagagagcaagactccatctcaaaaaaaaaaaaaaaaaaaaaaaaaaagaaaagaaagaaagaaagaggagatctgaagtgagcaactgcttcccctagctggtagtcccaatgtctgttcaagtctggctgagtccagggttttgtgtttgtttgttttgtttttttgagacggagtctcactctgtcaccagggctggagtgcagtggcgcaatctcggctcactgcaacctctgcctcccgggttcaagcgattctcctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggactccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccgggttgtgacagcacctaggcttggccacaactttgcttcacccagtagcaggtgccaggagtgggaagaggccagggagtgggagcaggcactttcaaccttgtgggagcaggggacttcctgggcccctgagagtacagagatgcctgggtccagagccactgctgggcagctacaggggtgcctgggagcatgcggttcccaccccgccaactcagtacggggcgggactcccacctgttcttggcctccctggccacacctccactgctgcagctgctctaaacgggcagctgctgccatcactgtgagctatgattgtgccactgactccagcctgggcaacagaaagagacctatatggtatgttaaatggtaatgactgctttgggggagaaaagatgactaaggattgttgggaatgctggggtagggttggagtgctcttgcaattttacataagacagtctcaggagaaaaaacaatgaaagtgtccgggtagagggacatgtacactggcagcaaggtcttcccttagggattggatctgcggaagaggccacacaggcctggaagcaggcttaaggccattcaggctaggaattccagtgtttcaaagacagactgcaatggatggcggttggtaggtcaaaagctccagataacatctctcagccctgcgaacaccttactctcggggagaaggatgggcacagtgggtcctttaaagcatggggtccaggacaggggcctcttgtcttggctgttgaaaaaactgggttttacactgagtgaaatgctgagccatcggaaggttttaagcaaatatggtttgacttttattttttaaaaaccactctggctgcagaatcaactgcaggaaggcaaaactggaatcatagcatccagttgtcagactaatgcagaaatcaccatgagaaatgacaatgactctgaccgatatggaagcagtggaggtggtgagaaatggtcagattctggatatatttgaaggaagggccaatagggttggttaatgaatcagatgtagagtgagaaaagaaaggactcaagatgactccaaggttcttgtccttcacctcaataagtggaggatggagcagaggaaggcaagactagaaggtaaaaatagcagtgagaaggctctgctatggtataagaagaaatgataagaagctgaattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttccccagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatcttctggtcaagctaaggtatgccatgagcatttccctgtggaaagcacttaattctgttcccagttgttacctgctgtaagatctccctttctaaaataaaaacaagaatacagctcactgaggaccttacatttccctctagctactgactcatttctcttctcctttttatagcactcttcttgagagagttgcctatatttgttgccacatctttacccattctcttttgaacctattcaagctttcatctgtacaaaactcactgatactgtgcttgtcaggatcatccatgacctccatactgctaaatgcaactctcaagagtatttggctctactgatcactcctttgtagcactgtgttttaaaatataggttttattattatttaggtatggtgaggccaatatatcaggaaatgactgtcgttgaaaaaagtatgttgtactcacagatcccaagagaaggggggcacaccatgccacaaagggccacatggggaagcaccagggtcagccaggaggtgggtggggggtgcgcaagatctttattgtggtttcaacaggaagaaatgggtgaagcagggtgagtggatttaggattagctgatataaataatttcagcaggctctggggcataggggctgtccctagtcttctggtacttggccctggggtgattaaggcagttgcatagtgttgggaatgtgaaagcccccaataaatgaggcagttgtgggtatgggctctgaaatgggttggtttgcatttgaaaggtgtgctcatgggcaagtggtttactctctcttagaggttagaattggctaaccctgggagcggcagtcccttcagggtcagcaaggccccaggtgtcaaagcatcagaatacagaaaataaaatgcatggataatacacactgccatttgcctttgtacccttcctttcaatcttctctgctggtgaccgctcttcacaaagatctataaatgttggaataccccatgtctcagtccttgggcactctctttcctatctctctgtaggtgatgtaatgcagatatccatgactttaaatctttaacacttctgcattgatgactcctaaatttacatctctaccccaactgcctactaaacacctccacttggctatctaataggcatttcaaaccaaatctacaacaaacgtaactctttttccccttccttaatttgcttctcccccagccttctccattttaataaacagcatctccattgccttagtgactcaagccccaaacttaggaattttcccagatttccctctttttctcaaactatatatctagcctgtcagcagttcccttcaggtcttttttcaaactatagaaggcctaaacaaaggaaagacatgctgtattcatgaattggaagactaaatattattcagctggctgtattccccaaattgatctatggattcaatgcaatccctaccaaaattccagcttcctttgtctgcagaaatgagcaagttgaccctaaaattcatttgaaaatgtaaggaagcccgaatagccccctaaaaaaaaatcttgaaaaagactaacaaagttggaggactcacactttccagtttcaaaacttactacaaagctacagtaatcaacgctgtgtggtactgacataggatagacatatagttcaataaaacagaatcgagagtccagaaatacatccttatatatatgatcaattgatgttttgcaagggtgccaagacagttcaatagggaaagaataatttcctcaacaaattgtacaggcacaactgaatgcccacaatcagtagaacaaatttggaactaaagttcttatatttaggttcttgatccattttgtttaatttttgtatatggtatgaggtaaggctccaaatttgttcttttgcatgtggacatccagttgtccctgtacaattgctccatttatatttatcttagcagaaaatacagatgtaaatctttgtgaccttgactaggcaatggtttcttaggtattacacctaaagcacaaacaataaaagaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaactttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaataggaagtttctgctaatgggtaaggggttccttttcagggtaatgaaaatgttctaaaattggataatagtgtttgttgcacaactccgtgaacatactaaaaaccacagagtcgtgcacttaaaaaaagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatgaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcagagccagttccctactctccctgtctaaacctcttagtaagaggtagttcaagagaggggcaaactcaattccagcactcaaaagcacttgactactttgctcagtcaactagcaagtatttattgagaatgtagctctgttctatggagtcttattttcaagtgtcagactcccagacatccagtccaggtaaagaagatggtgtccattattcatttgacaaacaaagttggggttcaagggccagctattgaaaaaagctatggaaagcttcatgagacgtgcaggtaactgccaatatgtgtggttcacaaggactggttcatattcagaaacggccattagaaaaggaagaagaacttctcatttggatttataaagagtgtcttgtttactcttaatttatatcttctcttctccaggaaatcaacctataacttctcctcccagctccactctaccatggtctgtcaccttccccaaatgatttgttattcccctgttttcaaaagtgaacaaagaaccaaagacccagcaaagtttcacaaggccctgagactttcaattgtctatttcagatcaaatacagaacatgatcttcctcctgctaatgttgagcctggaattgcagcttcaccagatagcaggtaagaaaggacaaagggagaggcttaagaaagaagagcaggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttcgaagagctttctcctccctactagctggttccagatcactcttcacccagtcacattcctctcactcacttgagctgcccagcctggtctggcactagagacatgcacttggggccctcctcaaaggaagaccctgagatattctgcttacttctactctgctcctgcctgcagggccagctaaaggaacttttcatgttttctttgcaaggaaccctgcctggctggcattttagagacaagcaaaaggggcaataacttccttgctacaaaacagcttcaagtttccatagagtgataagggaaatgagggccaaaagacactgttccccatcctgtggcaggactgggggcttcaggagaaaacttggggaatgtgtaacctctgtgggtttgtagcttaaaaacactgagatcctgggttttctgtctttgttttttgccttttctcttaggaaaggagtgagctagggtgacaaggggcaacattttttatccctcattggctctttctacagaggaaggatcttttcttctaagataatcagcacaagacaatgaagataggcactagctcccagttaggtatactaatggggcaaaaggaagagcatttacatttattgaagattcactaaatgccagatactgtgctaggcaatttacatatggtatagttcatttaatcttcacaatgatcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatttcatgtctctttaattaaagagttttgatttcagaggagggtacctgcaaaagaaaacaacaaaaaaactaaaggatctgagaaataattagtgtttacttctggggaggggaggaggtctgggatgggggtaaaaaggatagtcttatctattatgtatattcaggtttttgttttttacaagaagcatgtattaggtattatttgtataataaaatataattttaaaaatacaagaaatttctcatataaaaatatgaaagtaatcagactgcaacactcagtgcctgagacagagctacagctatcagggtgtccagacagacagaagattacattttcttccttgctccttgtacagccccagacctgcatgcttcattgaaaagaaaagaagatacctgaattaaatcaatgtgatgcttagtaccctatcagtgcacatttcttttctatttttaaattttaaaaataacacttggccaggcgcagtggctcacgcctataatcccagccctatgggaggccgaggcgggtggatcacctcaggtcaggagttcgagaccagcctggccaacatggtgaaacccctctgtactaaaaatagaaaaatattagccgggcatggtggtggccacctataatccaagctactcagctgaggcagaaaaattgcttgaacccaggaggcagaggttgcagtgagctaagatcatgtcactgtattccagcctgggtgacagagtgagattccatttaaaaaaaaaaaaaaagaaaaaaaaacacttatggcggtattctcagtcattacaaataaataaaaacaatccatatgccctggagaatttgattccaggagtaggtctagaagaacttcaactggagaatggatagagaaatcatggtatatttgcagaatatatattatatatataatagatagcatgtgaataaattaattacaaaaacatatgactacatctattattatatagcatgtagataaattacaaaaacatgtaactacatctatgaatcttagagcataatattgagtaaaaaataaataaataaaaattaaggccagaagataacacatagcacaatgtccttttcataaataaatatattgcttaagcataccttatatatagaagataaagcttaaaaagtaaagaagaggccgggcgtggtggctcacgcctgtaatcccagcactttgggaggccaaggtgggcagatcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaaaagtaaggaagagactgataagcccgatattcaggacgccagttacctctggtgcaggcagacatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttttaccttttttaaattaaaacaaaactttttagagacagggtcttcctctgtcatccatgctggagtgcagtggcccaaccacagctcactgcagcctccaactcccaggctcaagtgagtctcctgcctcaatctcctgagtagctaggactacaggcatgtaccacccggtctggctaattttttaaacatttttagtgatggggtcttgctatgttacacaggctggcctcaaacgcctcgtctcaagcaatcctcctgccccagcctcccaaagcactgagatcacaggtgtgagccatcactctcagcctgccctttattttttcatgaaagaaattgctgaagaggactaaaagaagttttagtaagcattcaataaatgtatgttctttatagtttccaaatcagcaaatatagacatcctgcatttttaaggagatttatatattttattggacatgctgtaatttatttaaccacttccctgttggtagacattatttccattttcttctgctagattaatgcttgaaaaaaatgtgtgcctcctaaagactgtgatgaaagttgcctctgaataaaactcaaacaaatcattaatcattaactctttccttacttgtatgctctttggatgctctactgtgttatctataaaataaagtttgaagtgaaaaattagggtaaaacattttatatcatttttaaaggatatatacatggatgtacttacatatgcatgtttaaatttatataccataacatttattctttttttaaaaaagtcttatgaattttaacaaatgcatagtcctataactaccaccaccacagtgaacatccaggacagttccatcccttgccaaacaaacaaacaaacaaaaagcttcacccaagtcttaagtccaggcacttactgatctattttctgtccttatagtaatgacttttccagaatgtcatataaatgggatcattcattagatatccttttgtatctggcttctttcacttaacataaagcatttgaaattcattcatattgttgtgtgaatcaataatttatacctgtttgctgttgagtatattctagtgtatgtatactatattttgtttataaattccccaattggggcacatttgggtatttcccattttgggtgattacaaataaagttattataaatatttgcatataggtttttttgggcaaacctaggttttcatttcacttggataaatacctagaagtgggattgctaggtcacatggtaagtgtatggtttattgtgagaaactgccaaacctttccatagtggctgtaccattttttcattcccaccagcaagtatatgagagttctaattgttcctcatccttcccagcactggtattcttttctattttttctttttttttgagacagagtttcgctctgtcacccaggctaaagtgcaatgccgtgatcttggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgatattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggtctccttgtgtttcccaggccagtctcaaactcctggactcaagccatcttctcgcctcagcctcccaaaatgctgggattacaggcataagccactgcacctggccttagttaagtttttatgtacttattgtatatcttcattggtgacattcaaatcatttcatcctttgtaattgtatactaaggaattaaacgattgtttaattattgtttattttcttattgtaaggttttaaaaattctctatttttttgagacgcagtctccatcagtcgcccaggctggagttcactgtcgtggctcactacagcctctgcctcccaagtttaagcgattctccagcctcagcctcttgactggctggaattacaggcatgtaccaccatgcttggcttatgtttgtattttcagtagagtcggggtttcactatgttggccaggctgtctcaagcttctgacctcaagtggcccacccaccttggcctcccaaagtgctgggattacaggtgtgagccactgccacgaccttaagagttctttattctagatacaagttctttatcagatattgattttcaaatattcttttgaagtctgtagcttgtcttttcattttcttaactgtgtcttttgcagagcaaagattttaattttgatgaagtttgatttatcaatgttttcttttatggatcatgcttttggtatcatatccaaaaactctttacataacccaagatgtaaaagattgtcttctatattttcttctacacattttgtagttgtatattctatatgtaaggtttataatccattttaatttttatataaggtgtgatgtataggttaagctcattttagttttacatgtagatgttcagttgttccagccccatttgttaaaaaacacccatcctttccccattcaatagcctttgaatcttcatcaaaatcaattagtcatatttatgtgggtctatttctggactttttgttccattaacttatgtgtatatccttttgcaaatatcacacttatatttgttttttttcttacatttttatttcaaaatctaaggacatcttataacccagaaatattttttataccttgtcatgtcttagaggaaagagccaccccagtcttttttcattgatgtttttcttctctcttcgtactccagaggtagatgaaaaccagagggccacaatgaccatggtgatgcctgaggtcattctggggcacagacctcagcctaggttactccacttcgcctatctttagatccaaaactaccctgctgactgctgagataaacaaaggagaataatcaggttggggaaaggatttctatgcgaagacatgtctccatgcagtcctcctacactgagcagagcatgagtcaggtgcttagagcaggattttgtcctaaaccaggaacttcagagttttctgaagaatgtggctatgtaaagcacccccccaccccacccttacttctcaagtacattacgtggcaagtctgaaaaaacttacacttctgttgttaaatgtgggggataaaatataaacttagtttcaagaggaagctatcttgggaggtaatgcaaataattcgttgtgtgtttcctgaataagtgacaggtgctgactaccattgatgcttcattgcaataaaatgcaaagctcccccaagaatttttgaaatgcatcaagctaggtgttctaatctagcaaaaggacctgcatacatgaatttttcatgcttttgccaagtcttttgccctttagtttagttaagggccccacatgaatggaaagcctgtgttgtcagcttaattttgtagttgtggaaaccttccagttttctcctttgtctaataccttcaggagttcaatcctaggttgaagcttaatttaataaccatgtggcatgtaaagtagaaaacaaaacatcttttccttagcatacagcaaaaaaaaaaaaaaaactcactcatggatgtagtgtacacatgccagtggatatatagtcataactgcagtcattggtagcacagaaataaatgtgcattgaagacacagagatgaatttgaattccggttccatgagctaccattctttgaccttgggcaagttgcatcacttctttgagcctcagtttccccatctgtaaaatgtggatagcaacatctacctcgcagagttgctgggaggatcagatgaaatgatgggctagcccagtgtctgacttactgtgtttaagaaatatcaactattacgctacttcccagtgacagtccaaatgcagaccagtgttataactctacttctcaaacattaatgtgcatgcaaatcaccgtgaccttcttaaaatgcagatcctgattccctaggtctggggaaggcttgaaattctacatttctacctagcttccaggtgaagttgaggacaacactttgaaggcaaggtggtaaaagacgcttgcacgtgcaaatgttactttgtgtaactaatggttcgcaatactgtctgcactttagaagctcccaggaaaagaaaatctttaatgatgctgacctcatctccaaaataatgtaattttaacagatccaaagtagtgcctgggcattagtgtgttttaaaagcctcccaggtgattccaatgttagccaagattgaggccctctgcttagtgaatctaatttgcagctgggcttgagaaaaaacctcttcatagaattgtttgcatcagtgtcttgattgcctctgtaacttacaataagcaagaatgtttcaggatttcaaaaatctattgcattgcctaaacctcttattttgtatggagtaatcaagctcaaagtttgcatgtcttagaaactttacttggggcaaaattagaccaagtaacaattaatcttctaggtattctgagctattcagacatatgattcatgtttgctaattgctcttttctcttgtaaatattagctgaaaaatgtcacctgtctgacaagtagcatattttatgcctatcactcctggcacgcattcttacaaggcagacaggaaaaataggaagaaaatggacttttatcaaaggcccaggcagtaaagaggggagttctgctgtaagctaaggggagttccagaggaagttataggcgttccctttcttatgacaagaaagcatagtgcagtaaataaatttgctaaatagattcaacagtctctacccaaagtcatctatttaattcttgttgttatgcagactcagcaactaaccttccttgtaagccccattttcttccctgtttcctgtttatcaaatgtaattaaacaagagaagtattatagaagagtaaaagtagtaggtaattcttgaacttggcatatgattactacatatttgatgaatagttgaatattattcttcaaggacagattggatttggtatcaggtggctctgcattaagttataagggacttaataactcaagtatttaaggacggcttccatcataaagggatctgcccttaagagggtcccattatggagattctgaggtgagagctattccaagtgtgcagtggattaaaataaaagaatcatacaggaaatctctttttacatgccttattccagggtctttgcaacctggcacagcaagtgcagatatgattagcattgttttacacatgtacactcaccttatagccctgcccctgtgcccctcctgcacaaaagaatgctgggcacacgtgaactcctctctgtagaaaggcacattaatgttctagccatggttaaaacagggatagaggcaagccaaaaatgtcggtcatttgaaataaatctcaagtttgtgcatatcactatcaagtgtgctgtgtggcaattaagaatgccaatttgtgtgatcacaggcaagttgcagtttgatgaaaggaaagcagaggtgaatatataaccagggtcatcctttctttctccctctctctctttctgtcatttatttgccaagctcttaactagaacttgctatgtgctaggtactggatatatcaaagcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgtaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacataatttgatctaatcttctgtgattattcagaaactacttcaagattttcctatacctccatcataatgaatacccattcattaatgatggaagcagcctaattttgtcatttttcacactttattgatgtaacactacctttactagtttggccactccttatgctttttttatagaactatttagatcaattcaacttttaaaaaataaagccacatacccctgtggtagatgaaaaacaagtatcatttgcactggtaaatagagaataggaagaaaaataaatgcagtgaaaataaagcagtgttatcaaatcctacccagatactgttatctacccggaagcttcctgtttgattaaaaggaaaaatagccagtgttagaggtgtggaagtctagttgaaattatatgcaattgaaggattaaaatagaattgaaaagggaataaattcctctctgaataatttaactccctttaggctttgattctgcctcatctaaaatcatcttacatacttctagtggcgtgtccctcacattttggtaaactctgagtggaaactacggattttgtagtcaaacatctgactggctctggattttaactttactaacatatgtcctgaagtgaactgcttggagccagtttcctcaactatataaccataatgacaaaacaggtttcacggtcatgttttcagtattaaacaatatagttaaaagtacctagcacagtgcctggcatagaacatactagatatacattaagtatcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacctggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggactggaggtgggagaggcctctgagagcaagcagtgctgtccaccagaagctcttgctggggtgcccagagaggagcaaagggcagtcagctgcacaggagggaatgtttggaggagagagccacctcagatcagcgggtcaagaatcccactcttgcccagatggatggggcaaaggagaaaaaggattcgccacgggaatgtccagataagacaggtgccttttggaaaatgggggtgagatgggtctcaggttacacttcgtaagaactggaatgtaaagtaaaggcagacaatgacaaaatatcttgttttcttttcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtgagtggtgtcaaggactagaatccatggaagcatctctccaacagaggatctgcaagtcacagaaacccattaaaggtagctcaagcaaaaacaagcaggctgcttttaaggagacagctatttcagagaaaatgaaagcatctgctcggaaataatttttgacatctgagtacaaagcagccgaagtacaagtgaaagggggtaggacctataggaataaaatgggactggaggaagccaggaaaattagtccctgaaatgtgggagggtatgaaaaataagctttgcctaattcacaattctcccatggaacatccctgacttgattattaagatactctttttcaatagtttataccctgaatccagagtttttaaaaccatggtttgccgcccattcatggattaaaatatcaatttagtgagtagcaaccagatgcacgtttcccgccctttaaaaaataatgtatagaagagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaagacatataacaactataaaaaatagattttgcttgttcattggcttatggtctccaggcttgaatgctctgagataaatgatgccaatatttctctggcctcttcccctcccacgcattggacctcagatggtctgtactgtcttctagagggtttgtgggttttggccccaaaaaaccattaaccttggcagaaagtgtgtgactttatgatctggtacaaagaaggacaaactagagggactggacatgaggatgaatattgtgttcgcccttatccttgggcaggttattttgcctttcataacctcacattttgcttatttgtagaagacgaacaatagtagtaccaaacacacaggattgttgtcaacattgagagagataatgaacataaagaactgagcatggtacccggcatataataagtgtccagagacttggttaaaagaccctcagttgttacaggggcagtgacctcctcacacctcaaccatcaatgagtcaccaggaaagccattagcctagatgtaactgttttctatctttattgcatttcctacatccaggcagcagctgggaggaactctagaacactgaagtttgtctgagttcccttaatgtaaggctgtacattctcaggatgccttgatgtactcgaatatctgcaaccctaaatcaccacctctgtttttattgatctctatctgaatgctgtattaatgggccaggccttctgcccattctctcaaactgagaactgtctctcattcctggggaggcaccctgcctactccttacctagatcagggatttctcagttgtggagagatttgttccttatagtgttggtcatcaaactgggatatttggggattacaaagacttttcaagggatgtatgggcacaggcagttttaggaagtgagttcctagatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattgacacctgatggaactgttatgactaaaaacccttttgcaaataatgtggtatctaattttctgctttcaacaaaattgaaggaggcccttataaagttaataactgataatcaaaaatgagtaatttttgccatgtaaatcaggtcaaagaatgaaatggcattgctgtaacgaaactgcttccattcccattgatttactcatacgaacaagattccttagcctttataagctacaaaaaaatgaaaaatagaaatagaattgaggctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgatagactggattaagaaaatgtggcacgtatacaccatagaatactatgcagccataaaaaatgatgagttcatgtccttcgtagggacatggatgaagctggaaaccatcattctcagcaaactatcccaaggacaaaaaaccaaacaccgcatgttctcactcataggtgggaattgaacaatgagaacacatggacacagggaggggaacatcacacactggggactgttgtgtggtcgggggaggggagagggatagcattaggagatatacctaatgtttaatgacaagttaatgggtgcagcacaccaatatggcacatgtatacatatgtaacaaacctgcacgttgtgcacatgtaccctaaaacttactgttaaaaaaaaaaattagatcttaatgcagaacaccctgaacatttaaagcttcatagtcacaagagaaaagttttcatttcaatagctataaatattttgttgttgtaaagacatataacgataatcaatacaaaatctgtcaaacaaaaatatgttacattaagataaaattctgtagggaaggtgaaattggaagtgagtttcaatgaatgaaaagaaacaatttagacagagaagaattttttcatttaataatttatttatttttacttagaaggaattgaatagattaggttccttacccaaaaagcctctgttatttgtcttatttatttattctcttttttccacattctccagtctcattccccttttttaacacaggaaattattccagcatgtttcatacatattcttttgtttgtaagagcttatttaaaatatgtaatattgttttagatgcatatattttttttcttgtggaaactatattgtactatatatatatattttagaaatggacacattaggccgggcgcggtggctcacgaccgtaatcccagcactttgggaggccaaggcgggtggatcatgaggtcaggagatcgagaccatcctggctaacatggtgaaaccctgtctctactaaaaaatacaacaaaaattagccgggcgcggtggcgggcgcctgtagtcccagctactggggaggctgaggcaggagaatggcgttaagccgggaggcggagcttgtagtgagccgagatcgctccactgcactccagcctgggcgacagagcgagactctgtctcaaaaaaagaaaaaaaaaaaaaagaaattgacacattaagtttattgtgaaaacatgattacaagcaataacagatataacagcagaaaaaattgtgaagttatgtgcaccttcttttgagatcatttttttgggtatatgtgaatgtattttatctttttttaattgacaataattgtacttatttatgggatacatagtgatgtttcaatatatacaatgtatagtgatcagatcggggtaattagcatatttatcatctcaaatatttattatttctttgtgttgagaacattcaatgtaccccttctggctatttgaagctatatactgttgttaaatatttatatgtatttttcaaggataatgttgtatataaaagataacttcttttatatttagtcacctttggatacatatgtaagagtaaaataattgttttactaaaaaaattcataagatgctgaacattatatgtttttccagtatagaaacttatgaaaaattataagaatcaacttaataggtgagaagagcatactgcatcatacttattttaggaggaatacaagcaaaaaaaaagttggaccatcacctaagagtaggctaccctgatccagggtctctaaaagaagcaagatagatctgaggccccaatgagggttcccatgaatgaagtaggactagaagaaggacatgtttttatcttaaagtgcctgatccatggcataaagcttgaaaatgggtttgtttatagcaccttcgttgatgtctgggcagaaattcttatcaaatataatgaaaagagttaatttcaaaaggacagaacaaattatgaggtggaatgaccggagattctggaagagacagtgataaaggactgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaatttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaaaaaaagaaaactacaggccagtatccctgatgaacatagatgtaaaaatcctcaacaaaatactagctaaccaaatccaacagcatatcaaaaagataatccaccatgatcaagtgggttttacaccagggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacacaaatcagtagctctgctatacaccaacatcaaccaatagctgcaaaaataaaataaaatacttaggaatatacctaacgaaggacatgaaagacctctacaaggaaaactacaaatcactactgaaagaaatcacagatgacacaaacaaatggaaacacatcccatgttcatgaataggtacaatcaatattgtgaaaatgaccatactttgtagattgcaaaagcaatctacaaagtcaatgcaatccccatcaaaatactaccatcattcttcacaaaagtagaaaaagaaatcctaaaattcatatggaaccaaaaaagagcccacatagccaaagcaaggaagactaagcaaaaagaacaaacctggaggcatcacattgcctaacttcaaaccatactataacaccatagtcaccaaaacagcataatactagtataaaaataggcacatagaccaatggaacaaaacggagaacctaggaataaagccaaatacttatagccaactgatctttgacaaagcaaacaaaaacataaagtggggaaagtacatcctattcaacaaacggtgctgggataattggctagccacatggagaagaataaactggatcctcatatcttaccttataaaaaatcaactcaagatggatcaaagacttaaatctaagacctgaaaccataacgattctagaagataacatcgaaaaagcccttctagacattagcttaggcaaagacttcgtgaccaagaacccaaaagcaaatgcaacaaagacaaaggtaaatagataaatagggacttaattaaactaaaaagcttctgcacagcaaaagaaataatcagcagagttaacagacaacccacagagtgggagaaaatcttcacaatctatacatctgacaaaggactaatatccagaatctacaaggtatgcaaataaatcagcaagaaaaaaacaaacgatcccatcaaaaaatgggctaaggacatgaatagacaattctcacaaggagatacacaaatgaccaacgagcatatggaaaaatgctcaacatcactaattctcagggaaatgcaaatcaaaaccacactgcgataccaccttactcctgcaagaatggccataacaaaaaaataatagatgttggcatggatgtggtgaaaagaaacactcttacactgttggtgggaatgtaaactagtacaaccactatggaaaacagtgtggagattcctttaaaaactaaaagtagatctaccatttgatccagcaatcccactactaggtatttacccaaaggaaaagaagtcattatacaaaaaaaagatacttgcacacgcatttttatagcagcacaatttgcaattgcaaatatatggaaccagcccaaatgcccatcaatcagtgagtggataaagaaaatgtggtatatatattatacatacatatatatatgcatattatatatatacaccatggaatactacttagctatgaaaaggaatgaaatcatagcatttgcagcatcctggatggaattagagactattattctaagtgaagtaactcaggaatgtaaaaccaaacattgtatgctctcactcataagtgcgagctaagctatgaggatggaaaggcataagaatgatacaatggactttcaggacttaggggaaaggatggttgggggtgagagataaaaaactccacatttgggccaggcgtggttgctcacacctgtaatcccagcactttgggaggccgaggtgggcagatcacgaggtcaggagatcaagatcatcctggctaacacggtgaaaccccgtctctactaaaaatacaaaaaattagccgggcgtggtggcaggcacctgcagtcgcagctactcgggaggctgaggcaggagaatggcaggaacctgggaggcggattttgcaatgagcagaggtcgcaccactgcactccagcctgggcgacagagcgagactccgtctcaaaaaaaaaaaaaaaaaaaaaatggccttcaccctaagaaggaagaaaccaagggcagaggaaggaaacaatcaaagagaagcaaggcagcagtgaaaagacaactgtacgtttaagcctctaaggcccaaggaaagcatttgctaaaagagccaagtctcagtgtctttttttcccttggggaaacagaagggtgtaagaaaatcggagtcaagaaaatgtcctgagctccgcctgcagtagcgggaagcctaggagtaaaataacacgttttttaaaaataaagaaagaaattattttaaaaaagaaaacaatgtcctgaatttcaatggggtgggggggaggggaagctcctggggattacaaactcgttaacctgctattccttttcaggcaatttaacagatgaattgaaagcagtcctaaaagatttaactgattactagaaacttgcatagatcctctaagaccaaggcatgtaaaactacatttttccatttatttactgtcattatgactataaaacagatactaccatgtatacatttcatctttatttcagaaattacagcattgcttgtaacatatctgtcagacagccagaacaaaccagggaaacagaaaccatttaaacctgtggaaatctaaagctgaaactagtaattcttttaatgagggagactgagaagccaaacagagaacagggaagcaattcagaaattagcaatagcagaaagctgctcctaccactaggctatagtgaaaagggggaaggcagggttaatggagcccagggattaaagtcacttgacagacactggaacccagtgggcctgtccattggtatctggagccagggaagagatacatcttctgctggagaggccacaaaagtatagagcataggggagaaataccttcccttctccctccagtccaccctctagtgttcctgtcttgcttcctattggctgtcacgttcctaggctatacaggccacaggagtctgccttcctgcaacacagagcagagaagaaaaagtgagagatggatctgaaggcaaacagacccaggacacacaaagcacacacaccttgtgtattgggtggtaaaaggtgggataataatacagttgactagatctataacagactgaaaagctagtagttgttgagtcagggacaacgaaggctggctgatggcctcagtcaacttggagacaatctccaagtgctaaggggtctgttattcaggttgtaaggatatagccaacctaactgagcagcagatcatatatttagcaaaactgatcttatgaccttaggttacattaaaaccctggatatttgtgctgcttagataatatctagaatatagattgtgttacatatcctttttaaagaacgtggcaaaactaaactataaccaaagactactatctggaaatgggtctgaagactgtatcttgtgagatatagttaaaggaggtaggcatgttttacttagggttgaaaagactagatggagtcttcccagttatattcaaatatcagaagggttacctgcaataattgctaacactaattgagtgtttactacgttctagacatctaactaattatttaacacccttgttaaggataagtattgctgtatccatttcctaaacaagaaaactgagggtttaagaggtcatataactagcccttggctaaagcctactcaaactgctcagattctgaactcatgtttttaactacggtgcttaccatatgttgtgttactaaactagacaaataccaatgggtagaagctacaaagaggcacaattttgcttggcatgaagaaaatctttccaatggaagtttaacttgcttattgtataatcatggcaaagactgcttctagaggaagtaggagtttccattcatagatgttttcaggcaaaagttatttagcagtttactaatatcagaagaaaaatattactaaagataacaagggacacttcataatgataaaagagtgagttctaaaggaacacataacaatcctaaatgtgtgtccatttaacagtatagcttcaaaatattaaacaacaattggcagacttaggagaaccagtcaaatccacaattacatttgagatttcaactcatctctattacaactgatagaacaaacaattaagaaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccaccttccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatcagatggttttcacatggttgttaccattattttaatgtgaaattgtttttcacaaagtttgtacctatttatacttccaacaatttaggagaaaaaagttgtatcacacctctgcctttacttcaagactacacttacttcaaaaattgtattgaaatttaatttcttaaaagaatatttcctaccgaatggaagccagtgctcatcccctcttcctctcaccaaatatcaacaggtgactttccacactgcctggtaactgcatatggtattgatatttgtttatttttagctattatctaagaccactggaaggtttgttcttgtgtcttctagtctcttggaatatcatgcctattttacttatttttaaagtttttataaggttgtaatgttttattttaattttaaaatttatttttaactggcaataatgtatatttatggggtacaatatgatgttttgatctatgtatagattatagaaagagtcaatcaagccgggcacagtggctcatgcctgtaatcccagcactttgggaggccaaggcaggtggatcacctgaggtcaggagttcaaaaccaggctgaccaacatggtgaaaccccatctctactgaaaatagaaaaaattagccaggcatggtggcaggtgcctgcaatcccagctactcaggaagctgaggcaggagaattgcttgaacctgggaggtggaggttgcagtgagccgagatcacgctgttgcactccagcctgggtgacgagcgaaactctgtctcaaaaaaaaaaaaaaaaaaaaagaataaatcaaactagttaacatatcacatcaccaagttgtttttttgtggtctttatttttttctcttcttaatctcaaaacagagaatgtaaaaaattcatgcttttagcaaatttgaatacagaatgcattaactgtggtcatcacacatggcaatagatcactaaaacatttcctctactctgagactgagcaacatcttccacatccccagcctctgataaccacctttctactctgtttctatgggatctacttttttagatttcacaaataaatgagatcatacattatctgtctttttgtgcctggcttacttaacttagcataatacccttcagttccatccatgttgtcatgaatgacagattttacttctttctaagggctgtaagtattccattgtgtatatataccacattttctttattcattctctgttgatggacatttagtttggttccacatcttggttattgtgaatcatgctgaaatgaataaaggaatacagatatctcttcaacatactaaattcaattcctttggatatatacccagaagtaggactgctggatcatgtggtcattctatttttagttttttgaggacctctatactattttccaaaatgactatacttagatctcagctttcttgaggcagggagccatatctgtttaattcactcagcatatactgcaaagaagcaggtgtgtgtatgaactgtgtgtgtttgtgtgtatgtatctgcatgtgttagggagaagtgcagaataaatatacccaactctttactatgtatagacattatctaggtctttattttttttctcttcttaatctcaaagaaaacagaggaaaggaggaagtaaaaagtaaatttttgcctgaagatgtttggaaaaaataccaaataaagtgagatagtgggtaatctagtgatttttatttttccgtcctctttctggcctccaattgtgaaataatttatagcactgtaagaaagaagccacaaattgtggtagcttggaccactgttgaggtctggaatcagaattccaatgttcaaatattggtcctaccagttataagctctatgactatgaacaaaacactcaacttctctatcttcagtaaccgtccacaagaattgggaatatcaacaatgccatctttattgcattgtaagaattaaataattcaatatatgtggaaaatagcatgatatcagggatatacaatgtgtttacaaatgataaccattattacttaatattgatagtgataattttattcatttcacatggcatgaagtaccaagctctataggaatcagaaaataaagtcttatttctttttcttctctattgtccagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtaagagctgcccccacttcctaggtctatcagttagggttcagacaagaaacagatggcatactcgagtgatttgaggagagtgtaataaagggactgtttacaaaggtgtgatcaccatttggagaaactacaaaggatagtgcagaacactggggcttcaatgttgggagggcaattaccactgttggagaagttactggaatcagaagggagctgtagggaaagccccacttcccaggagctgtagccacagaatagggaagctgccacatgcagcgactccaaagggtggaaactggatgaatgaataccccaactcattctcctcccaccctccaatctcctgctagcacctcccattggctgaacccagctagaagtcagagaatacaagggtccactgttgtattccataaaagtcaacttctcagggctcagagcaatattgacatgtacagaatagatctggagaggaaacagaaaatatctagtacaatagctaatcactgtgattcatgcacagtgtcatgagccagcaggatgaatattcctttgctgtacttgctgccagtcagctggttatgggtttttccaagaaatttggtctctaacaaaattcttcagagcctttactgactatgctggatatttttggaagggatcccatacttttgaacttcatacagcagaatttcaaacaatcttgggaaaataacaacttttatctgcccagtaaggacaactaacacctagtatcataatcatttcgtaagagacaggtaatttcatcaccgagtgcatatgttttctaatgctcttatatcaaattaccacaagcttcacagtttaagacaacacagatttattatctgatacttatggaggtcagaaagccagacttgagtttcactgggctcaaatcaaggtgtcagcaggattgcagaggccctaagggaagattccactttcctgtcttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagatgggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggggagagccataattttatttatcctactgagaagggatatactctcagactaaaggacagtccctagtactgattcaatctggctttatagaaaattcactatattgtcattgtatttcacagtttgccctttgtcttagctggtaagacagagcctatgataaggacttgtgtggcatgcaggtatttaattggcaaccccagagggcagaagcaagagatttaggagtttaagagagggtaatataagagtatattatcaaagttgtagtgtggacaacagaaactcaaatattcaaggaccagcatgtagacagcctcctaagatgtctactcagacaaagaatttcaggtggaaggacttgttcatctgcttcacgcccattggttgacaggaatatgaactccattctgctgctgggctagacatgcatgtgggctgagtgagctttccccagtatccgtagcatcagaaaagtcgcagggcagaaagaaaagtatccaatttgaggtgaattactgaccttgaagtgagtgtaagcctaactagaattctaccccagctggctgaagtgaaaggtgaggctgagaggaaataaggcaggactgcacagtccccaattgtactgttcaaatccactcatgcccttcattaagtcagctctgccactgagccttccagctgggaggcagccacaatctctgcagaagatttaatatacaccagtttgtggaacaagctgtagttcctgctgctgctgtggatcccaagccacagttgatatttgttgtctcactcatccaccatacattccagatttccctcacctaacaccccagatggaatggtttctttgcctgatagggtgacccagacttaacgaccctaagagatctgagcttttgatcagcatgcccttaacagactggggttgttgcaaatatcttttcattatcactggatatggaagtaaaaagaaccagtgaatcagcggacccctgagttccagacatactcttccttgtctccattatgtagcagtgttcaagattttcatgataatcaagattgatttctccaccagtatggtaatttttttctttgctcactggtctgccaatattaagagctcaaggtggccaggccagtagcagagctttagatgcagtagaacaagcagagtatcccctgctagaattccccgtaggaagccagacctttgattcagcagagcctaaatgtgtggggttgagtgaacttctatacgtgagtcattagaagtaatggtgagaggggccaacctgcagcactgggatagccctggtacagacgtagaacatgcttgaggaggttgtcaggaggaaatgagttagaccttgcacagaactaccaccatcaagtacagttggggtgaggcagacatggtatgagttgaggcatcagagatatctgatgctttatgccaaattaaaattaattttttcatggagtgacactgatccacagaccagactccaagaactttgcagtgactaaatacccatctcatcataactttcctggtattttcttctggaaaaaattcttccctgatacagttttcagaggcagctagatgcactgtcatctctccccttttcccacttccctacctatccacaatttactacccaatgccaacactaaagttagcccaacttccttctaactaaattattagtttagaaggaaagagaggagtcatgctaaggatcttaactgaaatcaaaacattagaggctgggcatggtggttcttgtctgtaatcccagcactttgggaggccaaggcaggaggatcacttgagcccagtagattgaggttacagtgagctacaattgtgccattgtactccactccagcctgggcaaccgagtgagactctgtctccaaaaaagaaaaggaaaggggagaggaggggagaggaggtagggaggggaaagaaagaaactagaaatccatcaattttaggaccaacttcaggtaaaaaaatgaattaggcaagttggtctttcaacattctctacctctctttatatcatggttgagaccacagacttctcacctcatgaaagatgaactctaactaattcatactaaagctaaagcctctaaagaggattaaatatgagcaatcccacgagaacttttttcccctggaattgtttattcaactgtcgttcgttatatggaatttcctgcctggttaagtgtaggccagtactttggatgaattgtagttttctagaaagacgcttcttatataagaacctctccagggaaacaggggcctgtatgagatgaattgagaaataactttacaccactgattatgtcagtgttctattctgcatggtagagatgtgaaagggcagactgaccattgctctggaagcctttacgctgtgagaagttaacagtggagtaaaatggccactccactctcttcatggaagccaacatggcttactaaatagtcaacaaccatgggagagacctgtggggtcttcatcagagctcaggatctcctagggtatcactcataaatacagccatcagggagatggagaaatctttgtgcagccagaaattctcaacctggttttacccatccttcccaactttgtattcgtcctactgtttactgacatggatcctctgcttcattaaccatcccttcctcaccacatgctctctgaacttggctgcaccttttctacctccatgccttctttgctcaggtttttccacataaatatcattatttccctctctactagctccaagcccaccctctctctggggcagctcagtcactccagggcacaagggggtctttccctcatcccacattttgagacctactacctggaccatttgtttgccttgtaactatgcttgcctttttaattgctattttattttccatgtattttcattgttcacacaagtcttctttattccacactaaggcaaaagcagagtcctgtgttcataataagtgctcaacaaatgttgggttgattgggttggagattccatcttagataatcgcagtcccatcatgccagctaccagactgtgtggacagccaggtcagagcagccaaatgatattctagcttgtggcacaaataccagcaacaaaataaccaaagtcacacatctgcctctgagttcctggcttctatttctcaagggcatttttaagttgtcttatgactgttccctttctactcattctcataaattgagctgtggactgctgtgacccacaagcttctccggaagtcaatgtataaaacaaacacggaaacgaagagtatggtgggtggagggtactccactgactctagaatggatgactgaacattccaaatttcaagcacaagttagggagcaacagatcattttccttttgaaatagggtttcttctgctcagccagttgttgtattttcattaggaaatggaatgggactacagcacaaaaaataaatataaaaggacccttgtagggctggcagaaaagagaatccttcctaggagacctggaggtgattccaggcagtggttgagagcatgggctctgatgtcagacaggcttaaatttcaaactctctctctattagctttgagaacctaaatatcctacttagccactctagcactcagtctctcatgtgtagcatgagggtgagtagtggtagacagtttatagggttatagtgaggattaaatgaaatgtgcttataaagtgcttagtactcagaaagtgtgcaaacagtaaaaaaaaatggtatatctagcaagttgcatgccttacttgtgagttcatgaagttgtggcaaggataagacaaatattttttgccattgcatcattatatcattgctaagagtatgccattattggccaggtgcggtggctcatgcctgtaatcctagcactttgggaggctgagatgggtggattgcttgaggccaggagttcaaaaatcagcctggctaacatggtgaaaccccgtctctactaaaaatacaaaaaattagccaggcatggtggcaggtgcctgtaatcccagctactcaagaggccgaggcaggagaatcacttgaacccaggaggcggaggttgcagtgagccaagatcatgccactgcactccagcctgggcaacaagagggaaactccttctcaaataaataaattaattaattaaattaaagaaacgacaaaagagtatgcaagaattttaaaacaacttagaggaatatgtatgaggatacaggctaagctaccataatgaagagacctcgaaatacagtgagaagcgagacagaagtatctttcgttccatgtaacactcaggtggttcagagcagctaagcagctatgttccatagagtcattcagtgatccagattattttcatctgttgctctgccattctccaggatgttgtccctataaaattgtcaaagctcagtcagtgccaaacccatgtttcaaccttcagaaagtaaacgagtggtggaaaacacattcaatgttttaaggccaagaccttgaaaactcactctcttagcctgaacttagattacatggctgggcccacttaactataggggaggcttggaaacatagtctctgagaagccatgtgtccagctaattccctaatactaaagttgaaagaaagaatggattaaccagcagtataccacaaggtaacaaatgactaggaggatcaggctaggtggactagaaaagagacagtcaattcagtgcaacaattccatattgacacttttcatgtagctgttgcttggctctatctagagaggactcagaggtagtttagataaggcctttgccctccaaatacagtctaagcagactgatttcctactggatgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtgggggctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgagtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatagatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatccccttctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgttttgttcttatgtctgaaagagtttgtcttattctttgagccaagagctttcatcagcctcatgagagtgatgttattttggcaatgcagagagctacgtgctccgattttgctggtgggaggttgccaggatcctttctgaggattccttccattttcacccctcttttccccagtctggatatgacctgggttaaacccaccccctctcccaggaatctcaacctcacggttgggtaaggaaaggagaaaggtttgtgaggccatttggggataaggaaacagctggttggtggtgcattaacgtctttcagcagctcccttcgagtttctccttagcctgttgtattcttaccaacacactcctgttctgttgtaccagctgggacagagcatgctgaagcctttcagccctgatttcattgcttcattgttcatgtgtctgtctttggtttcctgggtggagcctgcccacaaaacccccagaatgtatgcaggcctagctggtgctttcctaaacggctcccttgtctgcactcaatgaacttctccaaagatctatacatggcctcatctatagaaagagaaatgacatgtggaaataattcagtaggagtttgcagcagcactatctgaggactaggggaattttaagtggttgttatcttacatttatactcataacttctatattttcatctgccataaaatattgtcatgttctatttgtccattgccctatgtgtgtatgtattcacttgggtgctgaccacaatatttctaactgtagaatgcaaggaattgttgccaaaagaaaaagacagagggagggaagaagatggccaggggagtgagggagaaagagaaaacaggagatggagaagaagaaagatagaaagaaaaataaatgtgggagggaagggagcttcatggtaaaggaggaggtatgtccaacagaacttcgacttttaaatagaaccacttcagagagttgtgtcaggtgcacctcagttgtcttatcttctgccattcttcttttacctctcacacccatacctcagggttcaaggcctggggcctgaggactccttaataacttcagaaatgagcagctgagtgttccgttccagctgtctttgggagaatggaatggagtcacactcaaagatagagtggaaataaatcctctcctcatccttcaccccaatcttaagagtgagtgaggatatcagtagctccgagctgggaggtaaagctcaagttctaactgtgattaggagacctttcttacaaataagaattaagtgaataaatgtgcaaacaatttcttttatatttttaatgaaccagagagaaatcatggttgcctatataacccttgtctccaactcacttgcattcagatctgctttcttacatgtgtctgccatgcacacaaacttgtgtgccatggaaaagggttgagaactgctggtgatgcagacagagctttaaaccagggtcagagggctaggctgggaccttgtgctgccatttgttggctttctgaccttgtacaaattgcctatcttctttgagatggtctttctatctgtaaaaggggaagcagcaagagaaggaacattttacagcttattggccgaacttcactgccgctagtgtggttcaacttggactacagagaaatcttcctaactggtttccctgtattcactcctgctacctccaacttggtctgttctcactttttgctataataggcttttaaaaatcataaatctaccatgtgtcctctgtccagaccttctccatggcttcttattgctcactggatgaagttccaacgagcccaggatggtttgactcatgtctccagctttaactgcatcaccatcaccttcattgtctaaagctctaaccacacaggattttctagtcctcagaggcatggcagtctttcaattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccacatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggtcccaaagcaggacccctatgggttgatgaggtaggaggaggtccctgccttagccacagctgcacacagccagcctcttcccttctaggccctcatgttgagcctgggacgccagtcctaacttccttctcttcagttcctcttagggccattggtatcctgaatttcttagtccattgcaaagttaagtaaagaagcagcaggcttggtccctttccttccagatggcttcttagctcctgaacagatttacccacctatacctcagtgactagctctgtgtactaaagtgtattgggagggcagccattattggtccataaaaggtcctgcttaccattttcccctaagaggaaccattcaacagtttggggctcgagggtgacctgctgggctctagagaagaagctggcaacttctgttgcaaaataatgttaaattctgcttcatctgcttgtctttacgtttcaagaatacagtaactgtgtttctctgattcaccaatatatgcccagtgtctaaaaaattacctggcatataataaatgttcaatgaaattttaaacattgaacctactatatgcaggtgagtatgctagatctgctctgtccaatataatagccatctgtggctctttttaagttaaataaaaattcatcagtcacatcttaagtattcacacactgtaagtgctcaatagccatgtacagataattgctcctgtattggacagtacagatatacaacatttccatcattgcagaaagttctactgaaaaccactgtgctagaccctttacaaacttctcatttaatttcacaaaaattgcttgtggcaaggagaagtgtctttatgctggagttaagaaagtgaggctcagaaaagttatatgacttcccaaagtcatacagctgggatttgaatacaggtctgtttgactccaaaacttgtggcctatttgttgcaaaagtgcttaatacaaattggttcagtcaatattattatctttgaacaatggaaggagaaagtaagtttcaatccaaaataattgagtgacttatacattgacttgctgagccaatggcaaagtcaagttagaatccagcagaagtcaccagctacagaatctagatctttagaacatgtcttcagatcttcagaacagtgtttcttaaactctcttgtgaaggaacagttatcatcataggctggtaacagttcacctaccagcaccagcccatgaaccagactctaagtggcacagccctagaagattgagccagaattttacagaggtttaaagaccaaatatgctggtttatggttacctgtggcccacagagaatggcagcactaacctcaggcataaatgaggtacccactgaagccaacattcaagagcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttcaggaacccaggcaatggcaggagttgggcattaaatcctaaaagagaatcagagtgggagggaatatgtgaaatcagaggttaagaaaaaagtgaaaacctattcatgattgcaaagatatgaaaccaacctaagatcccattgacgaataagtggataaagaaaatgtggtatatatacaccatggaatactactcagccatgaaaaagaatgagataatgtgttttgcaacaacttggatggaactggaggtcattattccaagtgaagtaactcaggaatggaaaaccaaataccatatattctcacttgtaagtgggagctaagctatggatatgcaaaggcatacagagtggtataatgggcatgggagactcagaaggagagagtagggagtggcagtgaggaataaaaaagctgcatattgagttcaatgtacactatttgggtgacgggtgcactaaaattcagacttcaccagtatacaattcatccatgtaaccaaaaaccacctgtacccctaaacctattgatataaaaaaaaattaaaagaaagatgtgaaatcaaggaaacttactggtgagcagcatcccattatgtgaacttgtgcttctgaaccagtaacttgagttactttgagccagtatcagtcacttataccttagtgcaaaattaattgatcagacattctgacctggaccagggaaggcaggcagaagtagcagtcaagactaaagcagaaaagggagagctaattctgcagccagacatttcctggattgaatacccaaattagtccctcagcctttaagtgcctgagggccaggagtagacagaggaatggaaagtgtgagacttctttgttcacactctttgcctaggggccagattttgctttatgcattaccatccgaagtcccaggccacagtgaacatttgggcttcgctatgtggatttatttagatttactttttgtcctgccatattttaatctataagccaaacagttttctcattaatcttattccatttctggaatttttccttttcagacacaacaaaaagacctgtcaccacaacaaagagggaagtgaacagtgctgtgagtaagcatgatttttacttttctttcttactttcttttctctctcagcttgaattttaaagtaaccactgttctattaattcatggaaggcaactgaatagttccagcttatagaatcttcctgtttggtagcatttcagcgaagcctcgttcttagccccagaacaatcatgccatcttttgctcggtctatattcctaagcactcctagatgatactgcactggacctctggtctcacatagttagaaacagagttaaaatcgaacagcaaagagaagatattcaactgcgatgcaattgacaatggatgtttttgcaacaaacaatgattaagaagtacattgttgtgggctctgagtcaagagtaatatgggaaaaacacaagtctcttcatgaggttgacaggtttggagctggaatctgtggaggaggaaggatatgatctaggggtcagaagaagtgggttactaaaatcattaagcctggttggatgaaaagcttagactcaggggaagcagcacatgattgtgggggctggcaagtttgaaatgtgtagggcaggccagcagtctggaaacccaggcaggatttctaccttacagtcttgaggcagaattccatcttttctgggaaacctcagttttttgctcttaaggccctcaactgattgaatgaagccaacctacatcatgggagataatcagctttacttcaagttaactgatagcaaatgataattacatctacaaaatactttcacagcaacatatagactagcatttgactaagcaactgagcaccatagccaagatgacacataaaattaatcatcacaggcaccaagagatgaggggggcagtcttggccatatatttggctgaagtaagtcaatttgtcattcctgcatgagcctttataaacagaagtaagtaaccaactactatttggtcattggagttgtccaagaggccagggttctgtctaatacctgttcatgcatgaacatgccaacctagattgcatgcagactaccagttttgggtttttgtttagttcagcaggatttttctcagctcactgcctctcaaactttcagcaacaaaaggacatctgtgatatcagaatctaccactctaagtatttggatgcaatagcaatgaatatctgagtaaatctaggtggggagtgggggcaccctgtagccaaaatgatttaacaaaatcaaaccaaaattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcaacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaagaaaaacatgaagaggttaactaacttgcccaaggtatatagctaataatataagggccaataaattgattcagcaatccaggtgtccaagtccagaatccacacccatacactacactctgcttttttaaaatttaattcaatttttttttagagacagagtcttgctctatcacccaggttggagtgcagtggtatgaccgtggctcactgcagcctcaacttttggactcaagctatcttcccacctcagcctcctgagtagctgggactacaggtgcatgccaccgtacctggattttttatttttattttttgtagaactggggtctcactatgttgcccaggatggtctcaaactcctcggctcaagcaatcctcctgccttggcctcccaaagtgctgggattccaggcgtaagccactgtgcccagcctacatacacaacactctcttgcttaatctgtaagactctctcccccactcatacctttttatttttcctctgcattgtacacacaatctataccactcttaagcacatgattacagcgttattttctggctgcttctatgtgtctatattttaggtccacctggtcaatataataaagtgggatattagtgttaatgcaactatatggtatttgatatttgtctttctgtccgtttatcaatgtttcttatagtttattatataataaatttaaaaggtgtctgattttgaccaaatttgactaaatactaaaaaacaatattaaaataaattttgtttaattttagttgagtctatcaactcaaaaaagaataacctacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtagttaagtgtggtcatgtaactcgctttggtcaattaaatgtaagcataagtgatgcgtgttatttctgggtagaagatgtaagagttggcatatgctttgccatattttctttatccatctggcatggtaaccagtaacattctaggtagtaattgctccatcagtctcagtctctgagtgactaaaattgacagagtcccctgctgaccctcaatgtacatggaacatgaacaagaataagcttttgttttttatattgagattttggagttgtttgttcctacagcattacctagtttactctaatacaacatggaaaaaactggaacctataataaatagaccctacgttgccatttaaacttctagttctgaggaataataatgtggggaaatactttctatataataaaaaaatagaaaattgcaaaataaaaatatacttatgtatcattcatgtcctattaaaaatgttatttatagactcaccatattcccttcctccagaaaaatagaagtaaaaatatgaaaatgcctgtaatcatgtttttggattatggaatcaagtattgctttttacttttatgttttctgaatttttgttgtacttcactacatttttgagtgccctgatgtattactttcaaaaagaagaagaatactttctgaagccatttcaaccatccccactcacctctctagatcccagtaaccaaatacattatataggactcttcatcagtccttatcaagtttaggaagggcgatgctataccttctttaaaggacacctaccaatgtcttagttgcctttcaaagactcctagcacagctaaatgtgatggatatgctctaaggatataagagctgaagtgacttgcataaggtcatatcataacttactgttagaaatggagctagaactcagacccactgagtccttgtctgtgacacactgccctttccatttgtggaagttgttcttgtatctaactttatctgtgctactatttgggcctagccattctccctcttatgcagacaagcagataaacagtaaaactttaggagtggattatgataccatagatatatatcatctatcctttacaaaatagttattacagtcatcaagccttggttagagtttacagaccatgtatcctagctacctcatttcacagattatgacattgggggctaagagatattaagtgacttccttaagtgaaacagtagcagaccaaaagaagtcatgattcccagcatagtgctactcactcatttattcattcattcacccactcacaaacctgtattaagtttctgttatttgcaagaccctgtcagttaggccatgtgggaactagaaggatgaatttatcagtcatccaagattcttacaattaagtattaccgataaggtactcaagaaacagttctcattcacataatttgggttaaaacaaaaagaagccagctttctatatacttttggtccagtctttacgttttttgttttgttttgtttgttttcatgagtatcccgacttccttctaagaacttccacctgagaactgaccacagcgtcagcattccacatgggtgtgtttcctttcccctttcccatttcagtggtttccaatttctttttcttttggcactataaacctttcgcaaaggaaatattagacagaactcctacatgtcaagcaaattaaaatagtggtgaaattagagtggaggacataatcaccctatcatataggctatttgtccatatcatatttgtccctacaaaggcctctaaggcaggggtccccaacctctgggccgcagaccggtaccagtggcctgttaggaactgagccacacagcaggaggtgagcgggagacaagcgggcactactacctgagctctacctcctgtgagatcagcagcagcattagattctcatagaagcgtgaatcctattgtgaactgcacatatgagggatctaggttgtgtgctccttatgaaaatctaatgtctgacgatctgaggtggaacaggttcatcctgaaactatagcctacccccactcccacacccaatccatggaaaaattgtcttccctgaaaccagtccctggtgccaaaaatgttggggaccactgctctaagataccttgtgcttcttggaacatatttggaaaatcatgtagctctcaaattatccctatgtcctgaagcccaccttaccatcaatcctcagaaatacccaacccatgtcaggcaacttcacactttctttcttcaggcagcacagttgtctcagggagggaggagagtgctattagcaagaggagtcactaacagcttcactcacctgtgcccatgaatttttaatggtgtgaaaagtctgtgtattttttatggttctctatggctcatataagagggacaaacaatacatgaaagttcagagatggggacaaatatcactttaagctggggataatcagggaagaagaaagttttcatggagaaggtgacttttgaatcaggaagaaatggaaacagcaaactcttctagatagaggagacactaacaggaaaggcagagaggcaggaaggtgtgggaaagtgcacgtgaccccgttcagagagaaagccaggtgtgagataagggggaaagactgttagggcatgtattgtaaaccactaattccaggcaaaagttagattttacttactaagcaagagtgcttcagttagatcctagcaggaaatggagggtatgcttagaagaggtaactgaggcaagtttaatttataaaggtgtgtgcagcattaagggaaaccagcaagggatactgagcatgccaggatgcaagagcaggcagggaaggtgactattcctaggtctgaaggagaaaggggagggagcagttcccagaaccctagtaaaaatggcaatgagaaaggtccatctggcaggacctatggtctttaacagagggacaaagtcaacccacaacttgtctgggaggttgctgaggaatagataccccaacctctctctcaacccactgcaacactctttttcccctagactgagcccagtcaaagacagagggaggagcccagtgatgcagtctgcaatgtcatcatcctggagcatgaatagagtgcagcagggtgaataatgagtctgcaggaattaatagaaatatctgacacaatagggaactataagaggttttgaataggagaggcccctgaaatgtgctccaatattactgaactatgtgtggcccaaagaatggaagaggaacagctcttgcaataggtctgaggagagaagctgaagacttggactagggcaatggtaaaaactgtggaaagaagttttaaatgaaaagttttaaaccatgcggcttccagctagatgaacttttttaaaaaaattagttcctcactcaaattttggggaggttatatattttctaatcataaaaaatgatttttcttatttgtgggcttttctccccagatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggtaagaggtttgctcagggtcttgcaagtcagtaagtttaatatcctattacgccatttggctcccaaagatttgaaggcctttgaggcaaacttggatgtacttttcagcagggttgggtcctagggatgcttgatctggggctcctgctggaggaggagcacttcctaacaccacagagagcagggcaggagacaaggccttcttccctggaagaagcccacctatgctgcccctacccccacccatgccccagatatgtgattggcatgttgaatgcttggggagttttgtttaactctgttaggaacccagtggcataatggcttctgtcaaaatattcccatctttgttcctagattggggctatcttttagattaccaaatagggagagagcaatctagctgtagtatcctgaaatctgggttctgtcaggggagaaaatcataaggcaatgtgtcttagcttcagaaattttctatactacagcatgctatcttaacacctaacatttatcaagtacttgctattgcccaatattgttaagcattttacacatactattggaacaaatcatccccaaactctctgaaaaagacactattaattactccattttacagataaggaaaggcacagagaggttaagtaatttggttaaggctgcttgttcagtttgaaagggatggaattagagcaacaaacctatattttttgttacacaccataatgtgccctgatttcctaccacatggggtttaaagtggtatttttatactgtgtggtctctttgctggtcaataatta

SEQ ID NO: 14026 - DNA, 56665 bp, Human
agtgcagaagtactgtatatggaatgaaatgggagagtctccctgtaccacctctcttgtgtagctcctttctccttaagctggagatttggcacaaatccttccagtagattttgtttacatttacatgcagtggatatattgagcggtggctcatacctgtaatcctagcactttgggaggccgaggcagaaggattgcctgagcccaagagtttgagaccagcctagacaacatggtgagaccctgtttctacaaaaaaattttttcaagtaaaaatataaataaataaagcttaaaaatatataaatagaactgataaaaaatttataagtaagtaaataaatgtggagagggctgcttgcgctttctggagtaaggatgctaggtaaatggagcatgtgagattgattttgcatctcctttccttcagcaggatttaataaatcatcaagtgctaggaaccatgcctgggagctgggagtatggagttgatgaagaataggctaatgtggttgggaaaagtataaataaattttactgtataaaaataaattttgtagaagaatgtatatgaagtgtcggggggacatagaggagaaagaatttgcatccttatttttaagttaacatttttatttcatagtatttcctaatctttctattaaactttaatacctgacttcatcctgaatcatcagccttatttccagtttgtatctgcatctttagttaggctggtctcaggttgctcataggtcctttatcttctatatttggttaatgatggacagtttataaagtactttaacatatatgaatttatttgggtcttacaggacctgtggagatgtcagggaaagattcattatctttaccttggagacacttggtggtggtcatcgtactgataagatggcatagctttatcatggaacagtctggagtataaccaccaggaggtcctgacctctgtgttgctctggtgtcattgttcctgtggacaaatgagctgttacctccaaaatgccttgtcacagtagttggaggcagcatatgaaacacctagttcccagaatcataatctaataccgtgtctggccccaaagttataaatgggctttgccttaagtcttatcttttgttcttcttggtttataatgtttctaattattggagatgttgagaagatccaataaagcaaaggatattaaaaaaaaaaaaaaaaaaggaaatgccacccgagagaggctaggaaacttggttaagatcactggctagtgaaaggtaaagtctcaggtcttacttctttccactccttctgttatctacctccggtgagacttagcaaggtacttagttgatgttcagaaacttaattgatattcctattcatggtatatttcttctgatagaataacggtagagtatcctgactgctatgatgtaggaggctgtgtcaaatgaataatttttgtttagtttctcagaattgcttagacatgtctgcctcttgtcatattccatagcccttcattgatactatgaatactaatatcattgatactattgatactaatatccattctaatataaaccttattttgtaggattctgggtaatttgattttccagaaactccctctggattttaacctctctgataagaaccattttccttacagtgtcttcaaataattctcaataaatacttgtggaatgaataagtgaatgaatcttagataaagtaagcatggttatgtattctatcttgtcatatatacaacagtattatgtatattataagctaaaccacaaaaagaaatgttttttcattttttaatgccaaacaaggtaaatctcattatgttttaaaattgtctccaataaatatgaaaaccttaataatttaactagagatatctatgctttatgtgtggcctatcctgaaccccttggagaaagactttatacagaaactaagatttttttggaaaatcatgttcggcatttgcataaggtaagcaatgatacatacgtgatataaatatgttgatagttgtatactttactagtttactgttttccagtgtagaacttttatcaaggtcagcttgttttgctgctgctgctgctttttttaaatacagggtcttgctctgttgcccaggctagggtgcagtggcgcgatcatggctcactgcagccccgacttccctggcttacgtgatcctcccacctcagcctcccgagtagctaggaatacagacacacaccaccacacctggcaattttttttttttttttttggtagagatgggggtctcactatattgcctaggctggtctcaaactcctgggctccagtgatcctccggccttggcctcccttgtttttgcttcttaatcagcattttaaaaatatatacatattaagatctttgagtcaagcactgtgttagggaaatcagtttacttgctcagcatctcgtaattagtaaatgaaggagagggtcagctcagggtttgttgagttttaaaatgtgctcctacgtcctctggatagtgtttatacagccaaattttccctcgttttttattcctatctcttggtaaatctctgtctttattattttcagctttttagctgcctttcatgtgctatatgaagtcttcccaaaatctaaaattaaaaagaaatggtaaatggtgatagaagctgtctctgtgaccagtttttttattagtatgctgtacatagaggggcagcatcacagacatgatctgtgtataaacagtgaattttgcagtattttgctatagacagcatttccaacttaatttagactactgatctaatcaggaactggatgagataatttagtgcctgcgtaagaatcttcactctgctttttattagctgttgtaaccacgggcaactcacttaacaactaccttatggactgagttttgactttatctataaaatgggaataaaacaacacagttttatttaaactgtctaaccctgcacgtggtcaggagtagatacttttttaaatggtaagaactggcctggtgcggtggcttacacctgtaatctctgtactttgggaggctgaggcaggaggatcatatgaggccaggagttcaagagcagcctgggcaatatagtgagacactacctgtaccaaaaaaaaaaaaaaaaaaccctcataagtaaggcacaattgattgtgtgctgtttccctgaaaatattggaaaatgctctacttttgatagtatatggcatgtgcattttagtgttctaatgtgatcatttatctgcttataaaagtgcttttgatagcaagtgtgttaaagtggtcttaaagtgtttagtatgttaaagttctgctattgtaagctagtgagctttggttaacaccataagtgataactatgtaagacattaataatttttttgcaattttatattttaggttacattataagtgtgatttttttttttttttttgggagacagagtcttgctctgtcacccagcctggagtgcagtggtggggtctcggtgcgatcgggttcaagtgattctcctgcctcaacttcccaagtagctggaacttacaggcatgtgccaccacggctggctaatttttttttatttagtagagacggggtttcaccatgttggtcaggctggtcttgaactcctgacctcaggtgatccacccgccttggcctcccaaagtgctggaattacaggcgtgagccactgcgctcggctcagtttattctctattatggatgcttcactttcattttgaagactcacatctttcccagttgtttcatttttaatacgtgtagttaatatgtgttgtgtaaatgtaatttgtacagctagaattatgtaaattattttagaacattaattttgatacattttattgttgacagtgaaaatgattattgcttttcaagtaaaaatatttttcctctttatatagagagttttggagtcagaagaacaagtacttgttatgtatcataggtactgggaagaatacagcaagggtgcagactatatggactgcttatataggtgagtgtgcctttaaaatctagacaagctaagcagcgttgcctgcattcagtagttgacaggataatttttttattgcctatttctcattcacatatgcaaaactaaagcattctctctgacatggacttttctctgctgtggggaaaggtctatagtcagggtaaggtgggtatttaggagccagggagtgtgtggaacgttctgtgaaaagtaaaactgtactcgattgcatggctctgtttcttctgattgtttacaacctgtagcacatgtttaatctcaacagagatcaatgtgaaaattcaacttgcatgaaacttagtgggaaaatctcagctcatgtcccctcgatatgttcttatttgactctagcattcagtattttatgtttgatgcaaacgatgttagataaattactgggttattttccccttgaagttctgcattccccatggtctaggcatattgaattacttgtagtttcctaatggcccatggtctctcccatcttcctgcctttcctggtgctgttccatctgcctggattgcttctctttctttttctatttttctttcttttattttgtccttttttttattttttattttttgaggcaggatctcacctaggctgcagtgtagttgcatgatctcagctcactgcagcctcagcctcctgggccctagcaatcctcccacctcgaacacccttctccccagttgctggaacaacaggtgtgcaccgccatgcctggctaatgttgttcattttttgtagagatgctgtctcactatgttgcccaggatggtcttgaactcctgagcttaagcagtcctccctcctcagtctcccaaagtgctgggattacaggcatgagccactgtgcccggctaaattagtactattaaattggtgctatttgtgaacttttagtaaatgttgcagcctatttaatatgtgtttgtgtatgtgtgtgtaaaatgatatgagttagttagtatctctgttttttacagaggaagaaagcaatgctgagagcatgattttgttgaaggtcactcagctaatgaatcacaaaggcaggatttaaacccagatcagtctgaatccaaagcccatccatttaaccacttcattctaccataatcttgttccagaaacatggtatttcacttaagtagattctattctcaatcttcttgtacaggcatactttggagatgatgtgggttcagttccagaccaccacatgtaaagggaatattgcagtaagacaagtcacacaagttgtttggtttcccagtgcatataagttatgtttatgctatactgtagtctgttaagtgtgcagtagcattgtctaaaaaaatgtgcacaacttaatttaaaattactttattgctaaaaaaaatgctgttgatcatttgagccttcagcaagttgtaatccttttgccagtcttcttacctcggtgttgatggctgctgactgatcatggtggtggttgctgaaggttggggaggctgtggcaatgtcttaaaataagacaacaatgaagttagctgcatcagttgactctttcttcacaaaagatttctctctagggtgcaatgctgttggatagcattttacctgcagtagaaattcttacgaaattggagtcagtcctctcaaaccctgccaccaccttatcagctaggcttatgtaatatttgaatcctttgttgtcatttcaacaatgttcataccgtcttattaggagtagattctgtctcaagaaaccactttctcatccataagaagcaactccttatccattcaagttatatcatgagattgcagcaattcagtcccatcttcaggatccacttctgagttctcttgatgtttccaccacacctccagtcacttcctcccctgaagtcttgaccccctaactcatccatgagggttggaagtgttaactgaattgagtgactgaggcagctgtctcaatcaaggtttattgagctagcttaaggatgctcccaggaaaaacgcaaggcacagatgcatctgtggctgttttgtccaaagaggttcttaggagggttagtgtttatacattttccttaaaacatgaggggtggtggcagtgaggcaaatggttacctacttgtgagactaattaatgcccagtaaatctacattttatataagataaacctttgaagcaaaaggaaatagaagaagaaaacagttgtgcagacatctcagggaaggaatgattactctcatcttgcctttgctctgtgcctgggaattatcagctaagaatcgacacttatcaggtggatgctagcagaccttaggttttaggaactagactttagactacagatctggagttacaatggacctgtccttgtgttatgggaggatttacattttaatggtttcgaggctagcaaagaatttacgaatgagtgactttttgaggcgggttagtcatcaggaaatggctgaggctttttgccttaccacgggggtctggctaatatataatgtttcgacacaaacttgtaagagttattcgtccaggaagaggatggccatttagcatgactcagcctccaaggttaaattcctgttttggcataggagttttgggaatcctgagattttatttccctttatagaatcagcatcttctaatcacctgttcataatgatatttagaccttctcccatgaatcataaatgttctttttttaaaaattttattactaatttttgggaccgagtctcgctgtttccccggctggagtgcagtggcacaatcttggctcactgcagcatccgcctcccagattcaagtgattctccttcctcagcctcctgagtagctgggattactggcacgcgccaccacacctggctaatttttgtatttttttttagtagagatggggtttcaccatgttggccaggatggtctcgaactcctgacctcgagtgatccacctgcctcagcctcccaaagtgctgggattacaggcgtgagccactgcgtccagcccatgtctttattaagaagcaaatatgtggttaataaatttgattgtaaaatactacagtgacttataaaataagaatggtgtccatattaaaatgaaaaatggcactgtttatattttaaattgtgactttattttctttttttcttttttttttttttcagacggagtcttgctccgtcgcccaggctggagtgcagtggcacgatctcggctcactgcaacctccgcctcctgggttcaagtgattctcctgcctcagcctcctgagtagctgggattacaggcaaccaccaccatgcctggctaatttttgtatttttttagtagagacggggtttcaccatgttggccagactggtctcctgacctcaggtgatctgcctgcctcagcctcccaaagtgccaggattacagacatgagccaccgtgcctggccatgactttattttaaaacattgtatttcaagcttaaatttaccaagagtaaaaatctgcaataagaaagacatagttaatgtaagttagtttaaattttattctgtgaggaaaagataatactggtttgtctttgcagatacaaagcatgtaaagctgcactaaatcaatacctggctcaagaatatacatctagatctttggaatggattagtgaatgcaggcctgatctgcagatttagcatctgcttctatgctaggcagtttacacttattatgtaggtaaaggaagctcctgtagaattctgaataggaaagtaacatcctgacagcagaatttttagatgaattaaagatgccagaaactgaagtagagcccagtcataaaagtgttccacataatcggggcagagggtcagcaagtagattggaagtcaaaggaagtagtgagaggaagtgatgcatactttaggaagacaggaagactgactgattaaagcaggcaaaatggaaggatgagataagtgattctgatgttttaggcgaggttactggaatggtcttggtgccagtgaccagaaaagaaaactggtttggagcagattccgtattggaaggcatatgtaaatggtaatatgacaattaagtaccctctactgagggagcaccgctcctgacgaaatcttatatttgtttgtatattgtaccacagagtgagctctgtgtgggcagagaccatatttttgcttttcatctttgtgtttccagtgcctcatgttgacctggcacacgatataccctcagccgatgttgaatgggagtggaagacctctcctgagtttctgtgccagccctgccacttaggagccgattgacctttggcaagctctttaacctctctaggctgcagctttcttatgtataaaatgatcataggagtaccacatacatctgtcttatagtattcagccacataaaatgcttagggctgtgtctgacaggtgatctcaataaatgttagtgattacttttatttcctggtattcatggcttttatgatctggctgcaggctgcttttccaggtttgtgttctactgttagcttttgctatccttgctgtctggaatgttatccatttatttattcagtaattattttttgaggacttgacttttgcctgccactactgtggatgctgtctacaagaggaggttcttgctttgtatactgtacattctagagagaagatgaatgcacaaaaaaagaaaccaataaaagcataggattatttcatatagtagcaattactgtgaagaaagtaaaacagttgtgcgttaaatagttacttgcttagggctgggaagtgaaggctaactcctctggggttcagggcacacctgaaaggtgtgtctgtgctgagactcggatgaaaggggactgactaccctcagaatatctgggatggggcacttaggtggagaggccatcccctctttaccttttacttttgtctctcaatcttattcctctttccttagctggaaggcatggttggaaactcagcatgaaattttgagagttacagtgaggatagagaggaaggaataaatggcattttaaaggggaaaaaaaagagtatgatcttgtaacttatggtcagaggacactaaaatatcaaatggtacatcaaggttgtaagccatggagtctagagccttgactagtgaatatggagatggagcttgtgtaaatggttgtgggtataccactttggagtcaattttctaggagttattattattatttccttaagagacagtctcgctgttacccaggctgctctcaaactgctggcctcaagtgatcctcccgcctcagcctcccaaagcactgggattacaggcgtgagccccgacgcctggccaggaattatgtgtttaattgtttcccaaaattgttgtcttgttttggttgtcttcgtttttaatttgtctgtaaatgctgagtggacccttcattttggtgtagtgaattttgaaaagtgtatatattcatgtatagatttcatgggttgttgcctaaaatacttgtattgtcagtagctatttacactagcagaacctttcaaatgaatagttttaggtggtgactgtttaaaggcattatagtgaaatctggaatcctaaaaactacacagttgaacattacgagtcctttctccatgttttattttattttagatttctgtattcatctcagttattctgagttaatcacatatattagtcttgaaatatattaaacatttttagtataattcattttcctctggtagacaaagtcatcttgtatctgtcaatcttgcccatacttactatctgtaacactgtgttccattttcttacctactgattgtgatcttttttgtttaaaaatgaaaaattgcatttcttcctggtgattagaatataaattagaaagctaacttgacttttatcttttaaccattctctgtttaatttttggaaagtggactttatcttgactttcccaagaagagtctgggaagtagcaaacgagattatagaaattctgaaacttggataagagctgttgggctagaagggtattgtaagggcttgcagagaaaggtgggctgataattttaatttttattatatttctaatctctacataattcatttcttttggatttgttagtaggctattccatggcttatatgtaatcttaaaaatattcttctaaagttgcaagtcatttgctttcctactgactttaacttaatatccattgatattacatttattttccaggtatctcaacacccagtttattaaaaagaataaattaacagaagcggaccttcagtatggctatggtggtgtagatatgaatgaaccacttatggaaataggagaggtaggacattctttaagtgactagcaaacataagtatgtttttatacactgaggtaatttgattgcacatcattttttaaggacactgatttggctagcttaaaatggtcaagatttaaaagatcctaaataaaatgctatagtgatttcctaagaatcctcaggaacgaaaaagatgtgacaactactcttttgataattaaatttataatggatgaatgatagagttaatggttctgcattgtgaaaaaactcagaaacaattataaagtgttgacggccctgtagttaaaaagtgcaggggacaagtacttaaaagacaggctagaggagaggaaacacaaatttatggatacaacaaatttattgtaactttactttaaaagtaattaaattcagagtgaaacaattaaatgggcagtttggtccattcaagttcttgaggtacagtgcaaattaaaatatggaaaattatgctgattgtgaaagaagtattattgtacaagcttgtttattcatttaatacatctttattgagtagccaggcattggggatacaatggtgaacagacagaaggtccctgcacacaaaagcttgtaagttcatgtaagggaagcagatgccaaataggaaattaatgttaacttgtgatttatgttaatgaaggaaataaacaggctaagaggcagcattaggagacatttaaggtagtgtaatcctttccgaaagaaattgatcagtgtctttctttcagtacagtttaaaatacttaataccttttgaccaagtaatcccaagtcctaagcctagtgatccatacttggaaaataataaatattagaaaagagtttaatgtttaaaagtattctttgcaatcattgttaatagggtgcctaatggctgaacagtgtaaaatttcagcatccaacattcagcaataaaaagcatggaagaagaatgtattatatatgatatgattttgttataaaagtaggcaaatggataaattaatagcagaaaattgttcatagaaactttaacaaaggggacattgtttatgaaaaaatttggacacaaaattataggtatatgttgaatacaaatacaattatagggaaaagatgatatagagaaaaagatcaatgagaaataccaaaatattaacagtagttgcttttagttagtagcattgtaagtgaataaatcattcccttatcaccagcactgtcaagcacacttctcttcccagaaaatcactgtaaacaatttagtttgcatcttttctgaactttacctgtgtatttataaatatttacataaacacacacacacacagcagttttgattttatttttcaaactgcgataaaacggcacacataaagttctacagcctatatttcttgcctttttttttgttatttgttactgtctgtctttttacataagtttgttttttgtgaaagcttaatattctgtagagatacagaataattttttaaactatccctttaatttttttttttcttttttttttttgagacggagtctcgctgtgtcacccaggctggagtgcagtggtgtgatcttggctcactgcaagctctgcctcccaggttcacactagtctcctgcctcagcctcccaagtagctgggactacaggcgcctgccaccacacccggctaattttttgtatatttagtagaggcggggtttcaccgtgttagccaggatggtctcgatctcctgaccttgtgatccgcctgcctccgcttctcaaagtgctgggattacaggtatgagccaccgcgccccccaatttttaattttttgttattacaaacaacactgcagtgaacaccactattcatttattcattcattaagtatttttgaacccgtctgtgttatatatgttgaatacaacagtgaacaaaatagagaaaaatcttatgctcatggagttatatttatgtgtatctcttggtacatgagcagaactttttatagactgggtgtcaggaagtggagcctctgtcgaagcacatcctgaagtttcgcagctctgccccattgcctttcagaagggcctttaccagtttgcccttccaccacatgtgtaaaataccagtttttcatgtattgcctccccaacccccattcatgctattaagaaagaaaggcaaaacttgaacagtgttccttgtgggaagacagatgcttaattaccaatggatcagaataaaattaccctagggaaacaatagggaggctagcaacagcctatctggatgtagttagggtggaaaaagagaagagtcaaacaaacaaaaaattggttttcagtactggaataatttatactctatgtggggaaaatatatttgaagtttaaaggcctaaatgtgaaaggcaaagcttgaaaacttggaaggcagagtaggaccacacatatgcctattaccttagggcagagaaggatttcttaaaaaatacccatgataaagaagattggtaaatttgagtatattaaactttaatatatttttaccaaaacacaataaagaaaccgagcagttgatttactgggacagactgtgaaactttcaagggattaatttccacaatatataaaaaactctagcttttattaagaacaagacaaactttaacagactaacgggcaaaattaggaatgggcgtttcacagggaagaacccaaaatggacaataaacattaaagaattcccagcttcattcagtaaaatgagagttaaaaccacaaggagacactattttttgttgttgttgttgttgttttgagacggagtcttgctgtcgcccaggctggagtgcagtggcacgatctcggctcactgcaggctccgcccggccggttcacgccattctcctgcctcagcctcccgagtagctgggactacaggcgcccgccacctcgcccggctaattttttgtatttttagtagagacgggatttcactatgttagccaggatggtctccatctcctgaccttgtgatccgcccgcctcggcctcccaaagtgctgggattacaggcgtgagccaccgcgcctggccggttttttttcttttttgagacggagtctcgctctgtcacctgggcgggagtgcagtggcgcgatctcggctcactgcaagctccgcctcccgggttcacaccgttctcctgcctcagcctcccgcatagctgggactataggcacccgccaccacgccccgctaattttttgtatttttagtagagatggggtttcaccctgttagccaggatggtttcaatctcctgacctcgtgatccgcccgtctcagcctcccaaagtgctgggattacaggcgtgagccactgtgcctggccaaggagacactattttatgtccagcagactggcaaaatttgactaaagcctggcagtaccacttgttgtcaaggatggggactaatgggaaatcttgtgctttgctatgcaagtataaattggaaaatcatttggcttgatttagtaaagctgcatgagcacttgattgttcagtacaggatctcaacttgtagatgtatatcagagaatctgttgcttatgtgggccaaatgatgcatacaggaatcacagcattgtttccagtagcagaaaataggaatcacagacacatcagcagtcatcagcagtagagtggaaaaataaatcatggcatatttatgcaacaggatgctgtatagcagtgccaatgattgagctatggctgtatgtttccactggatgggtttcacaaaattgtggattgtaataacctgaggggaaaggaggaggatatctgggacaatggtaatgatgaagttgtatttcttaaactgggtagtgaatacaggaatgttttattactcttttaaccgacttgctctttttatgttggtataaaatttttcataattaaaaaaatcagtctacagccaaatcacattatttcatttaacataaatcctttgtttctgttacggtctaggtatctatagcccatttatagtgttgagcattttaacaatcaaaaaattaagttttttttttttttttgagacggagtctcgcactgttgtcaccaggctggagtgcagtggcacgatctgggctcactgcaacctccacctcccaggttcaagcaattctcctgcctcagcctcccgagtagctgggattacaggcgcatgccaccacaccaggctcatttttgtatttttagtagagacagggttttgccatgttagccaggatggtcttgatctcctgacctcgtgatgtgcccaccttggcctcccaaagtgctgggattacagacgttacccactgtacctggcctaaattaaggttttataataatcaattatttcttaagattttcaactaataataaaaccttaatgttgataaggctagtagagtggtcactgatatttcaaattagaaatttgttttctttgagtttttaaatttttgttcaggttttatttgaattttgaagtattagtataaatacttcttttgatgagtatttttagttaaaaaaaaccttgaggaaatgttaaacatatactaagtaattcagccctgatgattttcgtttttcccggcagctagcattggatatgtggaggaaattgatggttgaaccacttcaggccatccttatccgaatgctgctccgagaaatcaaaaagtgagtgctgacatttatcttactgagtcaattttattttgttgtttgatatggttttaaaatagtgtacaattgcagagccagtgactagccttggggctggttttactgtaatgagcctcattttacttccaatgccagcattttttaagttgttttattttcttcttcttcttcttctttctttttttttctttttggtggggggagctctggtcttttcttataccctaatatgcttagtatataaataagtatctgagggaagtgacttattgcttttcagagctgaaaactcttagactttctaggcagtgccctgagttgcttgtacatattacctgtttaaatcctcgtgaggaccacctattgaggaagacattcttctagttagttggctacctcttagcctcagtgttataatcaataacttgcctaattctgtgagataaatttatgggaaaatggtttcccactctacccatggctcagagtggttaacactttttaccctagtgctgtgtgaatacaatttagtacaaagaacattttcctgtggagtctagaatagaacatccttggattagctctggctcaaagactctcagaagcactctgtcagtcacacaaatatatatccagtaaattccaggttactggaactgatgttataggaattatctagaccagtgaattgtagtgtaataatggccactccacctatatctgtgctcatcaagaagacctaaataaggagttttttttatatgaggaatactttgtcaaagccgtggtatttagtatgggactcctgggaggaagtaagggattaaacacacacacccacccctatgcctcacataagaagataagagaatatttttaaatttttgatacccaatagaaagtaggtggtaacaactagtaacttgatttttaaaaattgtcactgaccgtttgagtgattccattgtttttagagatagagagctggagaggaaaggcaatactgaagcagtagggtgtaacccgttgtttttcttcctcttttctttacaaaactgtgaactaaaagaacactcccaacaaaacttctaagttctaatataatttctcctgctaaaatatactaacttttcttttgacttggaattcaagtatttaaaagtataatgacaatactgttatactttctaaatgtacttttgtgaaatatcttttttaatataattttgtcccaacctagtaaatttttagtgtgattgttagtttgctaaaaatcaatatgataaaaaatgaaggaaacaatgtaagaaaaataatacaactaaagcatattagttctggaaaagatagattatctggtctgcttgtcttatttttgttgttataatcggcttccattaaagcattgtttcacatgctttactaagatctcacttattcttcatgacagctctcttagagttttgcatgttaaagttaaggaaactaaggcatattaataatagaaattaaacatgggaactacataccaagcattgtgctaaaaattttacatccatcttcccatttaatcctcacaacactggaaggctaatactattagtgtcaccattttacatgcatgacatccttgacatgcaaaagtcaatggtggtgatctgactcagatcatttgactccagcctccatctaataataattctagggattcacatctgggctaatctaactctgaattcattatgcctgtccttttttcctttttttttttgagacaggattcccactctgtctactaggctggagtgcggtgacatgatttcagctcactgcagcctccgcctcctgggttcaagcaattctcctgcctcagcctcccgagtagctgggcaccaccacgccctgctaatttttgtatttttagtagagaccggttttcaccatgttggccaggttggtctcgagctcctacctcaagagatccaactttctcggcctccaaaagtgtggggattacaggagtgagccaccgcacccggcctttatgcctgtattttttttttttttttgagacagtcttgctctgttgcccaggttggagtgcaattgcacgatcttagctcattgcaacttctgcctgctgggttcaagcgattcttctgcctcagcctcccgagtagctgggactacagacgcgcaccaccacacccggctatttttttttttttttagtggagacggggtttcaccgttttagccaggatggtctctatctcctgacctcgtgatccacccgcctcggccttccaaagtgctgggattacaggcgtgagccactgcgcctggcccagaaatctttaaccaaattattttttattgtaatctaatgtgttcactcacagaattgaggaactatcatagagaattaagcaaatatggaggttgaggtagggtttctgatgtgagccacatctttcttttacagtgaatagaattcctgatatttaaaattgttttctaggtgggaatgtcagttaaaggaaatgaagaaattagtaatttagtcagcatattatagagctgcttgttagagccatctatcattttgttcttctttattacctggaaaattttatcaagatatgcttcttctcacctactgtttagttacccaatggtagagttcatataggaaaagcaaaataactgtttgtttctttcctttttaataacccagttttttgtttttgttttgttttgttttgttttgttttgttttgttttgagacagagtctcactctgttgcccaggctagaatgccgtggcacgatcttggctcactgtaacctcctcctcccaggttcaagccaattttcctacctcagcctcctgagcagctgggattatagacatgcgccaccatgcccagctaatttttgtatttttagtagagactggatttcaccatgttggccaggctgctctctaactcccgacctcagatgatctgcccacctcagcctcctaaagtgctgggattaccagtgtgagccactgcgcctggccaataacccagtttttaagataatgagttggtttgctgtcatccttaggtgaccagttagctttttaaactttaccaggatgaactcagacttaaactagagaggcctacctcactttattaaactcttctcctagtggcgtatattaggttccttccagtttttccactaacaccactcttgtttctgttgtacacatatgtagatgtttgcttggggtcatagggtgtgtatacttagagttttgccagtatgtcctccacagtatctgttcttccaccataagcagaacatgagaaaataggtaacagttcagatcagtatctcaccagattgaatgtgggcttatgtgaggtcacgcatgtgacccaagccaaggaaatgagctcacatgtgtgaccttattatatgaactagtcagtgatatcaagatatcaagattctctatgactgacagaattactgtagccatattaattcatgtccaaaaaatagttctcagaatatccaaataattaaaggaagaatcaaagaggactagaggggttcagaggcagggaaggactctagtatgtaaaggtaattgcctggatgcttttccttgatgcttttcttcaatgatagaaaattcttacatcctatatatagagcaacaagctcttactagggaatgatgataataagttttctgttgctctctttgtgacattattaatgcaaagaagaaattattttaaagtaggttggaagagtgtgtagtgaggtaaaccataatggtttgatttgagcattggtactagagtcacaaaatcccaatttagagctagattattttactgtggctttaagcaaactttttttctattttatttttatttttattttttaatttttgagacagggtcttgctctgtcacccaggctggagtgcagtggtgcaatcgtggctcactgtagcctcgactcctcctgggctcaaacgatcctcccacctcagcctccagagtagctgggaccacaagcatgtgccaccatgcacagctaagttgttttttttttttttttgtatggggtcttgctatgttgcccaggctagtctcaaactcaggactcaagggatcatcccacctcagcctccagagtagctgggaccacaggtgtgtgccaccatgcatggctaattttttttttgaatgaggtctcgctctattgcccaggcagctcacaaattcagcactcagggatcctcccaccttggcctcccaaagtgttgggattacaggcacgagccacggtgcctggttctatttcatattccttttattagaaaagctaacatttcacctacatgtcttaatatgattaagactttgtagtttgtagtgagtgaaaatcaagcattcttaaccgccagtattaaagttttgaattgatgggctcgtatctactttgttaaaattaaagaagtgttatcttattactgacatagtatcttgaactttacaatcagttttctttttatttcttgaaatgacatctaatgtatacattaactatcatgaatattaactcagctgtgatataaaaaaaatcattgttaagattcatgcatgtacctttttatagttctttacactttgattagaccaatagaataaggagccatattttggcatattttgggtatatttccatagataatttgtattctcaagaatattttgtgttataccttgttttagtgatcgtggtggagaagacccaaaccagaaagtaatccatggggttattaactcctttgttcatgttgaacagtataagaaaaaattccccttaaaggtaaacagcctcctttaaaaacaaataatcagactgttaatttcttaaactgcttgttctaatttcttctaatatgatgtaattgatttattcagttttatcaggaaatttttgagtctccctttctgactgaaacaggagagtattacaaacaagaagcttcaaatttattacaagaatcaaactgctcacagtatatggaaaaggtaagaaataaaacatatcgaatacatttatctattttgtatctggcctggttttatttaacatcgttcttagttttcttgttttgtttcttggtggaaaaatattctgtttatttaatctatttaatcattaactctgagttacagttattatataatatcgattgataagtcattgctctttacaatacccttccagttttcatcataattgatgctttttgataaatcctgactgcttggtttacttgtccttgaaattaatatatatgcacattcttggcagaataatcagtttatactggatttcatgcttagtggttagtttagagaataggataagtgcagaagctctgtgttgaggtttttttcttcctttaaaatgagaggaaaaatatgaggaaaatatagtaattctagacatttggatgagtcactcttttggtctgttaagttcttgaaaggctgagagacaaccccacgtgaggtgttttttttttttttttttttttttggtgatgtggtcttgctctggtgcccagactagagtgcagtggcttgatcatggctcccaggctcaagtggtcctcctgtctcagcctacgaagtagctgggactacaggcacacaccaccacgcccagcaacttttaaaatttgttatagagatggggtcttgctgtgttgcccaggctggtctcagaactcctcaacttgagcagtcctcctgcctcagcctcccaaagcgctgggattttagatgtgagccattgcacccagccaagaaattttaattgatcactaaaccagtacatattggttatcatatgttaaatcccatgtttattttctcagtagtagaagaaaaaagtgttcatacaaattaaaccaccatatgtaagatatattagaacttctagccaggtttttaaatctgcagtgttggatttcaagcattttattttgggatggtttgtgttagtttatgtagccaagaaaggtcgagtagtttaagtgggtgagctgtcatcctacatccctaggccacaagtcacaaagcatccgtgcttaccgatacactgttgtgtcatccacaaagcccagatctagaggtcttagttgtttgattatcttcctgcttttcttactagttagctctgtcccctgagcaaattatctggaacttttcccccatcaattaagttcaggttacactagatcagtggttctaagctcttagcccttattgcaccttagacttttgttgaagcctctagatccagccccaagaatcacacacagattatctgtgatacatgcactttgctctgtctggctgtcaaaaatatgccactggcaagtggtggcagtagcccagatgtctgttagaagttgaaagaataagcaaaatgtgatacatatgtgcattggaatattattcatcgtgtgtagtgaaaaactctctcaaaccatgtttttcctctactctcacaccacagcaacaatcatcagcacagaaggcttctgtaaacaaaggtgtggctctcttctcccacacaccaagcagcagacaccagctaggtgtcctccagttcaactctaacaccatctacttgagatagtggctaatcccacagtttggggactgagtctccaagactgccctgcacacccccagacaccagtcacaagtctgggcctccggactactgaccgactggctttcaagttgaagtcctacagtacactgtttgggttccattaatttgctagagcagctcacagaacttagggaaacactcacttaatgtttactagttcattaagaaggatattttagaggatacaaataaacaaccacttgaggagacacataagggaaggtctgaaatcaccatgagtgcaggagcttctatccctgtggaacccagtcttcttggatttttgtggaagcttcatgatgtcagtagtctttcccccagcgtacagggtggggctttctctggggagggtcttatgacccacagtcagaaaggtagggcaagattagagtcctgccttgaggcaggtgaaaggagagtaggagagaaattctgtttcctgagacctaacacactcaacattataactaaagactgtaactagggctaagggagttatgaaccaggaaccacagatgaaaaccaatgtacttacatatcacaacaccacacagtctttaaaaagaattgaagttatacatgatacaacatggatgaaccatgaaaatgttatgctaagtggaaaaagacagacacaaaagggcaaatattctgtggttcaatttataggaaatatctagaacagacaaattcaaaaggacagaagatagattagaggttatcaggggaggaggatgtgaggagttgttacttaatggttataaagtttctgatggggtaatgaaaaatatttggaagtagacaatgggggtgattacacaacatagtgagcgttatttaatgccactgaattgcccacataaaaatggctaatgtaaattttattatctatgtttttaccacaatttaaaaacattgataatgtaatataccaaaaccattgaattgcacactttaaatgggtgaattatttaatatgtaaattacatctcaaggtgttaaaagggaaggagggacattggaataaattatgtttggaaaagaatgtttattagaaaagcttatttcaggctgggcacggtggctcagacctgtaattgcagcactttgggaggctgaggcgggcagattacgcaagtccaggagttcaggacaagcctgggcaacgtggcaaaaccccatctctacaaaaaattaaaaaactagccacacatggtggtgtagtcgtctggtcatagctcttgggacgctgaggtgggaagatcacttgagcctgagaggcggaagttgcagtgagccgagattgcaccactgccctcctgcctgggccagagagcgagatcctgtctgacaaaagaaagaaaaagaaaagctcatttcaggaaataatgttggaccatattagcttcaagggcaaaaccctgggctttgctctccatttagttaattggggaatgagtcagtacagccttcctgcctccttgctgcgttcctcttatagctttggcctttctttcccccaggggttttacagctgtttgaagccctgcactggggcagtccaaccttctctacatttctcttgatatgcgcctctctctcccaagttatcattgttttattttttccttcttccatcctccttcacctctctcagacccactgtaattcctgttgcattaacttggcaagcagattaaagtcactatagtatgctctgaatgactaatagacttaatcctttttgttataaaaatagcccttaaaggatttattgttaatcaaagtgcctttcttagctgatgtaatatgtggtgaacacttttgtcctctagaccaggggtccctgaccctcaggctgaggaccagtactgacctgtggcctgttaggaactggggaggaccagtactgacctgtggcctgttaggaggaaccgggctgcacagcagggagtgagcagccactgtgtgagcattacctactgcctgagctccgcctcctgtcacatcagcagcagcattagattctcatagattctcacagagcgcaaactccattgtgaactctgcatgcaaggggtctaggatgtgcgctctttagaagaatctaatgcctgaggatctgaggtggaatacttcacctggaagccacctgcccccaccaatgccgcccgcactccgtctgtggaaaaattgtcttccacaaaagcagagcctggtgcctaaaaggttagggactgctgctctagaccccttcttgcccgacctgagtctgtgactttgccctgaactcctggcttcaaagggtcgcacaataggaaagacaggactgtgggaacctactgtctggagcctcatttttattgaaaatttctgatccgctttccaggaatgattttcactccttgtgcccaggccaactcagcagcactctccaaagtgccaggtgtatgtagttccccgggaacacttaatttcagaaactctaattacacagctttatgttccagagtgtttccaagccggtgcatttgtctgtgtatatgttgttgttttgtcttgagacagaaattagtcaaattctttggttattttccttatgggctagttcttgttgatattaaccagtgttatttgtagctcagcgctttatgtaggataaactttaataaaagtcttgattgacatacttgactatgactaaattatatttactttcaaatgttttattttttatttatttttattttttgagacagagcctcgctcttattgcctaggctagagtgcagtggcgtgatgtcggctcactgcaacctcctcctcctgggttcaagcagttcttctgcctcagcctcccgagtagctggtgctacaggcacctgccaccacacctggctaattttttgtatttttgtagagacggggtttcaccatgttggccaggctggtctcaaactcctgacctcatgtgatccacccacctcggcctcccaaagtgctgggattgcaggcatgagccaccttgcctggccttatttttatttttttgagacagtgtctcactctgtcacacaggctggagtgcagtggtgcgatcttggctcgttacaacccccacctcccgggatgaagtgattctcttgccctggcctcccaaggagctgggattacaggcatgcccggctaatttttatatttttagtagagacagggtttcgccatattggccatgctggtctcaaactcctgacctcagatgatccacctgccttggcctcccaaagtactgggattacaggtgtgagccaccatgtccagcccctactttcaaaaattttaattaaatctttaatatggtagttaactatcatgcacatacagttccatttacaagaagagaaaccaacgtaaaataattagattcatctacttgatttcaatataatttattttttagtttgatagttattcataacagagatcacctgttctgaatttaatcatctgtacccacttttcctgttacatgttatgttgtccatgtaataggatgaatggtgtaggtaaatgaagacaaaatgcagactatttaactttagttcttgcttataagactggtggaatgtagatgacagctagtagcttaaataaaaatttgaaatgatttatagaatgtgggtttaaattgcttatgtaacccttattacctttgccatgtttaattcagccattaaaatttggctgagttacttgctgatattacagatttttcctcatagtaaaactttgtgttcatgactgtaagaaaatatttttataggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatggtaagtgacaccaaacatgagtagaaattaaattataaatccaccttttatatcatcctctagtcacccttgatttaatgcctattttagtaatagtctttaaaatattttaaataaccttttacagattattaatactttattttgaaagactattttaggaaagtgttttcagagtgttctaaaatcagaagaaaaagtgggaaattgtgtttatacatttttatatattacaagagctaatttccttaatgcatttagaattcctgataaacagtaggaataaaggcaaagactataaaaaggaaatacaaatattatgtaataaatgtaataatttatataatataaaaaatcagctatatctgatttttttttttttttttttttttttttgagacagagtctcactctgtcgcccaggctggagtgcagcggcgtgctcttggctcgctgcaacctccgcctcccagattcaagtgattctcctgcctcagactcctgagtagctgggattacaggcgctcatcaccacacctggctaatttttttgtacttttagtagagacagggtttcaccatgttggtcaggctggtctcggactcctgaccttgtggtccgcccgcctcagcctcccaaagtgctgggattacaggcgtgagccactgcgcccggcctctctgatttttaaaaaaacaaaaaacatgcattacttttataggcaggaaagataataaatatgtatattttatttaattaattaatttttttgagatggagtctcgctccgtcgcccaggctggagtgcaatggcatgatcttggctcattgcaacccctgcctcccaggttcaagcaattctgcctcagcctcccaagtagctgggattgcaggtgtgtgccatcacatccagctaatttttgtatttttagtagagacggggtgtcaccatgttggcctcctggtcttgagctcctgacctcagataatctgcttgccccggcctcccgaagtgctgggattacaggtgtgagtcaccgcgcccggccattaatcaggctttttgtttttgttttttgagacggagtcccgctctgtggcccaggctataatgcagtggcgcgatctctgttcactataacctctgcctcctgggttcaagcgattctcctgcctcagcctcctgagtagctgggactacaggcatccgcccccacacctggctaatttttgtatttttagtagagacgaggtttcactatgttggccggctggtctcgaactcctgagctcgtgatccacctgccttggcctcccaaagtgctgggattatagacacgagccaccacccttggccccgtgttttttacagcaacattaatttcatagatccagggcaatgtagtcaaaacccaataatttcattttaattccgaaagtcactgtcttgaagagtatgatggaaagactttaatgaccagcaagacttattgtaaaacctatagtaattaagacagtgaggcattggtacaaggacagacagatatcctaataaaataagagatcctagaaacaacccaagcatatgtggccacttgatgtaagaccaaggtggcgctgcagagcggcaggtaaaagatggtcttttcaacacgcattgctcagtcaattggatatccatttcagaagaaaatgaaatttgatcactacctcaagataccatatacaaaatcaattcactattgagttttttctctaaatgtacaaggtaaaaaaataacacttctagaagataatatagaagaatatcttcataaccttgagacagggaaagatattttaaataggacacaaaaagccctaaccacaaaggaacgattgatccagtgaactacattaaaatgaaaaactttggattattaaaaggccattaagagggaggaagattgcttgagctcaggagtacaagaccagcctgggcaacatgacagtatcccatctctgcaaaaaaatacaagcattagccaggcggggtggtgtgcacctgtggtcccatctacttgggaggctgaggtgggaggatcacttgaatctgggaggtggtggttgcagtgagccgagatcctgccactgcactccagcctgggtgacagagtaagaccctgtctcaaaaaaagccattaaaaccactggatcatcagaagacagttatagggtaatgtacctgcaatactaaagatttatatccaaaatataaaatgctcaaaaaacaggcactgcagaatagaagatacccagatggccaataaacatagaaagaagtgtgaagtagcaggaacttgttgaacactgaagtgagagtataaattgatgcaactactttgggaaactggcactgaccgctaagtgggatatattatgcatattttatgatccagcagttctcctaaacatataaccaccccccagctttacctccccactgccaatgcctggacatatatacaaaaagacatacaggaatgttcatagtagtgtttgtaatagctccataaactggaacagctcaaatgtccagttactgtagaatagtacagtatattcatacaatggaatattatagaggagtggaaatgaacaaattaaagccatgcacaacaacatagatgatccttatacacatgttgaacacaagaagccagacacgaaagaattgtgtgatcccatttttatacgtagttcaaactcatctgtgatttagaagtcacagcagtggttacctttgcagaggagcaagagtgtgtgattggaaggaggcatgaaggggactcctgggtgtaggtaatgcctgtttcttatcctgcgtgtgattacatgggtgtgttgtgtgttcacttgtgataattcagtaagatatacacttatggtttgtatacttttctgtatatgtatgatgctttaatgaaacgtttaaaattaaacctactacactgagagatcattattcacctcccagtgttagagatcaaaacatttggcaacacattgttggcaaaggaactctctgctgttggcagctgtggttagaaggatctgtctacaagattaaactttgacacagtaacctcacttttgggaacttatattgcatatattcttgctcatgtataagattattgattgcaacattgcaatatcaagagactggaaaccacctaaatttccatcagttgttaagaaattatatccacataatggagtactgtgcagctgtaaaatacatagaaatgctttgtgtactgataggaaaagaccactaagttaaaatgtgttctgaagctacaaataatatacaaaatacagtacactgtattaaaaggggcaaagggaagaatatatgtattcacttgaatttgcacaaaatatctttgggaagatgttaaataaccacatccctttcctgtggggagaggggcttgggtggctgggaggtgggcatgggggacttttctctgggtgctctgcacttggatccgtatattgtactcctgcacttggatccatatattacctaataaatgaaaatatttgggagttaaccctcagatgtctttttcctctcagacatggcaaatatgtacgtcttactccgtgctgtgtccactggtttacctcatatgattcaggagctgcaaaaccacatccatgatgagggccttcgagcaaccagcaaccttactcaggaaaacgtgagttgtgtgggaaactgcaacgttttcctcctaatcagatccagcgtggagcctttcctttgactttattgttttgaaagatgaaagaaaaagtcttaccatgccaacgaaagaaatgtctttattcaaatgttttaaacctagaatttgttggactcattttggaattatcagattattagaaagctattgataggctgctgcttagccatacggagggtgtccattgaacagttgttaactttccacaggaaaataagctcgccatttttaaataactgtgtttttgtgtaattggcattgataacgtagtttgttgtcatggtagtagtattaatcagtggtaatatagacgacttgcaatttgcctcctttccatatcctctgaatttggttgtccaggaagcaaatttagattaaaataatcttctgtaagtatatgcttgctgccccaaatacctaaaacaataaccctcatatccctaatactcatctttctcgaatactttgccaatcacatgactgtaacagtttgtactgtaacagtttgtctttcccatcaccaaatcttgttattactggtaatgtttgatgagcaagagagaaataacttcaaatgttactgtctcttcttaagtagagctgtttgcccttcatctataagatagtatctgtgtatagacgtcactgttcaggagcactttttagaggctgttaccttagctgcagattggtttttggcaagtaataatttttagtttttatgttatgccacaataatgtgtaagttttctatttttttatttcttcaaattccctttaccacagttttctattttttgtagaactattagtttatagtattcaggtttattactctattatttgtcaaacttactagtttacattattacgtttatagattccatgtccaatgacattgggcatagaagcatcgaattttgtgtcaaggctgggagatggaaacataagtgaatacatttgtggtagactcaaatccaactgacttagttaagtcttaggtagtaacttcttcatggttatctccattaagagggaaaactcacttttgtactattaggtatttcttctctctgagatgtgagggattgtcttgccgagttcaaggggtctctgttctcaggattattggctttttaactctcctttctctcagcctttagtgactttgcaggcagtctttgcttatttaagcctctatgaaagtgatagacctggtagttcaggtcttgttatccttaagataagttattccaacacagtagaaaagtatgcttttggtgggttcttctgacaggtactagacagtctatgacagcttgttgtgttgaatgacaagctattttctttcttccttttttttttttttgttgttgttgttgtttttctgagacggagtctcactctgtcgcccaagctggagtgcagtggtgcgatctctgctcactgcaacctccacctccctggttccagcagttcccctgcctcagcctcccgtgtagctgggattacaggtggacgccaccacgtctggctaatttttttgtatttttagtagagacggggtttcaccgtgttggccaggatggtctcgatctcctgacctcatgatccgcccgcctcagcctcccagaagtgctgggattacaggtgtgagccactgtgcccagccttcaacaccaaagttgtaaatttctaagaccgtcttagctaaaaccattttctgagaagtgtgcatgtgtgaaacataatttccttgaggaaaaatttactaataagtctaataaacctcatagtttggatatccttgaacctcttaaaatgtggttttgtacttatatttcatttttagatgccaacactatttgtggagtcagttttggaagtgcatggtaaatttgttcagcttatcaacactgttttgaatggtgatcagcattttatgagtgcgttggataaggtaagttttaaatacatatatactatatatgtacataaaactctatcattctttaggcagtttcaagattagaattctagtatgaggtttctgatgtagacatggagattaagtaattttgatatgaaattcaaaatagaaataatataatttttaaattattaactgaatagttaaattgaatgcttgtagaatgtcccgtgattatgctatataaggggaatttttaatctgatatgttctggatagacatgcataattttgcaatttttagtactgattttttttctttggccataatacttaggctatattgaataatatttgaaaagagaatagatatgttttacatgaacttttgcatacgttaaaggaaagctgcttacaagattgtaagtttttttttaagtaacgttattttatctgttcaaatttcgataatgagttacagaatatcttggaatagcaacaggatatatagatattttgtaattagagaataaagtcagaggagtctaccatgttaggcatgaaaatattaacaaactaccggcaatgctgtgttttatgtggcggggtaatttttggatgtacagattatggcttatattgaactagctgtactttttccctatggctggtggttaattatggcgtgtttttttattcaggcccttacgtcagttgtaaattacagagaacctaagtctgtttgcaaagcacctgaactggtaagtttggtggttgctgaaaagtaatcttatgaaaagtcagtattagaaaatgagaactcagaatatcaaattaatttggtttttgtagcatttttcagaaaaatagaaggaaaattatctacattgtatatagtttggcatttatgtaaggaatgcaatatactatgtgtcttaaagaataaccattttacaaagtttgggttttaatgtatatctactttgaaataatttgcaatacttttcatgtagattctgttacatctgaaatctaaaggaaatctgatgataaagtttgggtaacctttgaaggaaacttgcttacaagatttttgtaacttttttttaaagtacttgttcaatgtcaaaaattataaaaccactcgaaactcacctaggtgttcttttaaaaatttgtattacttatatcagttgctttattggtcaataagtgatgatttgatatttgacttgttctttttaaaaatttaccttatgatgtatattttatttagtttacatttatgattattacataaagctttagaagcctggtgtggttgtgcatgcctgtagtcccaactacttgggaggctgaggcaggaggatcctttgagcctaggagtttgaggctgcagtgagctatgatcttgtccactgcaatccagcctggcaacagagcaagacccggtctctaaaaaaaacagcaaaaattctgtccgctgatcttaccttgtatcaccactttgcctcctttgaggcgtgatatatacagaagcaccctttgtaagatttattatcaatttctacatgagcttgctaagtactgtgacaacttactgaagaagtcagcgaaagggatgacagagaatgaagtggaagacaggctcacgagcttcatcacagtgttcaaatacattgatgacaaggacgtctttcaaaaggtatgttgtgaacagaaaagtttcatttgtattttggtcaactttatttctgaatgctaaatcattagaaaggaagtaatcttttaaaatatttttaaatgtagttctacgcaagaatgctggcaaaacgtttaattcatgggttatccatgtctatggactctgaagaagccatgatcaacaaattaaaggtaatgtaagtctttaatgtggtattgtcctagaaattcattcacaagcacataaagatgttcattgcagcattgtgtacagtaacaggaaacaattcatctggttaaatgtgtatttgtgtagtcacacagtgggatatacaaatactgtattaaaaggacaaaatgtatatgtttatatatgaagattcacaagataatcagtattaatgataaaagattattactacttataaatgaatacacctaaaatattcctttaagtacagattttggagtgcaattccatttcaatttatttttacatcatttcagcttgcttacataccgataagtggtagcaggttcatatttatcctgtgttattcaataaattttcttgcatagtagacattttgaatataatatgcattccttttttcctttttctttttttaagagatagggtctcactatgttgcccaggctggactctaactcctgggctcaagcgatcctcccgcctcagcctcctgagcagctgggacaataggtgtgcaccactgcacccagttgctgtgtgctcttttttaaacctccaaaaagaaacttaatttttaatttctaaaagtagtgttggccaggtgtggtggttcatgcctataatagtagcactttgggaggccaaggcatgtagattgtttgagctcagtagttcaagaccagcctgggaaacatggcaaaaccctgtctctaccaaaaatacaaaagttagctgggcttggtggcgtgttcctctagtcccagttactcaggtggctgaggtgggaggattgctggagcctgggacatcaaggctgctgtgagccatgatcataccactgcactccatcctgagtgacagagcaagatcctgcctctaaatagattaattacaaaaaaaaagtagtgttaatgagctttttatatttcaagattagagattcagattttctgacctggtaacaacagaattttgaataattttaaagaaatagttttcttcagcactcagtagatgctattaaaaatatgcctaaatagaactttttcaattgactacaggctggagtattcccagtaatcatttatgtaatctttcatttgatactatctgtaaaccttataagagccagcagctgtggcatgtgccaatagtcccagctactgggagagtgagataggaggatcacttgagcccaggtgttcgaagttgtagtgcaccatgatggctccaatgaatagccactgcgttgcagcatgggcaacagtgagaccccaagtctttaaaacaaaacacaacataaaatccttttaaggtatcttatgtatagtaacggggcattttgcagtgctgaaataagagatgaatgtataaaaaagtttttgtttaaggggagatttattgttcctagataggtggtttttattcacttatttaaaatacgtctttaaaaagaaagtttgaaaggttttgattagttgctttgacttatgaagaatatattactagtccttgggtataagtgtatatgcaagaacctttgatcaaagacctagcaataccgacacattattattaaccaatatgacttattatttttcttttgaattcatgtattttctaaaacttttttatagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggtatgaatatgtgttttactatgagcatttactaatcatttcagtacgttgatacaaatgattcataaatggatgcctgattacgtttggttctgtgagtagattgtggcttctaaagtcctattgatttgggctgggcgtggtggcttatgcctgtaatcccagcactttcagaggccaaagcaggcagatctcttgagctcaggagttccagaccagcctggccaacatgtgaaaacccgtctctactaaaaatgcaaaaattagccaggtgtggtggtgcgtgcctgtaatcccagttactggggaggcagaggcaggagaattgcttgaaccccagaggcggaggttgcagtgagcggagatcgtgccactgcattgaagcctgggtgatggagtgagactccatctcaaaaaaaaaaaacaaaaaaaggtcctattggtttggaatgaaatgtgccatgatagaaatactcagatttcatcaacattttgaggaagaaaaaaatgttttagatgcttagattatttaataaatatttactttgaatttagatgttgatccatttagcttattttattttatttttttccttctaggctggtgcgtggcctcttactcaggctccttcatctacgtttgcaattccccaggaattagaaaaaagtgtacagatggtaagtttgcaggaaatatattagaagactaaaggaattttaataattgtcttcatattatatcacctttaatattttttcagagtcttaagggttcatgtgataaaaatagattcagaaattatagtcagtctgccctttaggaagaatgtaagttattgtagttactaatattaatactaaaatgctaagaagaatgtcatacagttctttgtcaaagcatgtctcttattctgagtaagtctatcatctgctattaagcagttttaaattataaaaatgttgatatcagaagaaagcttagaattcaacacctaaaatatcacttaccagttttccttttgaattttgaccaaatacctcattcagcccttgtaatatttttatttctgtcctgtaatgtaggtaaatatatgtgaagtaactgctagtagagtaagtagtaacagtgattgatagtggttattagtttcgtggtaataactaatagaggagagtcctgtaaccagtcaggtaggtttcaggaaggcaagcatgatagactttcagaataggaggctaaattaggacttcttacatcttctttgaaaagagattgtagcacagactattttagaaactatgtgaagaagagcatttgtgcagacattcattggatggggcagactataatccaaggttattacaaattttgcagaaaggatacatcccaaagtgctgggatttcaggcatgagccaccatgcctggccttggcagtcttttacatttctttttaaatatcatgtgtccctgattgaaattaagggagagaataggagctggcagaaatgaagttttcctttagttttttctttcctctttccttgaaataattattttctatttatagtttttaactctttaaactttatttgttgatgtatagtcttcctcaggttttagtttccccatttacaaataggaagtgagtttctgtctgtaaaattctgattccaaaaatactattctctccatttgaattgtctccaattaccagtagagggagtttgtcctttattttttttctagtaagtccaagttttcagatacataggattgaaatccatttgtatacttaatagtgtacagttttctcatgtaaattaatccatcctgccttagtgatgatttgcattttttacatcttaatcttaaatataactatcaagaattacctttattttacaccaaagtatctcaaaactgtggaattaaagctgtaattaaaagtaatttattttatactttaggccagtcaatcttaattgttacatttcttttttacctaggccaaaaacctgaataatattagaagtatctaaagttgccgggcgcggtggctcacgcctgtaatcccagcaccttgggaggccgaggcgggcggatcatgaggtcaggagattgagaccatcctggctaacacagtgaaaccccgtctctactaaaaatagaaaaaattagccgggcatggtggcatgcacctgtagtcccagctactctggaggctgaggcaagagaatcggttgaacccaggaggtggaggttgcagtgagccgagtttgcgccactgcactttagcctgggtgatagagcgagactccgcctcaaaaaaaaaaaaaaaaaaagtatctaaagtagtgtatattaatgtagctatctattaaaggtaaataaactcattgaatttttaaggctctttgagatctaattaatgcccttaaacagtgtttgaaaaatgctgttttttatcctgtttattttaaaataagtttagtctgggaggaggggggagggatagcattaggagatatacctaatgctaaatgacgagttagtgggtgcagcacaccagcatggcacatgtatgcatatgtaactaacctgcacattgtgcacatgtaccctaaaacttaaagtataataataataaaatttaaaaaaataaaataagtttagtcaacatatattttttactaataagctttgctaacacaattattttaatgatataatcaaggaaggttttataactttggtctttgtagtgccatatgaattgatgaatttattggagtctgtttgttcttgactagctatagatacgagagtctttgtagtcagattttaaatgtaaggatgaatcagtatcttcttttggcatattgatattatcgtcaataaaactttaccaaatagtactactgaagaggtaaaacatgtttttagagcttggaatataccttttaaagccagctttgcactttaaattatgagcattttaaagctggaatttctcatttccgaaagtgttttgagaaaaaaatgaaagtttttttaacttttattttgcttttgtccagattcattgtaaatgtgttataaattgtgaattatatagtagtgattgaattttattgatatccctgggagttattagttagtcagatcatacttctgaaatcctcttatgacatatttcaatttgctgtttgtctggattagaactaagcaggcaatctgaagtattccaggtgctagtcatctcctgttcatcctgcaaagggattggtggatctgctggtagaggaggatgctgcaccattagagggaaaataggctcaacatatttcagcttcccaggactaggcaaacttagagtaactgctgaaggaattgactcattttcttggctggagctattaacttttgctgttaaggagtggtcataatatagctgataggtcagtcattgctgactgctttatgtgaacttcctttttaaagtacaaaaggtaaagtttgatatacaaataaaagctttaagtatgttatatatggtacatcatgctaaaagtttattcagaattctgaactggcataatgcagtttattttttagttttataaagaaattgagtttttatctttttcacatccagtatcatttttccactttttattgtatactagctctttattaaagaaaaaagaactctgtatttttgttctgtaattacacattcagtccagggaggaatgtttaaaatttgaaggctacattaatagaatttaaatttaattgttcacaataatatcagcaaaagaataatccagagatataccctaaaacttcgtatttgtgtctaattgaatgtggaagctatatgttggcaaatgggagattagagatgaaggtagggtttctcttttcatggtgaaatatatatgttgctgtgtttggttagtagaatttataaagtccatgttagtattattcagaaatgataatgaatcactgtgtcatacagaaagtcaaatttgcagtgctgtggtttagtggagagaactctagaacaagttgtcaattaaaagagctggaatatatgtgtatagccttgattagggaccacaggaacgtgctttctcctctgtaaaagaaggaggtaaaccagatgggctttaatgtctcttctaatatgaatggttttcattgcttttgtagtattgtgttaattaactaggcaagttatagtagctaaaaataatgtgtgttttttttttttttttacagtttgaattattttatagccaacatttcagtggaaggaaacttacatggttacattatctgtgtacaggtaaaatgcatttaattatatctggcttaatgaaatttacctgatgattatattaatttagaaagaggttttctatggcccaattacagtttttaaccttttctcctccatcaacctttccccattaaagcaactaacaatgaaatccaagtatagcactttttcatagtattttataattacactgtttataatcttgctgcttttaaagaaatgttctgactttatactgatttattacatttctctagccaaccacttcattagcaaatgtatttagaaactcacatttgatggggcagacacacttagaaacttgttctctaagtatgccagatcctcttgccagtttctttattatagcatcataaggagacctaaccatttgatttttacttgtgatactgcagtgaatgcaatagtaaagctttttgcagaaagtcctacttaattttcaatagtttccaattttaaataacttttatcacaatctaatttcctttgcttctttctggaacaatggagtccacttacttacagtaggattaatacctgaattattgtggactgtgtgtggagttgcctgaagatgtaagccaaagcagacacttgaattttctctttttttgctaaactatgctttgacaagttcattgaatcactttttctttgtacaagaaggaaagggtatatatgctaatatttcttagagatggtacaagaaaatcatttgccataacctttattaggaaatgttttctatcccctccccaagagttactttatccaagtaactatgatacttggtgtttatttgactaatttacatcttgggaacgtgatggctcattgtattagtaatacattttgcattacttatataagtcgatctttactgagcaagttggacattctaatttttaaaataatttttgaaatgagattttttactgatactcttagtggtagtcaaaggtcaaattttaatttgacttttggctaggtgcagtggctcacacctgtaaccccagcacttggggaggctgagacaggtgggtcacttaatcccaggagtttgagaccagcctgggcaacatgacaaaacctgtctctactaaaaaatccaaaaattagccaggcgtggtggagcacacctgtagtcccagctactcgagaggctgagatgggaggatcacttgagcccacgagctggaggctgcagtgagccatgatcgtgccactgcactccagcctgggcaacagagcaagaccctgtctcaaccagtcaatcaatatgttctattttcatttagtaaacataattgattttaagaaaaaaatgctggaccagggttttagattttttttttttcccctaagaaaactaatatatcttagtgcagttcgatttagcttgcttttactttccatgaatatctgtctgggggagtttaaacattcttggttattctcattatttcagcaataatcaatgtgtctcctaaagtaattttagtaaggggctcattttaacaaccagtggtgtataagaagaaaataaatttatgcacatagttttttagccattggaatttagtttgaaaatagtcaccaatatcacctaaataggaaagagaataactttctttctgtttttgagctatactaaatttctaagctgatacataagttgatttggggagctcttttgtttgttcatttcttttatttaatattatttgtgttttagttaaaaccaaatagttacttcctttggaaagagaaccttataagtttatttttttgttttgagtcaccgaaggtactgaaaacacctgtgacctatcagtgaaaccaggagttagagttgtttttcttcccaactttgataagatacaattgacacataaaaattgtatctgtttacagtgtacagtgtgatgctttgttatgtttatattgtaaaatgattaactcaagctaattaacataagtagcttctcacttatctttatttgtggtgagagcatttaacatctactgtcacagcaattactgtcacagcaattttctttttctttttttctttgagatggggtcttgctctgtcacccaggctggagtgcagtggcgatctcggctcactgcaacctccaccttctgggttcaagtgattctcctgcctcagccttctgagtagctgggattacaggcacacactaccactcccagctaatttttgtatttttagtagagacggtgtttcaccatgttggccaggctggtctcgaacgcctgacctcgtgatccacccacctcggcctcctaaagtgctgggattacaggcatgagccaccgtgcccagccttgtcacagtaattttcaagtttactccacagtagattaacagtcaccatgctatatgatagatctccagaacttactggtcctaactgaaactttgtcccctttgatcaacatttttcattttatttttgttctccatttattcatttaacaaaaagtttctcacacgctatgtgtattgaagatacttgttctagattacccatatatggcctaaggctccaggacttctttaaaacactggctctgaggctggacagatctctcagagttctgtttcttgagaacccctgttacttctgcttaaacatagaatgaaaattattcttgcctagtctatttctacattcccagctcatggaatacccaagaaaaggttaatttttgtattgtaaatgaagagtcttcacaaatggttgatggtgcacaaggtggtgtttgggggaatttagaatcagaagacctgtggctggagttattagctcacaacttattagctgtgtaatcttaagcaaattacttaactcctttgagcctgtttccttctctttattgttgtaaaattcattgatcaactcaaagaacattttctatgtctcaggtacttctaaacgccaagtggacagaaataaaatacagagccttggccctcaaaaaaaactcatgtctagtaggaagacagacatacgtacatagttacagtacggtgttttgaatgtgatagaggccagcccagggcatatcacagaatggtggtggcagtcaggtccttgcgagggaagtcttctggggaaatcacatctcaacttgttttcaagagctaatagggccgggtgccccctcgccccacttcgccccacctcaccccacctcaccccacctcaccccacctcaccccaccccacctcacctcacctcacctcacctcacctcgcctcacctcaccccacctcgcctctcctcaccccacctcacgtaagctggagtggaggtgcgcgatcacagcccacattagcctctgcctcccgggcttaagagatccctgtagtcccagctacttgggaggctgaggtcaccagagcccagagtgagaagaccaggcaggcccaaaaagaaaataaataaatgaaaataaaaaataataaatgaaagaaggaaggaaggaaggatatacatgtatatgtaaatgaaatggggttttatttaatacatattcatacattaaaattgacattaatataaacatgtattaattatggaaatatcatctatatagttttatcactacatatttgtgtgtgtgtatgtatgtgtgtgtgtgtatatatatacatacatatataaaaaaatgtatgtttatacacagcagtgtgcagaaaataagattctctgaggcaggagaatggcatgaacccgggtggcggagattgcagtgagccgagatcacgccactgcactccagcctgggcgacagagcaagactccgtctcaaaaaaaaaaaagaaagaaagaaagaaagaaaacatgctgcagattaacatggaggttaatttaatctgcagttagaatggaataaaattgtcaccatgtccatggcttgcagagactgtaatgtgctccctacaaagtcttctgttgaagctctaacccctaaggtccatgagaaggtgatcaaggttaaataaggtcatagtaatctagcactgtgggaggctgaggcaggagtatcacttgagcccaggagttcaagatcagcctgggcaacatagtgagaccctgtcttgaaaaaaaaaaaaaaaaacccataaaataaaaagaatgaataggacttaaccaagctacgtaaaggagagtgttgagagtgtatttccaacagaggaagaattttaagaagcaatctgtgatgccagatgtgacagagtgagaaaaatcctgaaaattccactggatttatgactaaggctttggatagaattaacgataaggaacagtttgataaagacatacagatacttgataaagagatataaccagacagtgtgacagaaaccattacactgtctttgtataaataagttttatttgtggcagagcaagaagttgtagagattgctggtcagttgctgaaagacacgttgagaaatgatgaactcaaggaagataaaaaaaacttcaccaggcagtacatagtatggatcaggctagaattttgtgaaccctacatcatagtatgtgttggtagttactagtgtttgccagaataaaagtaacaccatatcattgtgcataccttaaaagataacgattctattgactaaatttgtcttgcttttgttttcaaataattccaacagctaaaaatagggagggatgttagtattgtctaatgtccagtccatattcaaatttccctgactgtcccaaggtgacttgcttgactgtcagaggtcactaattgtatttggttgttacatttcccttccacctccccacttctcagcattctttgacacactgttttgaacagaccaggccagttgtcttgtagaatatccagtactttggattacttatttgtgatttattttttttttttttaaatttgttttctattccttgtatgttctggaaagtggaaattagttctaaaggtttgattatattcagttaagtattattggcaaggatatttcataggtggtcctgtgtatttcatattgcatatttcaaaggcatctaatgtcagattgtctcactattagagatgctaaatttggtcacttgatgaaggcggtaaccaccagatatctccattgtagaggcactctttcccctcttcagttagcttagcagacagtctgagggatgatactttggcatgaataccctgttccaggaacctaatgtagttttagcctccactgatgatccttgccagaatcagttgtttcattactggttgcaaaatggtgatatcctatcatgccttcaacttgccctgagagagtagagagctgacacagatactggggagtgacttggatgaaactattgtgagagttctgcccgctctttatttcctgtcattgtaaatgctgcttgaattatttattgttggcttactttaagtatgcatgtatcagaatgttttattttagtttttagtctcttagggtttgccaacctattctgcagggtaaatcaccactcttgttgtttctcatttgtgtttacaccacagtaattaaatgaatcatccaagtttgaagtttcctttcccctgtcgtgtcttcccaccccttccccagtcttttcagtaagagtatggtgctaagaaaagtgggaagaggtcagtgtacccctgatccctggtagagtattgaaaaatagcaagaaagggcacaatgaaagaatgaactcaataagaagtaaatgatgctttggcccctcgcatgatctcctaatgctctttgggtctcgtggtgctgaaagacggcagaagactcattctgctttcaaacccacggcagcatattacagcatcagtgacatcctggctgatggtgccacttaatcatcttggtgcttgatgcataattctctacttatttctgcatatgattaagtcgtcattgcagaaataacaaaatgcaatttatgtaatgttttacttacattttccaaacttaaatgttgataagagtcctttttatagaaattgttaatagtatactccaaatgataattttttgcacaagctgtttctatgaattggatattgaatttaatatattaaacctccttttgtgaaaatttagagggctatgaattttttctcttggtattcccatccagataattctgaaaaatgtttctaaatatcagttttatctgaaatgtcaaggcataaatgataataatcaagataatattgcatttatggtgatattaagctaatgaattcactcatagcctttaaaatctttttttttttttttttttgagacggagtttcgctcttgttacccaggctggagtgcaatggcgcgatctcggctcacagcaacctccacctcccgggttcaagccattctcctgcctcagcctccggagtagatgagattacaggcatgcaccaccacacccggctaattttgtatttttagtagagacggggtttctccatgttggtcaggctggtcttgaactccagacctcaggtgatccacctgcctcggcctcccaaagtgctgggattacaggcgtgagccactgcgcccggcctaaaatctttaatgaggtaatgaatacataaagcagaaaaccttaatcagagttactaattatccttgagagggaaaatgcagtctctggggtaattttatgagaaatacagcttccttgagttaacaatgaagagctttaaaatcaaatctcatgttgatttcatcttttttttttttttttttttttttttgtgagatggagtcttgctctgttgcccaggctggagtgcagtggtgcgatctcggctcactgcaagctccgcctcccgggttcacgccattctcctgcctcagcctcccgagtagctgggattacaggtgtccgccactgcgccctgctagttttttttttttttttgtatttttagtagagcaggggtttcaccgtggtctcgatctcctgacctcgtgatccgcctgcctccacctcccaaaatgctgggattacaggcgtgagccaccacgcctggcccaatttcatttataatccattcaacaatcaaataatgcaggccgtgtgtgtgttagtcgtcaaaccacaacttcgtgctttaggaagcagctctttgatctgcatcttttttcttttctttttttttttttttaaacacgtatggaacattacagagtgtagacatgtttgccatattattcattatgagctttcagtgtgctgatgtcatgctgctgtctcccaggatgttgcagaactgtagtatacataatacttgctctatctcttagagctcccagggtcatttagcatatagaattttttttttttttttgagacagatactcattctgtcgcccaggtttgagtgcagtggtgtgatcttggctcactgcaacttctgcctcccaggttcaaggattcttataccttagcctcccgagtagctgggtttacaggcatatgccatcatgcccggcgaatttttgtatttttagtagagacaaggtttcgccatgttgaccaggctggtctcgaactcctgggtttaagtgatctgcccacctcggcctttcaaagtgctgggattacaggcataagctaccgtgcccagcacatatagaacatatttatgaaaacattcagattaaatgtttttcatttttatgaaaacattcagattaaacatttttatgaaaacattcagattcttttgctatcaactttcagcaagagaatgggtctgcctgtttgtctctcctttcatacctgtttgcctctaggaagttactggaaagaaaaatgttgtttatgagacataatagcattaattttggcagaaattacagcttagacagggcctcaaaagcattttccatgtggctgtggacctcccaggaggcttgaaccttacctgggagagcccagctatcgacagcacttgaggctgttgctgatatcactttgccctttgtctgtccatttctccttctcccacctccttttattgtttgggttttttgttcttttctttttctgcctaagtcttagcatttctattaatatttaaagacttttttttttgttttttttttttttttgagacagagtctcgctctgtcacccgtgctggagtgcagtggtgtgatcttggcttgctgcaacctccgcctcccaggttcaagtgattttcctgcctcagcctcccaagtggctaggattacaagcatgagccaccatgcctggctaatttttgtacttttagtaaagatggggttttactatgttgaccaggctggtctcgagctcctgacctaaagtgatctgtctgcctcggcctcccacagtgctgggattacaggcgtgagccgctgcgcctggccttaaagactgttttaacctactggtgaagttatgatagttttactgatttataccatatactcaaaactaatagacttccatcctcacctccccaagaaacaaaatgactaccttgttaacagcagtggctttacaacaatttaataaaattattggttcactctttccgaagaaaatgtctgaaataaagtaaatttgaaatgtttctttgaatggtcaattcactgtcagtttttgttttaattgtaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggtatgtagtaatattccaaagaatttaagcatcatcagcattaaagctttttcatgagatgtttgcagttttaaaataaggctgtaattgttattgtgctctggaaagcacttgtattcactacgttactgtacgctccatagagctgcgagcgttaaggcatcacagagcatgctgtgtgagttggtgccatgtgccgtttatagtttgattttatttgtcctatactgttacagcttattgaataattgtaaaagaattgccatctggaagattttgattaattgagattttgaaactagcctttaaagactttccaggtttttggttttataaatgtgcttaatttcatggttctataacaggaaatgacagcctgttgatgtctgtttgtacacatatttaatatgtgtaactccattccaagtgttcttaatgtcagcactcaattaactgtcatctgtttttaaccaccatatatttttaatatctgtcacaagaataacaagccattagtatattactttttttctctgtaactttttttctagttacaagattttgctgttttgttgtcatagtatatcctagatgtttaaatagttaaaaatgcaacagaggtgggattatatctccttcaaattattgtgcttataagaaaaaattcctataaataatgttttgtttttatttttgtaaagttaatagcctacagtttatttctctcattaattcattttgctgacatccctaggattatgatgacattttatagtctataactgaacaactgtaaaaggcatattctgaaattcaaatcaatgttttcataattttgagaaatgatttatctggcatcagaatcttagcaaaatatggattttttttttttttttttgagacggagttccactcttgttgcccagggtggagtgcaatggcgtgatcttggctcactgcaacctccacctcctgggttcaaatgattctcctgtctcagcctcctgagtagctgggactacaggcacgtgccaccatgcccagctaattttgtatttttagtagagatagggtttcacaatgttggccaggctggtcaggctggtctcgaactcctgacctcaggtgatccacctgtctttcccaaagttctgggattacaggcgtgagccactgtgcctggccaaaatagggatttcttaaggttaattaattatggtttctaattttaggctagtaaattcttaaaggttttatatttttttctaaaacatgctatttttgctgcccagaaattgacaaagtaaacatagattccttgtttgcactttaaattttattttatgtttatttatttttgagatgagatcttgctgtgccacccaggttggagtgcagtggtgccatctcagctcactgcaatccccacctcctgggctcaagtgataatcctgcctcagccttccaagtagctgggaccacaggtgtaagccactatgccaggctaattttttaatttttagtagagaccgggttttgctttgttggccaggctggtctcaaactcctgagctcaagtaatctgcccacctcagcctcccaaagtggtgggattacagacgtgagccaccatgcctggcctttaaatttaattatgaatctgtccattccttagcagaatgtcttagattattattgagaattatttcatcttccaagtgccttttgattctgctgccagagaaattccactctatgatatcagtggctttcttaagcctgatacagaagttgttattctaaaaattgcctaaacagttttcccctgagcaaaggccacttgcttcttgaagagtgaataaaacatggattgaaataaatgttttcaccatcaccccaggtcacagcaaattgatgctgtgtgctactggaggcacagctttctcttgtcatcaggccatttacagtgggtattttgttactgcggcatttgtaaaaaaaaatgtggttgctttttcaaaatggggtgatggaaaagttacgcactttggtgtttcataaaaattaaaatgtcaaactctaggcaatgagcttgactcttattttatcaaaaagtagtgtatatagaatagtaggaccagaaaatagcttattcccaaacataaactgcttaagattctggcagatgtaaaagtagaaaataattgggttttttcctgtttgtttgaacaaaagaattatttttctcttaaatttggtaatctataatataaaagttatgagagtggaggcttttttgcttggtcattaatttagcagaattgcttgcagcaaactcttatttaaagattttggtttttataaatataaatgttttatttttaaatgtaggaagatattgatgcagaatcttcgttttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggttttgttgtatttgctcttaaaccattagaatgtgtaactatgcattctctccgaaaattcccacattgagaagtaataaaatttcatatttttcatttgtaaaataagggaaagttctccagttcatttttttttttttttttgagacggagtcttgctctctcgcccaggctggagtgcagtggtgtgatctcggctcactgcaagctctgcctcccgggttcacgccattctcctgcctcagcctcctgagtagctgggactacaggcgcccaccactatgcctggctaattttgttttttgtacttttagtatagacggggtttcactgtgttagccagggtggtctcgatctcctgacatcgtgatccgcccgcctcagcctgccaaagtgctgggattacaggtgtgaaccaccgcgcctggcctacagctcatttctttcaaagaaaatttgtcagtagaaaatgcttcttaaactttcatatgcaaatgagccacctgggcatcttgttcaaatgcagattgtgatctagtgggtgtggagtgaggtactgacaggccagtgtgaggaggggacttctgctcttcattattttaactcagcagtgattgttgctttggtctgggatagactgtttctatcacttatgcttcctgattgcctccggtgtgcagtccttgggctgatgcaggatgtgaagataatataagatgttagaccctctccagaaacttaattcccgatggggggagacaaatattaattgccatttactttgaaacctaaaatggtcaagattccattttcctccaggctaataaataataatttgcaatatatagattgtattttgtctttgaaacgctgtgaggagatcctcttaatgtggcatggtctgcttctatgccttgcttctgtgtttcttgagctccgtggagataggccccctctcctggcttctctgcttgagccacataaaatgccacttcacagctcttccctttgaagcctgatccagtatgcatttggagctaattactgcagttgacacaactccatctaaaagcgtcatgaaagattctgtaatcactgataagaaaatgatcttgcaaattattgctgtgtcctcctttattgcctctttaccttaacagtacagtttacaataatgtaaatttttttctaatctttcaactttaaccctagaaattgtagatgttttagcagtggttatgtgatattggcacaacataactatataatttgctcaatattgtggtgcatacctgtaatcccagctgctcaggagtctgaggcatgagaatcacatgaacccaggagatggaggttgcggtgagctgagagcgagtcactgaactccagccaggacgacagagtgaaaccctgtctcaaaaaaaaaaaaaaaaaagtatttgcactcactgataaaatgaattgaaaacaagttcagtgacttaatgtcttgttgggtcttttttcttttcttctgtaaaacaggaaatggagcagactagaagtgcagttgatgaggaccggaaaatgtatctccaagctgctatagttcgtatcatgaaagcacgaaaagtgcttcggcacaatgcccttattcaagaggtaaaaggagggcagtcctcagggcttcttagggtagagggcattgtcattgtacagattcagtctctttcttcttaaagaggatacagaaataacctgatcctcagatagcataaagaaatgtttcatacttaatcagaatcgtactcactcacaatttcagtattaaattcagatttgcaggctgggcacagtggctcatgcctgtaatcctttttgttgttgttgttgagacagagtcttgctctgtcgcccaggctggagtacagtggcgtgatcttggctcactgcaacctctgcctcccaggttcaagtgagtctcctgcctcagcctcccgagtagttgggaatacaggcgtgcaccaccatacttggctaatttttgtatttttcgtagagacagggtttcaccatgttggccaggctggtctcgaactcctgacctcaggtgatccacctgcctcggcctccaaaagtgctggggttacaggtgtgagccaccatgcccagtggacacctgtaatctgaatgtcttgttaggccaagacaggaggatcacttgagtccaggagtttcagaccagcctgggcaacacagggagaccccatctcacctaaaaaaaaaaaaaattaaaaaattaaaaaattagccagttgtggcggcacacttgtagtaccaactacttgggaggctgaggcgggaggattgcttgagcccagggattgagcctgtgtgacacagtgagatgctatctcaaatgataataataaattcatatttgctttggctttattttagaggtctaaaacttgctgattcattgagtcttctgtccagttattgaaggaaattgacccatcagatattcattcattccataactatctgagcctaccatgtgatagacagctgggctggtccctgggatatagcacagagcagctgaagatatggcaggcttttttggagttcacagtttaatgggggaagaaatacactattgaaatgatatgcaaataaatgtaaaattacattagcatgcactgaaggaaacgtatacagtactatgagaatgtatttaaatatcctggcctaggggctgctggggaaaactttcttgagaaagtgtttgaactaagagctgagagttgagttaaatagaagcttggggttgtgtgtgagtacttaggttaattagtttattgtttcacttaattatgtatcattattagattttgctgtatccattttccacattgtagttcctattttcatacttaatttggcccatttgttgaaacctcagtacatttgaggcactttaaactgattggttaaaagtcattacttaatagctgaagaactggcagtagtttgacttccacatctcttccacaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagatggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattgattcctttttttcttaaatatttataaatgttaaattaagtcttatcctggtatctaattgtcaagaaaatatactgaaaaatggacaaaatacttgtgcggaggtctacagagatggcttacaagagttttcttcacatcctttctccattttatctgaaaggaaacatctctcgcatgaggaagagaggccaaatctgttcaaccaaggcaccattcagaaagggagcaatgtttggaa

SEQ ID NO: 14027 - DNA, 4900 bp, Human; identical to SEQ ID NO: 12813
  misc_feature (1)...(4900): n = A,T,C or G

SEQ ID NO: 14028 - DNA, 5330 bp, Human
tagaaaataaagctttgtgttagaatcaaacgtgttcaaaaagtccatgagaaatcacatcgattgtaaccgtctatgaggtagtcttacctgaggacactggctccttgaaattcctcttcaagtacaacagtattgtgttaattttatttcctaagaaggccactactatactcaaacttacagttttctctttacatgtctcaggcatccaccaaactccctcctcccttctagactggattagaagctcttcagaagaaacccccttatcacagatacagcccaataaaactttctgcgatgataaaaatattctgtattaacactgtccaataggtagccactaaccatatgtggctactgagtaccgtaatgtggctagagtaagtgtgcaaattaatttttaatttaaattaatttaaataaaaatgagcacatgttgctagtggctaatataggacagcagagctttaaaacaattattctcaaacttggaagagcatacctaccacccacttagagatctcattaaaaatgtaatatcaattccattgatttggggttgggcccgaaattctgtatgtctaacaagcttcagagtgatgccagtatagctgggatatggctgctccgcccttaaatacctgacagtaagtagaagtatgctggtctgatatctgccccctaaccctgagtgtacttttccctttactaaacttttgagttctttaagagaataaatgtgattatctttgtaaacctggtatttgtacactattcttggcatgtagtggacattaaattgttgaatgaatgaatgatgcttgtttggtgcctacctcaaaaaggagagcacttgagatccttgtgtctattcctacaggtaactgaacctaagccaaaatttaagtagactcttaactccacaaaatgaataatcttctcactgcttttaggcaccagcagagacgggatttttaagttacccttgcagtatataggaggcaatgaatgtgaagcagtagactgtaagagttaatgttgaatttttctactacacataccctatgatctgtgtgtagaacacttcttccggaatcttttattaggacagtatttcacagaatttattagtattatttttgttaatttacaaacctttattcaccatgatttaccatgtatgctttagtggcatgaaagcagtggtaggtagcaaggtagtgagactccagaatcgagccaacaatacaatgccatttattagaggataatgtcttcaagcctgggattccttatctttacacctcagatattgcattatacattgaaaaactaagaatgaaacttcaattaatattggtttcccttactagaggtctttctttattaggaatgccaaaaacgatgtgaatgtatatgtctctgccaaacgctaagtctcatgattggccaaatttaagaagtattgctacattttaagaattaataaaaatggccgggcgtggtggctcacgccagtaatcccagcactttgtgaggccaaggtgggtggatcacctgaagtcaggagttcgagaccaccctggccaacatggcgaaaccccgtctttactaagaaaatacaaaaattacccaggtgtggcgacgcgtgcctgaaatcacagctactcgtgaggctgaggcatgagaatcgcttgaacccagaaggcggaggttgcagtgagccgagatagcgccactgcactccagcctgggcaacagagtgagaccccgtatcaaaaaaaaaaaattagtaaaaatacattttcaaagaatcttcacatttaaaaattaaagctaggcgcctgtaatcccagaactttgggaggccgaggcgggtggatcacctgaggtcaggagttcgagaccagcctagtcaacatggcgaaaccccatctctactaaaaatacaaaaattagccgggcgtggtgacgcgcgcctgtagttgcagctactgcaggggctgaggcagaagaatcgctcgaacccgagaggcggaggttgcagtgagccgagatcacgccactgcactccagtctggggcagagcaaaactgtttcaaaagaaataataattttattctcttgtctatccattcggtagacaagtgtagcgttactgcctcctttttgcaaataataaggattttaggagacagacattatcagttcgagagcccacaggcactggactagaagacacagaaacctacactcaagacccaaacaaggaaacaggaaggagtcaaatcaacttgcatttcccctaccctcaccgccccctttccttcccaaggcaatagtgtaggggacgcccagtaagttacggaaaaggcggagacagaggtttcgttcccgcccctccaattcagtctccaaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgctcttgtccaggctgtagtgcaatgacgcaatctcggctcaccgcaaccaccccctcccgggtttaagcggttctcctgactcaacctcccgagtaactggggttacaggcatgcgccaccacgcttggctaattttttatttttagtacagaaggggcttttctgtgttggtctggctggtctcgaactcccgacctcaggtgatccgcccttcttggcctcccaaagtgcagggattgcaggcgtgagccaccgtgcccggccttagtgttatttattaggcatagaacgtgagtaatcttagggcggctgtggacagatcaattactggtaaacttaatccactacttgtgtccgggcgcggtgcctcaggcctgaatcacagcaccttgggagaccacggcgggcggattactagagctcaggagttcgagactagcctgggcaaccaaaatggtgaaactccgtctcaactaaaaaagttaaataggaaagttagcccggcgttgtggcggacgcctgctgtcgcagctaatctgcaagggctgaggcaggagaatcgcttgagcacgggaggcggagatttcagtgagctgagatggtgccactccactcctgcctgggcgacagagaccatgcctcaaaaaaaaaaaaaaaaaagtaaagtttggccgggctcggtggctcatgtctgcaatcccatctgtaattccagcagcttgggaggccgaggtgggtggatcacttgagctcaacgagttcgagaccagcctggctagcactgcaaaacctcgtctctactaaaaatacaaaaattagacgtagacgtggtgacacgcgcctgtagtcccagctactcgggaggctgaggcaggagaatcacttgaacccgggagactgaggttgcagtgagccgaggtcgcgccactgcactccaggcctggggcacagaacaaggctccgtctcaaaaagaaaaaaaaaagcccaagtttttgtcttacccagtgaattctttgttggggcacttactgtgatttcaggtcattgataattttactgctttatttctcaagtactggtaatttataacccaaagtgtttctccttgtgctttgtcaacctacccggttatcacccgcgatcctgactcctaacgttttcattttttcaccataccgaagaagtggcttctcatctgttctttttttgtcaatggtaattcattacatacactgttccacaaatattcttcaacttggggtttcctcttcaagaagcctttacctgattcctatgggcaaaatcggtgtctggggtttccttacaattcacgaagcacactctacacatgtccctagccctacttcagaattccctatacgacttaggagctactgcacacttaaatagttgggagtaattcttgccctcttcccaagatattttcaggtcttgaacaatgtctttaatttagtatcctcaggatgtagtatttagttcataaatgtttgtgcaatgactgaaggaatcaatgaaattaagctatctgggccatcaccaatataccgttataaaaatcattcccctttaattaagcaatatctctactcccacagaaccatcttctctattcacctttacacaaatgtcaatattcatggctgccaacaatttatattacagactttttaaaatgcagattgagatccattcacgggtaatgaaaataatttagtgggtcccaaccagcatataaaacgtaaatagaatccaatataacaactagaaattatcaaagtatcccatctagtaagtaaaaatattgtgtcataaaattttagtttcaaatagatgtacttttggttttactttggaacttgaaggagaaaaggttcaaaagatactggtccatttatttaatgtatatatttgtcaaattctcaggttaggacattgcctcacttccctgggtttcagaacttcaatactcagcctcatttgcagctggaatgcagatctgtaacctaggcttcaccaatgagtcacaggtttaaaagacttatcttcaaaaatgggacccaggagagaagagactgcctaaagcctctgtttctg

SEQ ID NO: 14029 - DNA, 4720 bp, Human
tctgttgcccaggctggagtgcaatggcatgatccagtctcactgaaacctccgcctcccggttcaagcgattctcctgcctcagcctcctgagtagctgggatgacaggtgcacacaaccatcgatcagctaatttttgtatttttagtagaggcaggttttcaccatgttggccaggctggtctcaaactcctgaccttaagcgatccacccgccttagcctcccaaagtgctgggattacaggcgtgagccgccgagccccgatggggatttcttgacaatgtcccagggtctcatgggcaacaccctgcagacccgcttttcctgcctgcagcctgcactgcttaactgaggctcagctctctgcagaagaagaagcaggttttgcctactgattctttgctggtttgggacgctgaagtgacttgtcatcagcagagacgcttcccttttctcccttcagaaccaaaaaagaagctgagccccaggtcgcccactggatgggcgcagccagggctgggacctcctaatgctcgctgctaatgcccggtctcgctgattaccttgccccaggcaggagagaaaagctagtggtccactcaagacttccactcccttccttttctgccttcatcccttcctttttttccttcctttctctgtgctcccccttccttgctttctccttcctccctccctcctcttcttccctctctccttccttccttctatatttcctagtgtttttttttgtttgtttgcttgttttgtttttttgagacggagtcttactctgtcgcccaggataagtgcagtggcgcgatctcggctcactgcaacctcagccttcctggttcaagcgattctcctgcctcagcctcccgagtagctgggattacgggatgcctggctaatttttgtattttagtagagacggggtttcaccatgttggccaggctggtcttgaactcctgaactcaggtgatccacctgcctcggcctcccaaagtgctgggattacaggcgtgaaccaccgtgcctggcccttagtgtcttctatatgcctggccctatgttgatgctgggtccttgtcccgaaaaagtatcctggattttggtatgctaagaattctttaaaagcctttgaaagggctcagcattcccatatccctgaaagccaggtagcagcctctgttttataataaagtcaccctcggacagccctcaccagtcacaagcaggcatagtgaatggggagcgtgttgggagcggaggtccgtgctggagaggagggatgctggcccgtgctcctgccgcagctcctgaggagctgtgaccttggaaattcctgccccggcatcagctgacaatctctaggtcacatccagctctggaattctgaaggcagcatctgacttgccgaggggactaaacctctccctgcccgagcacgtgggtggggaagttgcctacttcagaaaacccctcatcctgacaaccgcccagggctatattctaagtcacagctggcacacaccttagcactgtcagtccaaggcatgaataatacatgttgatttaacaactgttattcctggttactgatgaaccaggaaggacaggagatgccaatgcagcagcagtgctcaagggtggacataagcagaacttccggcaggtggctggaacccttccctgaggccagcgtccggctgtcatcccttcagatcccaccttcccaggaaagcagttactctcccacccagtgaagtctcagaaactatttttgagaacatgctaattgccacaccaaccacctatgaaaaacttggtttcggtgacagaaataagtgcatgagataatctttaacccatttcctttctctccctgctcccgcctcccttggcttcattagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaatggacagtctctgtttctgcttccagactgttactctgtctcctaaggcgctggtaaccacagtcagagcccactggggctcagggtcgcaggaccatgcagccgtgctgaccacagcaccgtggagtcctgactccgatgcggggtggggacgttggaggaagacggggctgatctccatctgtaagacgcttgaaaacactaggagctgcatcccggcttgaactcagaggcagggcagaagggaaggggcttcctcggaaaaagacagttgccagaagtcacaaaataaggacgctgtttttttcttcctgtgagcaataggtccccactggtaaaaaaacaagagtcagaaggaaacggggccgggcatggtggctcatgcctgtaatcccagcactttgggaggctgaggcgggcggatcacctgaggtcacagtttgagagcagcctgaccaacatgctgaaacctcatctcttataaaaatacaaaaattagctgggtgcggttgtgggcacctgtaatcccagctactcaggaggctgaaacaggagaatcacttgaactcagaaggcagaggttgcagtgagccgagattgaaccactgcattccagcctgggcgacagagtgagactctgtctcaaaaaaaaaaaaaaaggaaaaatggagtgaaacatggttggtgtcttagctttctaggctttggcaaaaagcccagttaggagcaccacttgcccccaagggccccactgggacttcactggcttcttttctggggtggccagtcctggatgcaatgagaacaggtcctagcatctgtggctgttcctgcagctgcgaaaaatgtctgggaagctgggggaggcctgatggctctgagaacactgctgatccctgctggccatgatctaagtcacatggtgacacacaccccccagcagcccagggagcctgggcctgctctgacatccacatgggctcatgtccttggcccacctcggacagcacctgctcatgcctctgtccccaacctgaggctctgaatgtgggaggaaacagctcactccatggaagggcttggcctgagacctacacacagaggggctgtcacgtgaagtccctctattctctgcagtctgggagtcagggttccagcagtcactgcatgcagggaagagccgcagtagccagctggccaggctcgcttgaatggcctgctgagaccctggtatcagtgccagggaggctctagtacagtggtcaagaggcttgagaactggtgtcgaaagggcaggccaagcagcccacagcccagagccccggaatcaacaaggcctgaggcctgctaacgctctcctgacttggtgcctcctcctggcctgagtgggtcaggcacctgcttctccactggccaaggctcacaccggtaacatgtgcccaccaggcagccctcttctgattgctttaggctctgccatttatacctaataaactatgttgtgataaaatccctcaggggcctcctagcaatattgaagagtggaggattgaaggaacagctgtacacatacttacatatttcttttttgtttgtttgtttgagatggagtcttgctctgtgtgcccaggctggagtgcagtgg

SEQ ID NO: 14030 - DNA, 11231 bp, Human
aagatgtctacacattacaatattgtggatttttatgctttacaattgagcttcttccttcgagtttctttgatctaatcaagagatagaaggcctccagcttcacattcctcacgattatttacaaaaagaaggatggctcagccaaggctaaatttaggttacagtccctaatcttaacacagtttttaagtttaggtttcagcttttgggatattattgttaccttgaaaaatgtcacgtttaaaaacacctcacaccctctactatagattggatcttgggaaatagggttgaggaccggatcaatacaagaatcctcataacctccgccccggcgcgaacctgggagggctgcagacagtctaaaggctgtggtgacctcagcgctgcgtccctccagcaaccggcgagtgctggggcacaggccatacccccctaagctcggcatcgcctgcacctctcacaggtgctctgtccgccacagtaacgcactatggaaaggaaagttgtacggcgaacgactgaaggagccaaacgaggtggatctggagcggccgcaaggtgcctgtgctgctggcttttaacacacaataagagtgccaagggatacaagaagccacagggggaaaaacaagtgacatatctgcatggagcctaaatttcgcttggtgattttcagggtagaagcattacatattaaaaacactgctattttaggggaatacagaatttaaaaatccacacagattcgcaacataaaacatgccgcccaaagacacgtccgcggtgtcccgacagttccggctccgcccgcgggccacgaggcggggagcgacggtcactcccctcggttacccggagtacttgggcgggaacgggtagctcgcgggagagacgggctcctgggcgagggctgcgtcttagtcgccctgcttcttagctctcgaggtcccgcgtgttacgtgttagcaccgcccgggggcgtcagcatgacccgaggctgcaggaaccgtgaactctctgccccgcgggcccaggtgaccgcgggcggcgctctcccgcgcgcggggggcggggctccccccggctgttcactcagctaccacagcgacgtaaaatggtgtccgctaggcgtcccaggacggcttcctgagggactggagggccccgacagccggaaagcctgccccgccccttggccggcacaggtacgacggcggggagctcagaagtttcgaactccaagggccgaagcacagccaaacaccccacggaacttaacaaatgtttgtggggagaacgccgaaaacgcggggaggcggggctggcgcacagtcaccctctcgcgacatctaagtgacgtcgcacagcaagcacgtgttctagtctttcaccttcagtcagcctcctccgttatacaggcctacccctttaagcgagtgatggacagttatttcagcctatcaacttccttgccgacatccaatcagatttaaacttcttttagccgccggaggagttggaaaaagggggtcgaaagagggagcttaccgtctctcgcgatatcgctgtgagcctgcctctctggaaaaaacgccgaaactgatggcccgacctcccaaatagtggtttaaaggacgggtttataagccaatgaaagggataaggaggtgggttgctgctgtcactgagcaagaagtaccgttacagggcagactttttgtccaatcaacacctcaacactttgggtcacgtgaccgcagagtgcgaggggcggagctacagtctggcgcgaggaaccgttaagatagacaacaaatgtaaccaatgaggtactccgactagggggttgggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtggtgcgtcctaaagtccatgtgtaacttgtatttactactttgacatggttcctgttttgtgatgtgtaatgggatacagcatcagatgcaattttctttttagttgttagttgtagcattttcttttttatatttttataaacgtctttaaaatagaaatcaggacagtttagctatttttttgtttgtttagctattattttaagtgaaagggatgccctaaaggtagcaggcaggcagacagatttgctttaattaggagttcccacccttatgagtaattttttttctctattcagttgttttttttttaatcttgagcttaaaaaatcctcagagttacaaaaccaaaattttgaaaagtcagaatttggagaaaggagtccactgaccatataaagagagtaatagccacctaaaaatgactcgattggtgtgtaggtaaataattcttttaccagaaatgtgtgtgactgaaatttgatcagggatctcaaagatatgctggtaaattgtatagcaatgtaattattttaatcaggtatttgagtatttcttaagatacagtttattcccagagagtttgctttaacatgcattttttaaatcatttgttctagagttctgtatcccatatatgcacttttggtttgtagcagtaactgttcagtaaaaattaaggactatgttacaaaccatatatgtcttatgcttacactagtatgcaagaagtgagtaggtgcttttaaaatcagaattctttggtcagttattggtgtgtggtggtgtttttactgactttttcagagaggtgtagcaggtacagttctaatcgtgcatatttcgaaactaagtgttcttcatcaaagatgagtttttgtttttgtatcaattcaaatttctggtttcaataatagaaagaagagttgtctgcaggctcatagtcatcttttatttcagtgggcatttaaatcagccatatttggattgcagaatttcttaaaaagtcatcataaaatgcctttgacatgctcttttaaaattttgcttgtctttttattttcatatttaaacagtagtgacattacattattgaaaatgttttgaacatcttggaaattttatgttcaatattctcactgctgtccagctacggaattgaaatgtcagtgtaggaaaaccttttttaattgttttattttcccagacacccggaattaatacaggatcatttaacttagcctcacagttttttttttttcaaaggtgagatgatatcaacctctggttctcaacaaggacttttgctgcttaacagtaatggattttttttttttaatctatcccctctgtcccacccctaatttgtcaggtcattagtaagtatatttttctcccttgatttaagtgctgaagacttcagctaaggcccttgatatttaattatgattagagacttttggaccttctggatcatggtcatgtttctgttctatgaaagtgacttaacttgaagcctggcagaacccaactgttttctttctgttatcaaagctggtagttttgaaatagcaccaataataacccagggaaatgtcatgtaatttttattttccattatgacaggtgtctaatgcatgtcagcacaaaagtgtcatcactgctgtgtcatccctcttggttttcactatgcatctataattttttaagtttgcaggttttgtgggggtttttgtttgtttgtttttaaactggaaaaactagccattttgagagaaggaaggttctaggctatgagcatgaaggtccttgtgcctcttgggaaaatacctgaaatcctataatgaagacttttgatgcttcttgctttcaaaaagctgtggttggtttggagtagacacctgttcagaaactaatgcaagtgtggagtctacatacgtgggctcatagtataatttgtggccagctacatttttccagtttaaataaactcactaaccattaatttttgaatatcttttgttgagatagttggacaaatgattttgctcttttggagagtgaagtccatgacatctaattttactgtcatccaaaatgtgtgttttatttcttttcttttactttctttttttttgtttgttttttgttttttgttagtgtgacagcgtacagaagagtactgtgtttttgctccatgtttgtttgaatctttacctgacattgccgcttttgttaggtctgggcaatttgtgcttcagtgtttttgaaacaatggcttgataccatttctaaatgtatgtattataaaaaactaattatgtttagttggtcattacctacagagtgccatagtccacatgaacctcatatttgtactgcccattcttttgtgcaggttcataatatccataaagtatctagttaaaccttaagaattcaaatgaaagcaaaagtctaaaaccggttctacttctcattagccaggatttaataatcccaacgttgaatgttctttgtaacaaccaatttttttctatctttcttctttaattattttaatgtagttgatttttctggaactcagttaaaatgaatggaaagaaaacttcaggatatcatttaatgactattaagtattattggtaaaaacgtgaagataagacttttagatcacagcttcaaattttatggaaaattaagcaagcaatacctagccaatagttctgcttaactttttggttaagtattttgttgggattcctataaataatttttcacacaaagttttaaatttctggtgtactttgactctcaactgagagtggatagagtttttcttttgaggattacatcttaaaatgtccatcgcctggctggttataagcatttgtcaccttttgaaggtaaaatatactctggcccttcttgactcagttacaggtcattttaggtccagtaataagagtcaggtgtttggttattgctttcagagtcagacattgtttaggtttatttaaaaactattagcaggttttcactgacaatgcttttttaaaaataaaaaatgtaaatccacttttttaaggcagattgttcattatgcatatacagcttgaactatagtttgggtccatataggaaccaatcaccaaaaactctggtaacagaattaggaaatcctcttgagaagagggccttaatgaccttttatgtgaaaaaaattttggagagaatttctggacatttttttttctgtctctctcacagggtttggttttcagataggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatggagtagtctatgttgctccatataaattacagaatgaaaatagatggggcaaaagtttgactaaactttacctttttatagtttcactttttaagttatatttagaatatattgatagattataaattgattgtgaaacttttttctgaattttttcaacatgttttactcagttacatgagttaaaggatattttcagtcctgttatcttcaattgcagtctttaaaaaaacccaccctattgttctacttgttatatgtctattcatacagtaaattcatttcaaggtttatgccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgtacagaggggctcctgagttttggaagcctgttcccagtacaggagaacaactcccctgtttgcagcaggagacttcagtgcacggtgacaacgctggagttcaagaggaagccagcaatgctgcaccattggcttcagacaccattgttgttgtttgccagttttaaacttaactagttgcagacgaagaccaccttgaaatgcaggcttgttgggcttgttttgaattttaacctcggatggaagagccctagtgctgtctgtctccatgcgggatgatgattgctaggcaacaggtgattatcaacaaaggatgccacggttatactctgcaaggtggtgttccagtggcaaacagctgtataaactcttgtaaacaggtaagaggttttttagaggtcaaaatgcattataattaatagggtgagggcttttaatgttttgggtctgtttctctagatggaagccttaaggcactctgctgccattactagcttccttcaccgaagtgtcatatttcaggtcagaacttttgttctacttgatatttttaaatttatttttaacattaaaaaaatacttttaatgtgggagccaaagttttaaaatcttggttatggatttgggacctatagcctttatgtcctttaaaattttgacatttgctgttaaccttggcctttacccttagtcatgatttaatgatgcaggaggacttactgctgtaaaaacgttgcttgtttacgaatactgatttctaaacttcagagttaagacattacagtgtataacagcaacaaaagtatgccatcagattgtgaatgatacatattttagccaggattttttctttctttctttctttttgtcccacagagagattataaaattaggcaaccttaactttagggaaattaataagcagtgttgagaagtctggcttttttttgtctccccttaacattttcagtatttatttagttttaccagccttctgagcccttcttccccacattaatcaagtttgaagctttggcaacttatcacaagcccagcttttttagtatataatacaacttaggtttccttgctttatttcaaatgggatcaaaatttttgaatagaattgttatttttttcatctcttctggaagacatccagtatc

SEQ ID NO: 14031 - DNA, 15664 bp, Human
tctctacctacgactcagaggccacgctggaggccctcagcaggaaccccacgggcaaccttcccacattcccacgggacatcttggtcggtgtaagtgcaacagccacagagccacagggtgcctctatgactccaggatcttccatggttcataatgtcccagtacagatgagaggagggacagagtcagagaggctgggttgtatgaacactggtttattaggtagataggaaaagaagaatgaagtcaatagtctttagcaagccaactagctcaaggaatagacagcccctttccattctggagacaacacagaaatctattaatattaaatattgtcatgaggtatgcacctgcccacaggggtattatgatggaaatactggggtagtctgcagggccaggtacaaatgacgggaaacaaagccagagaaactgaaatacctcttggaccccagaagacagatgtactgatttctgggatgtcaggagcccagtgcagagcagctggataggtcgctaagagctttcccttctgcttatcgggtctcacacacctggataaaccagttattgaaagctgacctgctaatgagaagcttctggcacttgctggtgtttcctaattgaatgggtgactgccccgcatctcagggccggggctcccgtgcggacgcctctccatgaggttagcagcttgatttagatcagcgtgcgggacggggagctcacagtggggtcgaggagacacagcacaggcttctgaaaggtgccctgtccattagggagcaccccatttacagatgggtcatccttcagctcactagtttcccagcgcatgacagtgggtagcttttttttttcctattataaacaaatcttcgatgtgactgcgatgatctacggatgatctacgtatctggttgtgtgatcctcaagcacttatgcaaggtggagtgtaaacaatggccaagacccaaactgcaatgttccctgaagtccaacctgcttggagtccttgggaacgtgtacaatggttaacaggcttgagaggagtcagctgggagagtgagagcgagactgccctgcagaggggccgctgaggatggacccctgtaggccgtccacacccaccacgcgtgtcatcctcaggaaatgcaaccggatgctcggaatttcgcccctaaagcgactcagggcagtctcagctcaggaagacttctttttttgaccttctggcttaaagccacaaccccaggctgaggatgccacatcaacggcgtttcctcgccacgctgcaggcgtgactcacgtttctaagcctgcagggtccccgggccaagcgcggctactgagagcacagcgtcctccctcagcccctgctcatctgcacggagcaaagccgcagctttctctgctgtcagcgctttatacgactcggatgtaggctctgagcgggcacgggcccgccctcagacggcgacccgaggggcaaacaggatggaggcgcgctcccttggaggctgtggtctcgattttatctgctcctgggtggtgcgggtggtttgctctctaggcgtgagcaaaggccacaaggggcccgaaaaaatcacccaaggatgcaagcccgccattgcgctgagcaggggcctccccgccgccagagcccgcgcccctccagggaggcccgcgcgatcgagacccgccgcctcccgaccaggcgcgggacaccaggcgaggggagacaggagccgggaggggaggggccgggcccgcaaccccacccagtcctgcctccgcctcctcccggtaggaccgtcccctcccaggccccagctccgcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgcggatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacgcgggtcccgctggggccggggatgctgctcgctgtgagcgcgggtcccgtccgccgctggccccgggcgggcgcacgggggtctaaccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtgagtacccctcctggttcttctggaagtaaaaagggtgtcttttcggttgaaagtacttttcagcctataagaaacatgcatttgaaactggaactatccacagattgaaagtgtgcatctccagtcttgggatttagagaaatgaaggaggggtagagaggacctggcacccccgagggcgggttcgggccacagctctctgaagtttgaggaagcacagtgatggagatgaggcagggagataattggctgttcaagcaggtgctgtgccaagctgactgagggcccttccctcctggcgtccgggtacagccccagctgtcatcccgcgccagccgccccggattggccgcctggggaactggtgagcagcgggactgaaaggccattggtcgcggcagcaaacatgctaccctgctggataactgaaaacaaacccgtcacatgggttcaggaggcggttgccaggggagcaacttctcagcacttccttttgccgggtcgctgagtaaactgtggtctgaagccaaaccgcctacaccctgaactgttagagctctgtagattacgttcttaaggaaaagagtaacccccttacggcgtttagattttcgtacacccaagcagtagcatagatgctgtacaacgtaacactgagtcagtctgaactgtggacacggggactgctgggtgtgtgtactagactttcttggctatcattgaaccgcttttatagaaatgttgagttgatcttggctcagcagatcacttactgctcctgtagtcacacagcatttgtttatttaacgagcttgtcgggtgctttctgcaacctcaactctataagctgttgaaatgttaatccaaaagtgagcaccacaagcccctatccttaagcagcttagagtctggtggggaaaacaaaccagtatgtcagtgactccagtgcagtgcagggagcatcctgtttgctttgtggctgacgtttgtcagctgactgctgaccataggcttcagatgctttgctgtgttcattccttacagcaataccatgtgtagcttcatttatagatgtggcaactgaatcacaggtgaagtcacatccaagggtgcgcaggtagaaaggggccaagccatcgttggtaactgctcctgctgccttggtaggtgtgtctcctgcactgtggaaacacattgcctcagttgactcactgaaaacagcaagcagcagagaggtttgtagcagattaacagagggctccgtgttgaagaactaggacaggtgtctgtaattattaagtagtgggtagaatgttttcatatttgttctcggagggacgggatcctctttcgtttttcgaaacactttatgtggctgtactaattgaacattttttgagaactatatctagatttaaaattccatgtttcatatacatttggcagaatagtttctttcctttaaccaaaaacttgatcttagaaatgaaatagtttagccttcagtatttgtaattggatcctcaagggtttctaggaatatctggacaatttctcatactctcatattctacttttttttaaaccatcagccaagagcataagtaaaatttttcatagtatgttttttacctatttatttattaagctatagtgaagtaaagttaatttggggggtccatttttcagaactccaaaattagaacctgatgaagtataataaattgaaaacaacattttttatctgaatgtttgatgcaaactgtgtttcttgtttctcagttgaacctaaaaggtatatttctttcatactagactgaggtgaaacaattgcagggttctcaagagccctgggacacagtgacccttgtgtcccagcatccaaccccacgggccggcaccccactcccccctacagacattcattcctgccttcatctttggcattttacttctcttgggggaatgccattccttcccacctgtccaaattccaagttcgtgtctataaagaataactattccagaccacagtgatctctttctctgtgtcccagttacataatccttataattttacacatgagaaaacaaacatgcagagccacgtcccatcagagggcaagctgggatttgaggctgagttttctcttcttggtctggtgttctttccgcagcttgaggcttgaccatgcgggaaccagatggagaataagcgaagcctgtgtggggctgtctcgccccgtacttgcccatgtgcatgtgtgcacagtaggtgctcagtgcctcgtacagaacatgctagaacccccgaaaatcaactccagggtcactctaggagcatgtgacccagactgtcaaagtcacatcagcaaatatgtatctcatcacgtgccccaggcccagtactgggtggtggggaggagtgtcaagagctgtgatgtgacagggggtggacagatgctaacctttttattgtaagatagaaatcacaccggatgaaaagacaaggtgaactacatagtcatttaagttctgtgtgctttaggcaaatgtggatattaaatataaggttacatattgctcatattaatatgaataatccctgcttgattccttcctgtgtttactgagacatgttcaactacactaaataatagtgatttttaaaaaacttttcccaaacagtacaattttgtgggagtggtactcaaagagaacaagaatataaaatcactctgaagttatagctgataattttttctaggaaaaggactggtttgagtaatgtactgtgttactaatgaccacgttgaaattctggaacttgaatctgctgtattctaacattgtcaacttttttaaaacagctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagagtatcttcttaggttatatattgaagcgttttgttttgttatatactcaaatgactccatgtcataatacagacatgatggtggtacctacccatttcagattactaaaaagagaaagaagaatggggctatcgatgacttcacagtaaaatatattgttttatggtcaaaataaatatatatttatttatatttttatatatattatatatatttttaaatatatatataatatacataataaatatatatttatataaatatatataagcactttatatatagctttcagcaagtttattcttatggttaagtttttgactcagtgatggcagggagatttcaggtgatcttaatgattactgtaacctgtatccaacaaatcctttctttagctcattacacagtttttatggacagtgaattatctgtggtacaataataaaatacccatgtttttaacccttgtggttttacgtttttttatcttaataagagtcagcaaacttttccttaacttttatatcaccagaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggaaagcttacttaactttcattaaaacatccactaagcttagatattttcatattttatttgttttttatatagaatgatacagatttaggcatgaaattctcaaaaatgctgctatccataacttaatgtaacgcaaaggaaaaccaagtagtagcagttacaaccaaacaaatatgaacattcgtaacattggatggttgatatgcgttctgcatatccccactacagagaatctgtgatgtagaattgagccaggtgaaattgactgctaaggtacagtttcttttctcgctccaggtatacatccccagatttcctctatattcgttcttggctcccttgtatatttttctcaggaggcgtcacggtggggaacataggacgacagttagctatggtaagtgaaatgatcatattatcttctaaaacttgtgtctctttaccttgatagaatgactttacatgatacattcaaatttgcgttcatatattctggttcagacttgagtgacaactactgagaaaagcttatatttaaaaaaataggtaatgatacccaggtaattctttgctaaattataaaaattcataatatttgatctagaaaaggaactagagccctcgcactgcccctttgaattgcagatgtggtcagtgttctgaattcttgaaatttctgtagtaagcagtagagaaagtgactggtgtgtgagtgtcccctcctccttcaccatcggaagcagatctggatgacctcatgcagtgatactttgctccctgagcatcagtccaccagtgtttcttttcacaaaatcagagtggatgcagatgatgctggcctcttagtccacagtcaagcaaatcgagcctgaggctgcagagtctgtctcgggccagggcagggactaatgtgggcgggcaaggggacagcctggttcaggcaggcagcacctttctgtggggcaggtggccctgggcatggagaagtggtgatgagagcaccgctgcacgtggccgggtcaccatgtagacggactgtcctgcctgaacattgcatctgttctcagctgcaggagaaagcagtgctaccccgcagagcttctctcacagcccccctgagggagacggaaaggtagtgaactccaggatggctttagcagttctcattagttaaaaattgacatcttagcacttcaatttaaaaacatagaggtggacttttaaatgttattttgagttgactttggcaggctgaaagaaagtaaattaaaaaaaaaaacaaaaacctagagctgttgctctcggagataagctctgggaaaacttatcttagtacctcatgctatttttaaaacagtacatttatttttgccagctgatacccttctgtgaggagttgaatttgaagaccacttggctgtttcacaaaaccagaagtaattacaggtagaatttgcagtcttccactggttactgactctctgctgccaaatttctcatgatggagaagaaaggactttgcttgccttttttttttttttttttgagacagagctctggagtgcagtggtgccatcatagctcactgtaaccttgagctcccggactcaagcaatcctcccgcttcagcgtcccgagtagctgggattacaggcacatgccaccatacccggctaacttttttgctttttgtggagatgttatctccctgccttgtccaggccgggctcgaactcgtgggctcaagccatcctcccaccttggcctcccaaagcactgggattataggcgtgagcctggccttgctttttttaatattaaaaatctggtcggatggtcccacatggaaatagtatgttgttttcatgcattcgccatcatccccgttaatagtcttcaaaggagagctggcaactccatcattgctttcttgctttgagatttttgtttcggtactctttgggagagaattcctaagaaggtttttagaataaaattgtcctcaaccagattgactaattacacattataactacaacttgaataacatttaaagagttggttatttctgtttgataggttggtgctgttatatgtcaaggctttttaaatcggttttaagaaataagcattattttggtggaggtagaaatttcacaacattcataagttctaaacatctagaaatggttggaggaaacattttcgttttgaagatagtttcattaagtaatccctgctgtgctcctttgcttacagaaaaaaatgttaaagataactcaaaataggatagttggtgtaattataattctccttacttcagctttctcttcatcctttttattctttaagcttgggggaaaatgtttggatgttctcgtatcttaaaactggaggagagaggctgggcgcggtggctcacgcctttaatcccagcactttgggagctgaggcggccggatcacgaggtcaggagatcgagaccatcctggctaacacagtgaaaccccgtctgtcctgaaaatccccgaaaggaaaaaaaaaatacccaggcgtggtggtgggcacctgtagtcccagctgcttgggatgctgaggcaggagaatggcgtgaacccgggaggcagagcttgcaatgagccgagattgtcccactgcattccagcctgggtgacagagcaagactctgtcgccgaaaaaaaaaaaaaaactggagaagagagatcaccaccttaatccccttccctactgggctatcacatgaaactgacctctgaggttctaagcctaacccgcctaccactgtttttattcataaatacttaaatccttacctctggatcccaactgttactctttttttcacttcaaaatttgcaaactcatttctatccatcaaaccccggaaatggcccaggggcttcacagtgcagtcccctccctcctgctgcatccgttcctcaggctgtgccccaggttgcattcgtggtgcgtgttttctcccagggcagccttccccacattccactcttgtcatactgttgactcacaaaatggaagtggctgaatgttccagggatagtgtctaagagctattggtttaaggttgaaacctacaccaagtaaggctttgtgaagggagatgacgagagtgaagttgttgacagtctgaaggtgaagagattccgaggctcagttcagcaccgggaccagacccgcccagatccagggtaatttgaggtctgtgtttggtgctgatggttttgcccagtgcactccacaccctctccttcttagctgtctcagttctcttcagatgcctttgttctaacttatgcttccctcccttaagaagaaacatagttacttgcaagaataaccatgctcaaaagttacaagttggctttgcttcaagttatatggtctcctagctttttctatgtggtatttccccccacacatgccgttgtcctttgtgtccgaaaatacagcagaaacatttgttatcagcctgttacggtttttttgtttgctttttgtttgtttttatttttactttttttgagacggagtcttgctttgtcacccagactaaagtgcagtggcacaatcttggctcactgcatttgaaccgtctcccaggttcaaatgattatcctgcctcagcctcccaagtagctgggatcacaggcgcccaccaccgcacctggctaatttttctgtttttagtagagacggggtttcgccacgttggccaggctggtctcgaactcctgacctcaggtgatccacctgcctctgcctcccaaagtgctgggattacaggcatgagccaccgcgcccggcccagcctgtatgtttaaaagaaaatgagtctgtaaccatcatttatagaacttgtagttgttgctgtttgtagcttcaagtcctttctcaagagtaagctgcaaactgccaacagcaatcaagcctgtcctgctgccactgcccggccccactgggccacctggaggcagagtcccgcccacctcagtgtcagcttgggatttgatttgccgttcctgtttttgattgacccaattcagctgctaatgataataatactattattgttattgagggtttacatttgttgggctcttactgctgcacaggaggcattgtgctgagcgtttccattgttagccagtttagtcctcataacacaagtctttgaagtagaaactattattagcccatttttaaaaggggaaattgcagcttaggaagattaaacaacttggccaagtgggtggcagaggtcgacgtggcaccgtgcttctcattagcataccacactgccctttcaacacatagctcgcacctgccttcaccctggaagcaggtttacagcagcctgtgttggtgtctgggttgccatttacaatgtgccaccattaggcaacactgctggaagtccctgtgccacgtgtcaggtccgcccgggctggctgtcgttcgtctctggcgtctttgccaggcctcactgtggcctctgtcgaccagggattctaaaagtccacttcccatttatttatcagcacattagtgaacagggagtcaaatgtgatgaccagttttctttccaggttgctgccaagagtttgctcttttgttttctcaccgcagtttgtatagaaccctcccagtgttcatatctaaaaattggcagtgctttcacatgatcaattcctaaaagcatgtatgtttcctagaaggtcttattgtgtgtgtccccagggtagtaactggcatacctgggtgactcaacccagactcatgactttcttacctgtctgttcagatgagaggctcttgctgttttctggatgagtaatctccgtcattgctgaaggtgaggagctcagctccttcctcttaaagtgagtggagggcaattaagtaacgtgggaagtcacgattctgagggaaaaaaattctgtatggaggtttctcttttgccctttagcagaagctccgtggcctcaggaaggtcatttaatctctctggctttgcttcttcatcagtgaaatactgttctccattaagaatttaccctgaggtgcctggtcatagtagtaactgtagtgtctacctctcagaagctctgtgagggtcagatgaggaagaacatgtagaaaggatttcccaactgtgaagctctgtgtgaattgagggcacacagagcttcagtattacaaagcatgacctatttccaatgtctgtttcaacaaactgctggtaaggtgggttataacacaggcatcagatactaataaaggtttgtggcagaaacctcccttcagataaaggttcaatcccttaaattgcagttagaactttcaggaacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaagtgttgtatttatgtttgctttttaaaaaacagttggggtggtgttctctgtgtaggatgttagaatttgtaatggagaaatattttgcagttcttcaaattttactgaattttgacacaacctcttgggaagtatttgaatcatccttcaatatacacaggacattggttccaggataccccacgtatgcgaaaatctgcatactcaagtctggcacttggccctacggaacctgcgtacactaaaagtcagcccttcgtatacgtgggtttcacattcagcaaataaaccatgtttggttggaaaagctcccatgtatataagtggacccacaggttcaaaccctgtgttgtttaagggtcaacagtatgtgtttttccttatggtagaaagttttaagtgcagcacgagctgaattgaacctgccaccttacccctcctcaccacaggcacccggttttcaggcaggaggagcgggcatgcctggcctgtcacaggggcagcttccctgctgccagccggcgtggctggagttacttgcactcacaggttatcacgatgggatgagaactgaagagatgcgttgagcaccaggaacattaatgctaggcaggcttcacattacttgtagttgtgaaatcgcatgtcagtactagcagagaaaggccttaccttatatgtaccaatccattttataacacagatccaaaccaataggtttctactacatttaaaacatgaaacatccatgtatggaaaaactggtagatctcatgataaaaacatttccctcattacagagacttgaggtttgcctgagattaacccaatttatgtggatcaagtataggaatgcctgctgaactagtctaagttcatgtttattcgttttttgagacagagtcttgctctgttgcccaggctggagtgcagtggtgcgatcttggctcactgcaacctccgcctcctgggttcaagccattctcctgcctcagcctcccaggtagctgggaatacaggcattcaccaccacacctgggtaatttttttgtatttttagtagagatggagtttcaccatgctggccaggctggtctcgaactcctgacctcaagtgatctgcccgcctcgacctcccaaactgctgggattgcagacgtgagccacggcgtctggcctattcatgctttagaataagttttggaggttaaacgtttcctggaatttttctgatctattgagcaagtgatggaatgaaaccatttcattaagggtaaggtgtgtaatttacaga

SEQ ID NO: 14032 - DNA, 46499 bp, Human
  misc_feature (1)...(46499): n = A,T,C or G
ttaactgctgcagacttcattgctctgtcacctcaccttgaatctaacaaatcaaagtatttctgcaggtccaatggtctaaaatcaaatgcttgttaaatgactttttacaacaccccttactttcctaatccatttcaatcttattttttttattgtggtaaaaaacacatcacgtaaaatgtaccatcttaaccatttttaagcatatggtacagcagtgttaactccatgcatgttgtgaaacagacccccggaactttctcatcttgtaattctgaagttctatacccaccgaacaactcctcttttccccttccccctgcctgccccagctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattgagttgctcactggaatctttgttatctcagagtatctcaccgaggaatttggaatggttcatgggtttaacagtggatgttgacttccacagctgcttataattattcgctgtctttaatgtttgcgaccaaaacatcacacacgtggtattgttcattctgagtttcaaaatcataaccaaaaaaaaatgaggccagaatgtagtaaatacagtagccagtctttaacatgcatttaaagagttgagtcatcctagcccatcctacgatggcaagataatttcaaaggggacctcagctgtccacagttgcacctgccttaaaagtcaagaagaatttgttttttgggtcacttccctggtcactttagcctggggatcatttccaagtagtatagttgcagatcttcgaacgccattcctgtgttctgtgaattcaagacaacatgggttttataaccctttgactctgctcagcatctcccagatcaaggtaaggtaatgttgccaagaaccactacttacagaatgtttgggcttttgcttttgcttttcttccttgccccaaatccacatgtccgttctgagaaaagaagctaacaacttcttccaatctgtaaacaggagaaattccagagttcaactgcagctaagaccttgtccctgaacttgtcaacttcttccctgccctcccacctcctcctttcgtaccagccaaagaaggtcttcggtttcctttttggagagccccagagagaagcatttgagcacctactttagccagagagaccactgacatctgggcatgagactggcatctagactttgccagggaggcagctatacttcccaaaagatctggggtctttctcacgagctcataccctctgctggcctagaccctttatattcccccctcggtgctgaggcaaacgatctttgccagcaggggaggtctgaaaggcttaactttgtacactctgaggcaaattctccagaagtaatgttgcattttctccctgccaccaggcacattcccttcccaaggtctagatcagcaggtggccctcccagcgaaagctctgtgtcctatgatccgaaacaataaagctgtgcttgggtacgtgagattatgtttacgatgatggtcatcactccagccctaggaagtttgagaaactgaaaaataagcttagcaggctgcctaggttctgcggaatcagcaggcccccgctgtgaccaatcaagagcggccgcggggagagaaattgactcattcttttcaatttgctgattggctttgagaagtgggcggagctactgtctctgtcccggcttcccattggtggatgaaagttaaaggtgggcctccagcaagttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctggcacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccgaggacgagctggagaggacagaggcgcgatgggcctgctgcagggcctgctccgagtccggaagctgctgctggtcgtctgcgtcccgctcctgctgctgcctctgcccgtcctccaccccagcagcgtgagtaccgacctgcgcccaccgggggtctgggagtcagtgggagggcaaagaggggaggtcggtaggggaacatggggcgctcaggcagtccctcaaagtggcttgtggtgggtttaaagaaatggaaggatttttccagaggaaaccaagatatcttcttcctaaaagctgtcatgttcatctcctatcccagtcccattcccccaaccccatggcccccaccggggtcaggacagagtaggggccttggcagaagtgactgatgggtgttgcaccaagcagcaggccagcctgccccagcagcgggggccagcgacacccatgcaaacgacatggtgcacctgtgtttgtcgggagttcacctgggaccctggttatctgagagcccctggagacacagaaagagctcccaatagtggcactgaggagaaggttgggggaggaagagaaccgtggagccaatccgtggtctgtggtcgtgtcctggtgggcttcgatgaccacagttgaagctctaatcccgaaggcgcctatcaacttcagggaatgaatgtttagggaaggaatgaaagcagaacttagcaggctgccctgctcccatgcacgtggccttgaattatttgtgtcttctgtgttttcttctctgtcctcttgaaggacagacaaaaagtgacacgataaaaaagagataagagcccccaaactctagcccgtgacctcattcttcacctggtttgtgagaacagaggaacctcagctctggctcagcatccagcttgcctgtcacaccctcctggtggtcacctgcttcccttccctccgctgttctcttcctcctgtctgtggcttgtccccttcccccagctggcactgccctggagactttaggaaaaataagctaaaacaggttaatcacgtttgtaggagggggagcaattcttccactctgctccttaagtaacttggtaaccaagattaagttaaaaagttaaacagaggggattaggatggttcttcttaaaaacaaactggcttaaatctttcatagaataaatactccagagtgccagggagacgctgattaaaactgggctgggattagcagacagtgattgctgctgacattcttcctggactgtaccctagtcaattttctgctttgtccaaatgggcctgattttttttctttttgtggcttttcttgtttttgttttttctccatgtaggttgctataagggactgttaccgagagacatactagcctcctctcccaagcagtatcaggaacctctcatatctcctggttgaggcagccccatctttggggaccttggccactgcccacagaaggcacagactaggtgcccagcaggtagagtttcatccatccgtcacccctttcatcaaacttttttttgtagacgcagagtctcactctgtcacccagtccggagtgcagtggcacaatcgtagctcactgcagccttgagctcctggggttaagcaatcctcgtgcctcagcctctggagtagctgggactacaggcaagcaagtaccaccacatgcagctaatttttaaaaaaattttttttgtagaaatgggggtttcactatgttgcccaggctggtctcaaactcatggtctgacgtgatcctcccaaagtgttgagattacaggtgtgagccaccgtgcctggcctgcatcaaacttttagagtctgatatttaacccttaaaattccaaatggattttcttgctctggactggagttgagagcagtgatggagtacctgggcaggagctcctggcctgcagttttgatggttctaagcgacaagcctcagctacattttaggaggagtcaaaatgaccttccccctttttcttgcccaactctctaaaactagaggtccagacactgtttatcatgttatagaagaagagggtacaagagacagcatccataactaagcccttcctcagtgcccccagtgggataaaagttgcatctcaactgcccaagctaaattttttaaaaggcgcccccagtcattgatgataacagataacagacttcaacctccttcccgtgaagttggagtgggatatcactggggtggtcaaactgcgtggaaaacgagcagttccacgcctaagtgagtagctgactaggaaacgtcctacatggggaaatgccactttcgaactctttcctttacttgtaaacgggagccaaaaaatagtagatagcatgtcccttgaagatattgtctgaacactcaccaatgcccaacccccacatacctgctattataaggaaccagtggtgttgttaaagagcctgggggttgcagaatattctctccagaagatgagcgagacctgacagccagcagagaagtccagtgcagttcagcccacgtgaattgaaccacctgctagacatgggataggcgttggggacatcggactccttgtaagcaaactttgcagtatttttggttgtctgaatacaagcttacctcctgaattttgggaagctttagaaggggaaaaatgaagtttatggagattccatgggtgaaataagtggaaactgtatggaaagactctctaaaggtgtctcttgtccattcttctactctaaggaaaatccaggtaaaaaatgatagtaattaatcctgtccttaatacagctgggtgaaggtggcctgatgacttacttcttccagtaacctagtcgcatgtctaacaatatttacaaccaaaatgtttgctttattttacccacattctcctaattgaaaactaaaggcacctggcagagggaaagtcctctttcttttctctctctctcctttcttcttttttttttttttttttttttctgagacagagtctcactctgtcactcaggctctggagtgcagtggcacaaccttggctcactgcaacctctgcctcccgggttcaagggattctcctgcctcagcctccagagtagctaggattacaggcatgtgccaccacacctggatgaattttttgtatttttaatagagacagggtttcgccatgttggccaggctggtctcgaactcctgacctcaactgatccacccacctcggcctcccatagtgctgggattacaggctcttttcctctttctcctttccctttctctgcaccttctctccccacctccttccccttaacttgtaacttgtagccctgtaatgaccagatcaagaaagactaagggttccaggaagaaataagggtccccagtgaggggcagacattttgtctctcaactctttctcttcaactggagttaagatctgccactctgtctctttcccagaagagagatgagaacacgtgggtttgaactcctttaggtagttttatttctatagcaaacagggtatttctctaaattgaatttgtttccaagtggagcctctttttttttccaccattggttctgttgtcttatcagcacttccaaaagttttatcttccctctgatcttttggccccagagaacatctcagtggggagctacagtcaacttttgggcccagttcccatttctcaaaccccaatcccataatccacgaatgtcaggagggcacaaggtccttgccagcccagctgatttaatcactcctgctgccccttactgatacagcgaccttttgtaacttttatgcaagagtttgaggacgcgtgttctgaactcaaggggccataaacagcaagatttgtcaggttccttgatcagcagccagcctcagggcaaatcagacacgagtcctgatggtttacaactatgtaaaaattgaggatcccacagccaacttggattttctataaatgctcttctgagtcacggagcttggtgatgttaccattaacaaggcccatgaactgcagcctctccctagagtaaggcggtaacctgtcttaacagcgttcatcagcataattcagggcaatcaacacaactagagggcaagctgatggagggctggcttctgataagaatgttgtacttaattaccctgtgcacccctaggttgtccagccagcaaagtgagtgggctatggaaaatgctggtgaatgtccaggcctccccttccagatagatggctgtcttcagtctttgtagatggatgtttccatggtgtcaagcggatagaatggagtccaagagcaacgagaaccagaccctggttagggcagtggctctcaaccaggaatcattttacctccccaagggacatttggcaatgtctagagatggttttttgcttgtcacagtggaggaagtgctaccggcatttagtgggtagagaccagggatgctgctcttttacagtgcacaggacagcccccctgcaagaagaaactatgtggccctaaatgtcagtagtacgaaggttgacaaacactgagttaggagctgatgcttcttcatccaaaatgagagttccatgctcaggatcgctgccttcctcttcagtcttcccttccctctcccagggaagggagctccttattaactcttacaggggcctttgggagaaggattcagtctctagatgcaaaacatggtaggacctcagatccaaaattgaagggggaaatggtcaaccagttcttcaagttgcctaataatttatttgattaaaatttactactgaatcaagttgtttcagcaaatagtctaaaacagggggatttaactttgtttattcatttttaaagcaataaagctttttttttttcaaatctcacatgtaatgttcgtatatgaatcaaatgagaacaaagctactccatttgggatgaggctggagagggggtccagattccaggccttgctgatccccctggtatattcttgagacacaccccagatgcccagggctgtaagagcacagtccagaagccaccttttggattgtttataaatctcacttcttactgatccacttctcttcagtcaggcacacaccaatgccacatatcttcatatcttaggcacatgtgtcaaactcaggatgactgatctcagagctcacatgtgaacgaactgttttttttgtttgtttgcttgtttttttgagacagcattgtactctatagtcctgtagtccaagctggagtgcaatggcatatgatcatagctcactgcagcctgaagcccctgggctcaagtgatcctctggcatcagcctcccaagtagctgggactacaggcctgtgccaccacacctggctaatttatattttattttttagagatggggtcttgctatatattgcccaggctggtctcaaactcctgggctcaagtgatcctcccaccttggcctcccaaagtcctgggattacaagtgcaagccccagcccccaccacacatagtgattcctatctccaactaccccaagaacttctaatatccagtcaacttaacaccaattacatcccagtccaagttaaagctttgaactccacttgtatggttttgtgatcatgggtctggtcactgcagttaagttcagtccccaccttggcagtttccagaaccctccgagctgcctggctacacaccagtgcaaaccacacgccaggcatcggtccccgaaggagcagccataatgtcacccaccaaaggatggactcaccatgtattcaccatgctcgcctgccagttcggtttcggtccctgggctgtatcctagtacccgcgttacagtctgagtctgctgcctcagatgccagggttgcatccggacgctcagtggcagtgactattcctgtgaatgacggcccctttccttgccttgcaggaggcctcgtgtgcttacgtgctgatcgtgactgctgtgtactgggtgtcggaggcagtgcctctgggagctgcagccctggtgccggccttcctttacccgttcttcggagtcctccggtccaatgaggttagactacttgtagccccaccccctgcctgggtccctgcagggcccctgaaagagagcctccaatgaagggagattcacccagcacttgacgatgagggggccttgtcacccactggaatgaccccttaacactaagctttggcacctgcagttctagaccctgaattcctctccttccacccatgatcctcatctccttcaaactggctcaaaatttgcctctttcaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacatgtggcattgagtagccatagcctcaggctcaccaaaaagaagagaatccccaaagctctcagcagtgctttcattcctggagatgggtacaaccccaatatcgtggggacccatgtaaaagctaatctgtgaccagaatcaccaggcagttgttctaattgccccctcttctttcgtgaaaaaagaataggtaatatggggttttgtgtctgcctaaagaaaaaagcaacctaaatgtgacttttcttaagagagctatacaagcttgttctccaggcttctctttaaaattgtgaaattaaaaccagcaagggcagggcttgaaagtggagggtagaggaaaaaaaatgatgtttagaaagaactgaatcctaaataaccttttaaagtgagaaaactattaattaagaaacctaatctttgtatttcactataggcagcccaaaagccaacagcatgccttagctttcaagcagacagtgtctctgtttctccaagggcacagtagagatgttgccaggcaacagttatccgagggacgcccctttgtccagagaggaaggccaaacccgtaaggagagtctgcagaggcagtcgcttgggagggtaacaggactctgtgagaaataaaggaagactgtccagggagggactgtgtgtcactattgctaggggctggaggagccagaaagcacgtcttatcatttgaggtgaaaaatccgaatccacctgcctgatgacgtggctttggctgatgatgatatttagtagttgggctacagggagcagcttagtccaaatatagtctgtttagctgaccttcttagctcagattagagggaaatgccagtaaggcagagcacatgggttatagccctttgtaagccagttaactttgcagagaaaacacctattccacaaccacctatgcaccactatgacaccagaatgtgccatggctcacagggggaagctaggctggtgctctttaggagcccccaaatccttgtcatttcccaaacccatctacttcttgaccatcctcttactgcgacttgggttattcttccactttggaaagttctctcccgttctttgacctttaaagtcctactcaattactctctttggtgaagcccttccaatgaccaaaggctgaaagtgttgatcccttctcaatgagcctatttcatgtctttatcttttaaatggtgcatcagatacaccagatataaacttttcatagacatgtgctctccccaccgagattcatgctctctgggatgtacaatgtctatgtctatggcctgtctgtagcccagcaccatgtttgcatcagccctcattcacagctcttgattgcagtgtttcttgacaatgtgtcagtaatgtcatcttcagtgagggaaggaaggcacgtgaataggatcagtgtgactctgggactgtggctgggttccctcatgttattcattcaacatttagagacagtattttctcagttctacatctaccaggtgcaacatgggatgatatgggtaccctgagggtgacaaaaataaacaaaatgtcatctctcccctcttgaatctcgtatctgagctctcactgtctgaagctggatatgttctgcagtttctccagagaaacagaacgaagaggagactagcgcgcacgcgtgcgcgcgcgcgcgtgtgtgtgtgtgtgtgtaggaattggctcacttgattaattatggaggctaagacatcccatgagctgccacttgcaagctggagacccaggagagctgctgatgtcactctgtgtgagtccaaaggcctaagaaccagggaagccaatggtgtagatcccagtcccagggcaggagatgacagatgtcccagcccaggtggtgagactggaaaaaggaggcaaattcctgcttcctctgccttttgttctagtcaggccctcgacagattggatgatgtctgtccagatggcagagggcaatccactgattcaaatgccaatctcatccagaaacacccagaagcaatgcttaatctgggcaccccatggtccacccaagttgacatgcaaagttaaccatcacaagtacatataaatggttcatttttacagtggtgatctgtcagccagtgggtattaggagttgtgtgcaaagctcagactcaggtgctgataagagatacaaaatgacagaagggctcctgacccggagaagtttctattttagtagagagaaagtataaaccatgtggaaaaatacagaatgccctatgaagtgatgcctcgttttctggcattgtggaggatttatacaactcctcaagaggggatgttctagataaataaaatttacactgccaactgcccaaacttcatgttgactaatttttgattacagtctttctaatgggttttataatttccttggtctttgaaacagaagttattaaatataatttaactttttccttggagccttcaaaatttccaggggggaaaaaaagaatttctcactcagaggagtcagagtgggctccatgagaaagcacagttgagtaacttgagggctgggtgaacagctgaacctaaagaatcttgaatagcatgttggcatcagattagggtgagattgcagttgaaaatataaaaggcttattatcagatttgcagatggctaagttggatgcgctagctggctaatgtacggtgctaatgtacggtggcagaatgagacatgcggacaggaagagacaatggactgaaactgacaaaatgaagtctaataaggataaatgccagcagttcatgcgaaaaagacccttggcttttagctaagtacaggctcagcatgagtcaccatcagtccaacgtggctgccaaattccaagtgtttaccatatgccaggcactgtgggaggtcatttacacacactatataacttaatcctccgtgaaggtgctattatttttatcttcattttaaagagaaggaaactgaagttcagagaggttaagtaacttacttacccgcggttatgcagctactaagtggtggagctgggacttgaatccaagattgtatgattccagaacttgagctcttaaccccccaggcaatgtgaccaaaatcctccgttgaattaataaattatgggctgggcactgtggctcacgcctgtaatcccagcactttgggaggccaaggcgggcggatcacctgaggtcaggggtttgagaccagcctggccagcatggtgaaacccatctctactaaaaataaaatagaataaaaaattagcagggtatggtggtgcatgcctgtagtcccagctactcaggaggatgaggcaagagaatctcttgaacccaggaggcagaggttacagtgagccaagatcatgccactgcactccagcctggatgacagagctaggctccatctaaaaaaattttttttaattttaaaaattaataaatgatgtgtccagtacatcaaattctggataaggagctcatccagaggtgggtggccaggatgttaaaaagctggagcctgagtcacatgaggaatgaagagaagacttaaggggacataagtccaggcttccataagtccaggcttccatggctccacactccaggcccaaagcgtcacaccagaaccagagtcagagtgccataaaggaatttcccgttctgtataaaggaaaactctgacatgagttgccatgtgtggtccttgtgttcctgtccctagatgtctgagccaaatgaccatgccagatacactagacatagactttgtgccttgggagatgggttggactctaaggtccctctatgatcttgtgagcatccagctgctacttcctctgctgattagtcctgtattttaggtttgtgtgtgtttgtttttattttggctccattgtgactctcacttaccgtcattatatctgcctctgaagtcctctaagccccttctaatgtgttgctccaaaagtttatagcctgggcatgatacctgtgtcaatcaagttaactaagatttactgtctataggagaatggcatagaggtgggcaccacagggctctccggtgaagtagaaagcatgggttggatattggggattgggaacaaacagctctccaggaggcccagggttagggtgtacttcaggaagtaattgcatgtgctctttgtctctatcctttccccagcacacacactggcacacactcacacactcacatacacactcctacacacccactcatacatacacatacacacactcatatgcactaatgcacattcacacactcatacacacgctcacacactcatacacacactcatacacacatgttcacacatacacacactcacacactcatacacatacactcatacacacgctcacatatacatacacttactcacacacatacacatgcttagatatacgtacactcacacacactcatacactcatacacatgcccacactcatacacatacacacatacactcacatatacacactcatgcacacatacactcatacacacttatatacccatatacacatatatactctcacacactcatacacacattctcacacacgcatacacacataaactcatacacgctcacacacatacacttatacacacacatcatacacacacacattcacatacacactcataccctcacacacattcacactcacatatacacaaatacacactcacatatacacacacatacacacactttcacatacacactcacacacactctcacctgggcccagccagcggtctctggccctgcgctgcaggcctcgggctggtgtcactcagcttccagctcccgcaggggcaggagaggagtacaggctgcgcccgctgggataacccgcagccgctgccgcctggtgccgccggagtcggctgtcatcaatccgcttccctgctggctcctgatctttctgacccgccagattcctgccctctgactcgttaccctgactttctctgtttgagtaagcctgggggcatttcataaagcactctcagctctgcctttcccatctctcctcgccatggaggctgaccggtcctctgcatgcgggcccgtgggcatgtgggctggacatccagctggccacctgcctgaaccccaggctgccctcaccctcagccacccagacgcagccccagggctgagctccacactgggccttcagtgggagcctacagaccttgcagcctttcgagaccaagctaatgtttctggggggaagagcagctccctgtgaaccaccacctgaccagcagccccttggctcgtggctcagagcccagacccttgcctcagcttccccatctgggtagttcatacagtcccaaagaagaaactgggcaggggtggtggcggttatgaatcagtgtctccagtcatgcaggagttgggccagcttctgggtcatgccagcacccatctgggtctctctactttagacttctctagggcaggatttgcaaagaatgtttttttaagcaatgaaaccttttctttaaaccaaatcttagaagactcaatatataaaacagatggaaccaggaatgcaaatcaggtgatgagaagggtgtctgagcccctgctaggggcttacccggcagaaacagcattcctgcccccagggaaggtggaaaggagacactgctggcttggctgtgctgcttggacactaactggaatggagtcctgtggggcttcagccctggcagggcttagcttagcactgagcgggagccaggccaggtatctgctcccagggttcagagaatttcactgcaaaattgttcagatgaggctgggcacagtggctcacacctgtaatcccagcactttgggaggccaaggtgggaggatcacaaggtcaggcgttgaagaccagcctggccaacatggcgaaaccccgtctctactgaaaatacaaaattagccggacacaatggtgggtgcctgtagtcatagctaccgggaaggctgaggcaggagaatcatttaaacctgtaaggccaaggttgcagtgagccgagatcaggctactacactccagcctgggcaacagagtgagactctgtctcaaaaaatatataaaataaaaaacacataattaaaaaaaaataagagcccacctgcattatcttatgtgtaaagcccatgtcacagcagattaaattagctatgtagcatcactgtggcccttaaaaaattggtgacagaggtacagaggttcattagcttgtccaatagcaggtaactcatctgaacttcagagcccaagattgctatagctattccttgtcaaggggacctccttgagcccatctttcctaaaacacagtccagaaacacctctgctctccaagttcagtgatgtggcatactgagaaaaaccacagagcagaaaagcagaaaaagcaatcaaaccaccatgcaaatgtcctaaaatccatgcactttactcctggggaggaacagccatttagaatctaatttctctttacaaaaaactctaacaatcttcgttatctggcttcccagctcacaggatgtgagtctgggaaattataaaatggggaaaggaatgctaatggcaagcatcctcacatcgggaaaatgcagccgcctaagaatgagacgggaaaccagcaaaatgcagacccagggaccagagaaggaccagcagcctggacagctagccaagggcaagagcgataagaggctccctgggcagaggctatgatggggagagttggcacatgtctcacaagaagccggggagaatgcacaggctctgttgataaaggcaggaaatctgcaacacactactagaaaacaataacaatcatcctcgagaatacttggaagtctggtgttccctgggaggnnnnnnnnnnnnnnnnnnnnatcttggaagtctggtgttccctgggaggctctgaataacccaggtgttattgtgaaagaaaaatcaatgggctagaaaactaataaacaacaccacgtgaacagaattttaatttctaaaaatgaaaaagcagccctgtggctttgctctgtgcatggatgagcccactctgtgtgctaatggcctcaaaccagctcagcctttagatggagcacttcacaacaggaagagtcaccagggatcctggccatcaatgtggcaggccatgccagctggtttgcacgtgtcatttaatctctgtaataaccttatgaggtagggactcacataaccttccttccttttttttttttttttttagatgagaaaatgaagcccagagaggctgaataccttgtctagggtcacacagtggagtcccggctgactccagagtcctccctcttccccactcagtgatgttacctctgtaatcacaaactatatcctgagccccaggccgtgtctcccgagcacatagtatcacttacaagggagcaggaaagacatgagaatagagctgagcccaccaaacacccagcacagagccaatatcccactgaagctgggcctggagttcagactggccctgccctgggcatttaaggccagtgtcaggactgcgattataaatgaagataaaaaatgtgtaccagtgggctgggtgcaatggttcatgcctgtaatcccagcactttgggagactgagatgagcagatcacttgaggtcaggagtttaagaccagcctggccaacaagctggttaaagctcgtacctactaaaaaaaaaaaaaaaaaaaaaaaaaaaaaaaaaaaatccaaaaacattagccaggtgtagtggtttcactaaggaggtttccttagtttttctaagcacctgtagctccagctacttgggaggctgaggcaggagaattgcttaaactcaggaggcagaggttgtagtgagccgagattgcgccactgcactccagtctgggccacagaacaactctctgtctcaaaaaaacaaaaacaaaaacaaaaacacgacaagaaatgtgtgccagctcatgctgtctgggagacccagaaaatccccctagagttgaatcagatgggggtttccagtcggctcaccgtgtggcaggctgtctaggaggcttcggattcagatggccctgaagtggtatcctgcctctgcccttacactgtgacctgggagatgctccctaaacccccagtttcctcatcagtaaactgagatacggatagtgctgcttcatagcactgctgtggagctcaaatgagaaagtgaatgcaacatgcaaaatgccggcactagaaggctctccatattcctggttgctttcctctgcctccaagtggaacccagagaaagtggcctacctgtcatttaggcactgagcatcctaaaaggccatcacagccaaaccggtgttctagaatgggatatgatagaggcagaaaacgtagctcttgtcagtcagtccctggggaaagacaccccagtcgcactgacttgaaaagcttcgcagggctgtgtcatggggctggtggaaagaccatctcccacaacggtcccgcatcttctgtgggtttctctcctcggtagacaagaaaataaagctccagttgtgccacaaagccgcctccacaaagcctgggaaagtaaccaggcagtgagaaaggcccttgaacctccaagttcaaccacttccctaggacaatcctgcagtgcctcctgctcccgctagggggccgctccccccaaccccacccccgcccccaccaccatgatcaccgccctctcagagtggactctgccacggagtcacaagctgtccagagcagggggccttccctgcccccagggggcattcgtgacagtagtccgctgaggaatgggcttagagacaaacactgggttaaccagaagcaggggcttttccccccaggaaatggtcacagtgagggcagatgtcccttctcctacacaaccctcatcaaccagatgcaatgaaatgtccatagggcaaaagagagaaaggagagatggagcagcctgcctttattttggttttgatgttatcaaagtgtttcgtgcacaaagtttaaaaatcaaatactttaatactgaacgcttataatgaaaagtcagcagtctctttcctcatccctcccacttccccccctaccaagtcccaccccaccctcagagtcaataacttgtaactttgttaacagcttcttctgtcattaagctccattcccatatgatattcttatattagtccttgagttctcactttaagcggctatcagttgacttcttgttatagcagatgaagattttttctttttgttttttgttttcttttttgagacgtagtctcgctctgtcgcccaggctggagtgcagtggcgcgatctcggcttactgcaagctctgcctcccgggaagattttttcttttacatcccccacttcgccttctaccatcctcccaatatgctcaatcacaatttttgttaattcaataatcaaaattagtatgatcatgtacatattatttcaaatgctatgtattttactatgtatttcctttcctgttgaatttttatttttgctgcagttaaaaatgttcttgttttctcactttaagagggtttttcaattagaagttagacttttctatagcttttcctctcaatttctgtatggttcctccagttggaagcaattctcatgtatgtgacaaatatttattgagcatctacttttgcatattattctactaggtgttaagatatatagaagggaaccattcacagccgaaaaatttaattgagagacaagagaagtacacatacaaaaataaacagacaacagtacaatcaggaagcaatcattcaagcattgctccaagtgctctgtggtgtgcggaattaatggtgcccaggaggaatattctggaatcagaggctagggccacaagaaaggttttttctagaggatgccaggcctgaactgggcttcaaagtctgattggaatgtacaggcagagatggaaagagagaatgttccaagtgagagaatcaacaaagatttggtccatgaacctcaaacatgcgaaacatctttttaactgccctatgtctcaacttccccatcattaaattaaaaagtagaaaggagtttataactggtactgtggccactaaggaagagaaaatccctactcgtagaaaatataccctgagcctgggaggttgaggctgcagtgagctgtgatcatgccactgcactccagcctgggtgacagagtgagaccctgtctcaaattttaaaaaaaaaaaaaaagaaagaaaggaaaatatacactgaagtatttaggggtaaaggaccagccaaaatgtgtgtaacttaccctcaaatggttcagggaaaaaaaaaaagagtgtataggtattccttgtactattttcatttttggaattcattggaacttgagaattattgggaattatttaaatttttaaaattaaggccgggtgcgctggctcatgcttctgatccccgcaatttgggaggccgaggtaggaggatcacgaggtcaggagattgagaccatcctggctaacacagtgaaaccccatctctactaaaaatacaaaaaaaattagccaggcatggtggcaggcacctgtggtcccagctactcgggaggctgaggcaggagaatggcgtgaacccaggaagcggagtttgcagtgagccgagatcgcaccactgcactccagcctgggcgacagagcgagactccatctccacaaaaaaaaaaaaaaaaaaaaaaaaaaattgagcaagactctgtctcaaagaaaaacaataatgaggatatgatgttaaatgaaaaaaaggcaagatataaaagtatacatactgtataaatgcatttatctatataggtataggaaaaatggaagaaactataagtatttacagtagcatgattaagggtaattttgtctttaactttttttatattttgaagttttccatactgagtatgtattaattttctaatagaaatgaaatgaaaataattttctaatattttctaaaaacattaaaaattaggtttggggagaaacctagggttattttaaaagatcaatataaaattatatgtgtttattctttaaaatcatattcacatcatatttaaatacagtggttttatgttttccaaagtggagaagaacatctatcctatagagttacgggccagattgaatgaaataatctgtcaagtacttagcacagtgcctgcccacaatgaacgctcagtagatgtgactctaggatgggcggctatttcaataatcctcacccccctgcctccccttcgccagcctctttgattgagaacaggttttattgggtatggcccattctcccagctggtgctgggccctgggtctttggtccgggagggtgactgacatgcctggcctccctacaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgtaagtcttatttgggatgccaggacatagggcatccttctagctcccagtgtgccaccaggacagtggtctcaggtcactgcgggatgtccacttcagctgtttttttaccaaagggtcgggctgacaccagagccataggacccgtccagggagagggcctgtgatcatggagtagagatttaaacctgtgaccttgctatcattatccaaagaatttacccattgacctaggctgcaagggcagcagcttacaacatataggggcccatcaggtaaaacaggatggaccaagagaaattgtttcccaacctgtttcctgtgtatcagggaacaggctggaccggaagtggctgtcttctcctttgtcactgaaggagacgggaatgtttcctcccatccaccctgagtttttgtcatcagttcagaccacagacccagttagagacactgcatttgactgtgatgcgggagggagtcccaccctcggggaatgtgttacggtgtcaaggttgagttttgtgttagcttcagcaatgttccatttggattcccctgcctgtaccttcccttttggaatatcctgctcacctccttctagtttacaactttcttgctgtattttatgtaagctgccctgactcctatgggagtcaacacgagtataaataaataatatagtattggttctcagtatgagtcatttagatgactataggttatgcttaaaagcatgttcctgtctcccagattgtcaaacaggtctgataactacagcttaatccaccccctaactcagtaataatcttgcccctacactcaacctcccaggcacacagtggcatttcgtcacatcatatggagactctgtggctctttaaaatctctgtgtactatctgcaagaatttttatcctctcacatttccactcctccctatttacatcagtcagcaagttgccacccccagaggcagttacccgtgtaggtacagaattggcaaagtcaagtcgctgtcagccaatggagtccacatgataaacgtactgtccccaagttgtgcaaagtcagtgattccacctaaaataataaacacagtagtctttatgttggcttatcttatggaaactaggacatgtctgtacaggcacacattgcacaacgttctcaaagccaaagagaaataattagagggttaaccttgttagtgtttttctccaagtgttgacgctttaagatgtcagctggaaaagtgcacacagtgacacgggacacttctgtgactttgggggctatgccttcagcatgttgacaggtagtgggtggaactgtgagctccaaacattcatctctattgggtcactgatatctatggtgacttggcggcaaagcaaggagtgccgtggcgctcacagaattgctggctgcgagggcaaacaaagtattgccttccacacacaaacacacatcaccgccaagctccagccaatgtccgtggagacagaaaaacaatggtaagtctacaccctgtggccctactaccagagctattctttgcttcactaaggacttttttctggctaaggccgctagtccatgaagtgtgattcattcattcaagaagtattgctttaatacttacgctgtgccaagcattgggagtacagagctgaatggcaccctgcaggacaaatgcctgcctttccagccacagctgtctagaccagccccagcaggttggtaggaggcccactgtggagccgcagggatgtgtgttccgtggacgctctgccccaaccctccctgccttccaggctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtacagtttgctggagttcatctctcctttgctcctccaacctcccctggggtcctcctgcctggctcctctagggagactgcccaactttgtgcccaccccaggaccccctcagccatgcccccacattccccttcctcttccctctctcctctttcccatcccagctcttggactctgaagcttccctgaactccctgttctggctcttccttcctccttcacttctgggctcttttcccccaaatgctcaagggtacacactgctctttgcccccaaatgctcaaggatcactgcaaaaccctggggccagtctgcatccatgagccccattctatttacagagcaaagggaaggagaaatgtcacccactccatatggcccacctccgccctaagcccttgagctatgctccaacccacagggtcagccccagcctccacctctcacatactgcttttctttgctactcataggtctggatgtaaagaacagccaaccttctctggaactcatctttgtcaatgaagagtgagtatgactgccctctcccagacagcgcctctcagagtccataggggaggtcagaaaagaggggacctagacccataaacagctctttgagatgtaccacccaagctcaccaccttgccacaccacccccccaccccgcccaacctcccccatttcctctccatacctaggagtgacctgtcaggacctggagagtcactcccttaaccacagtgttgcagtgatgaggaagaaataaaaaggccacactgaatctcagtggatatatgaactgtccacacagccaccatgcagaatctcttctaaattcatgtcccttttaggaaaatagtatgtttaatttgttaacggaaaaccgttcacatctcgatgccactgcagattcttggagaatcatgaaatattttctagatattagataaggtcttggtagatttggtcttgttagatatggcaaagaaaacttaggtgacaggtaggggatgaggggacaggaggtgagagggccttgtgatgatgggaagcagagctggaaaaggagaagcagcctcagacattcctggaggaagctctattaacagctgattccatttggagattctatttcaaaatgtggcccacaggcatgccacaatgaatagtccacatttaaaagctggatttgtaatacagctcagctctgtcatttgcccttgttgtaaaaaaggagaacgcacattgggtgaaatcagcattcacagtgggacagacgtggaagggtgccatcaggaaatcgctttatttttctccaccactatcttcaatcatagcatattggatttcttgatgacatcacccttgatgatatcccaggcaaatcccgtagctctcctggttcctttcaggtattataacaatctcatgttcagacatttgggagactagtccaaattcaaatcaaaacttcaacttctcagccaaagcttctcccatacccacccacccctcaccctaggcctgcagaagaaagaaggtgaaagtaagtcgggggagggagttgagcttctttctgtcttcctccacctccctcttctcctcctcccctaaccgcaccctcactctgctgcttctgacttttctgggcttaggacagcagctctagggtacaggaaagataaatgggtgagaagggtctggatgggggctattgaggtctggggttggtgccctctctgagatttcagtccctggctctttcatctgtggggcaactgccttcagggtctttggagcatcccattatggcgccctctgcagggcctcaggcctgatggcagggccttgctctgggattaacactcacgccaccctccagggcctgtgctctggtggttaactcccccacaacccctgtattggggctgcctctgcctctgggcaggcctgtcccaggtgacccaggaaaaggccatcctcactgtggccttttctcctccctgtggcctctctggcatcaccctactggcttcttgcctttgctcttttccacacaaaaatgtatccccaaactccaaaagaaaagcctgagttgtccctagaactctaagcatcttttgtgctggtgggaactgggtcatttgctgggtgtgcagacagcactcttgcggccaccacctcccatgctacctgaggatcctcgcctaccctcctcacccagtttgggaagaagggaagggaaacatcacagcacattctcctcccaggctaagaactcactccaaagaacacttccctctgcacgcctgtcagcttcttatccttccctgacagagcctgaagagggaccatggccgcaggacccacataccgcatgtgtgtgcccaatacgctctctgtcttcacagtggctgagctggtggctcccactgtcctcgcaactaagacaaactggaaacattcactgatcactcagtgtgtcagttacactgatggctaagttctcatcttcttctgtcctcaaggcaaaggttggggaccagcaggggtgggagagactcaccccctgaggtgtacttgctgatcagaagtcctccccctccgccaccctctccctctcccttgactttccctgagtacaatccaggccctccctgctcctgtcacctccgatacgcatatcacaagttcccctttctagatagtggtcttcccagagtcagccagtgagaacatgagagtcagccagtgagaacatgagagtcagccagtgagaacatggtcagggggcataggctttccagagagacagactcctggactcctaccctcctctgccacttagcatccccgtgctaagtactggtgtaaatggaggtatgaatgccaggaccatagatctgtgatgaggattaacaatgtctgggggttaaagcccatatatgtgcactctgtatctaatatccactccacatctgctgttaggacgattgttaatatcaaaggaaagtgctgcccctgccctcagaaggaagcaggcccctggccccactaatccttacagcatctcagaaggcaaggaagacaagggagagattagtcttctctggagactagaaaactggaatccagagagtttaagtcccttacaccaaacgcctgatgcagggggacctcccctcccaagagtcggcctcactgacgtggcttctgtgtcctctgcttggttccagcaggtccaacgcagacctcaccactctgatgcacaacgaggtatggccttggggtttttctgtgctttggaatcacttgaaaatccctcagcacttcttcatggaaacccaagattcagaaccagattttcaacagccacagatccaccttagagttcccttcagtgaggattccattgacaaaatgttattattaaaaaggacacattggctgggcgtggtggctcatgcctgtactcccagcactttgggaggccacagcaggaggaccacttgaggccaggagttcaagaccagcctggccaacatggtgaaaccccgcctgtactaaaaatacaaaaattagctgggagtggtgatgggcaccggtaatccccactacttgggaggctgaggcgggagaatcacttgaacctgggaggcagaggttgcagtgagcccagatcgtgccactgcacttcagcctgggcaacagagcgagacccccatctcaaaaaataaaaataaataaaaataaaaagaacacatttacaggggaaagcagagtttacctgcacacagttactcgaacttatttcacctcccccaaatctggttatacatcttttcatgagaagtataaaaggccaattaaacattggacttcagctgggtacaatgatgtgcacgtgtacttccagctactggggaggctgaggcaggaggatcgctgtggcccaggagtttgaccccagcctggacaacacagtgagaccctgtctctaaaacaaacaaaaaactgtggacttgcttgtgattattttttttttattttcttttttttcatcttatatataaagggttcttcattagctaataaagtcccagaaaggctggctctcctgtaagggcagagccatgttctgcctagtttcaaagcctcttcaagtggagagcttgacaccaggctgggcggggcaggcctggctgaggtgccctggtgtatatgctccccctggcttctggcctctggttcccacagtgctgaggcatggggtggccctgggatgactaggtggtccttctcgaggcacctggctcaccacttcctcttcctaatagtgagatggcctttgtcccaacagaacctgaatggtgtgccctcgatcaccaaccccatcaaaactgcaaaccaacaccagggcaagaagcaacacccatcccaggtaatagaacggccccttctagctctgtttcctacatgaaacgctgtgaactgcttcccaagggcactggtcttgaagtcgtaagggaatcaggctagtgagctgtcaccaggcactcattactctcatacatgtctggcctgtgtgcgccatggaggtgagacatcaagctcacttgactgtagcaagacagtccactgcctgagccccagtgtcttcaacgataaaagctggggtttggtgtagatcagaggtcctcaaactagtcttcaaaggtgcttcagggacactgcaaatattttatttgagtatcctaagattgtaaggcacctgcttttctgaactaataattgtcttcctggcacgattcctctgaaacaaaatgcagaagtcgaatgaatgttgaggcttgtataaaatagcaactgtcacttacgacccttgatttcaaatgtctgtgttcatcaaaacagtctcacttgtttaatatccatcatcataaataactgccaccatttattaaatgcttattatgtatcaatcattgcactcagcattttttctatggtcttggctcaatgaggtagcgattttgagctccatttttgcaaacaaggcagagatgaaatcataacccaagaccaaggaactagataggggagcattctgattcaaatccaagtctccttgaccacatgcaattaacccatcaatatacttccaattacaaaattggatgcatgccagccaggtgcggtggttcagcactttgggagaccaagacaggaggatacttgagctcaggaattcaagaccagcctgggaaacacagccagatctcgtctctactaaaaataaaagtaaaatcattagctggcatggtggtgcatgcctgtagtcccagctactcaggaggctgaggtaggaggatcacttgagcccaggaggtcagggctgcagtgagctatgatggcaccactgcactctagcctgggcaacagagtgaaaccctgcctcaaaaaaataaggatgtatccaattgctacacttatactattctgtgtaaaatttcagtagaagaaaggattgtggaaaaccactggaccaaagaatctttgaggtctcttccagctctgttaatcaatggatcttttagaggtctggagggtcagccatacttcggccccactaggaagatggggcagtgggaaagggctttgagagatgtggcaaggtggcgcttccccattggttctttcatgacctgacttgctgacaattgcaccaggactttcctagtctcatgaagaatcagtgaaggtggccaggtgtgaagggaacaggagggacttgcttcttcaggaaacacttgagaccagagttcagcaacctctctgaccctgaaaggccgtcatctggaccaagcaggctcagagaggaccacaactaaactgaagtttatctgcaagggggaagaaaaaagtagagaggaaaagtcaggcaaggagaaaagaatgaggaagggaaggaggaaataatcacacttcaaccctcttcccaatgaagactagggtttttatgtaatccaggtgtattttttagtcatctctccatcagggtttgatggacttgaatggccagatttgagagatattcagaggtagcttgatgggtcttggtaggattagaaagggcctgaggggaaggccaaatcctgtcattctaactctacaggaataacatctgtttgttattcaaacacaatgtagagtgacaccagttttacaggagttcaaataaaaacccatgctgtcaataataacattaatcacaaaaataataatagcctaccattcattaaatgccaggaagtgttctaagcgctttacatatattacttcatttactcttcacaacaattcagcagagaaaatatggtttccaccattttacaaagaagaaactgcagctcagatgcatgcccaagttgacaaatggtagaaactgtgatttgtctttctgacacccaagctcaaaccctttccgctgtaccatggtgcctcctgcctctcatgcttcggccagacagcccaagctgggttggacagatttgctgattttccttcgttaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaagtaagtgattcacttggtcaacaaatatttactaaccaccactgtgtgtcaggaactggactaggtgctagagatatggtagaaaatgagaatagaagagtttccgtagaaagagggaaaaacaggctgagcacagtggctcatatctgtaataaggcacattgggagggcaaagcggggggattgcttgagcctaggagttcaaaaacagcctgggcaacatagtgagaccctgtctctagaaaacatttaaaaattagctgagcatggtgacacgcacctgtatacagtcccagctactcaggaggttgagacagaattgtggagcccaggaatttgaggttacggtgagccatgatcctgccactgaacccgagcctgagcgatagagcaagacagtgtctctatttaaaaaacaaaaacaaaaaaaaggccgggcgcagtggctcatgcctgtaatcccagcgctttgggaggccaaggcaggcgcatcacgaggtcaggatccctagaccagcctgaccaacatggtgaaactccgtctctactaaaaatacaaaaatgagctgggtgtggtggtgcacacctgtaatcccagctactcaggaggctgaggtaggagaatcacttgaacctgggaagcagaggttgcagtgagccaagatcatgccactgcactccagcctgggcaacagggcaagactccatctcaaaaaaaaaaaaaaaaaagtcccagcacggtggctcacacctgtaatcccagcactctgggaggccaaggtgggcagatcacttgaggtcaggagttcaagaccagcctggccaacatggtgaaaccccatctctactaaaaatacaaaagttaaccagccatggtggcaggcgcctgtaatccccgctacttaggaggctgaggcaggagaatcacttgaccccaggagacagaggttgcagtgagccaagatcgtgacactgcactccagcctgggcaacagagcaagactccgcttcaaaaaaaaaaaaaaaaaagagtcccagcacggtggctcacacctgtaatcccagcactctgggaggccaaggcaggcggatcacttgaggtcaggagttcgagaccagcctggccaacatggtgaaaccccatctctactaaacatacaaaagttaaccaggcatggtagcaggtgcctgtaatcccagctacttaggaggctgaggcaggagaatcgcttgagcctaggaggcagaggttgcagtgagctgagatcgcaccacagcactccagcctgggtgacaaagcaagactccatctcaaaaaataaatagataaataaaaatttaaaaaaggaaaaaaagggggaaatcaagtcattatagctaagtgagactggagaagtccaggactctgcagggagagccctgctgggagagctcacccatttgcagggaggaaatgcctccctgaagaggcgaccatgtggaaacctgaaggacgggagtaagctagattaagagagattagccagacaaagaaagcagtatgtaggagggctccgaggcaggacagcggagcacataaaagaaaacgacagagggtaagaggaggccagggagctggatgggcagatcttcagggcttggcaagacccactgaggaacttggactgcatctgaaggctctgacatgcttttaaagaattttaagcagggagtgagatggtcagatttatagttttgaaaactcattctggatgaaaaagaaaaaaaaaaaaaaaggagaacagattggaaaggagaaaccagacagcaggaaggcaattcaggacactgctgcaaagttgtccagggcagccggtggcttggctgacagtgcagtggggaggaggaacagtcaggtttaagggaaactcagaggtcacttgctgggtctcaggaaggttagaaagggcctgagagagggaaaggccgtgtctgcctctcaggctcctgccctcagcatgtgaaggaatagaggggaaagaggaagtatggggtgttggaaaaagtggcatagaggctgagatgtccaggtgaaaacagacctgtgaatgtcaaggcaaatattaatgcttaggctgaaggcatagatttgaagagagcggcctgcagcgctggggtcatgggcgtgccgcctgtacagggacacagggccaccatgcccagacaggcgtcacgcttggtttaatgctctgctgtccctgcctggatattcataataacctttgggtaaaggggccacatattcattttgcctcctggtaagggaagctacgggagtggaggaaattacctagaatatacagggtaaggagaacagaggacataaatattaagctcacatatttaacggacagaaggaaacaatatcagacagcagagagggaagggaaatctggtgccactctacccaagggaggaaagtatttcaagaaaaaggaagtgcctacaatatttaatgtcaatgaatgatgatgcaaagtaaggatgaaaacgtatccattagatttggtgatgtggaggttactggtgatgtaggcaagaggaccttggtcaagaggtgggagaagcagccagattctggtgagttgaggactaaggtagaggtgagaaaatggagagctggctgtgaagggaaggagagatgtggggtgataataaaaggaaagtaggggacgggcactgtggctcatgcccgtaatcccagcattttgggaggcgaaggcaggcagatcatctgaggtcaggagttcaaaaccagcctggccaacatggcgaaaccccgtctctactaaaaatacaaaaattagctgggcatggtagtgtgctcctgtatgtaatcccagctacttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagcagggtcaagacggagttttcaagatgggagacatttagatgctggtagggatgatccagatgagagggaagttaaaagatctgggagaagggatcactgatagagggatgtctcacaacttgaggagttttacgcccagccccaaaaacagagacccaaggaaaacacagcataggtcatttaggcctgagcctcgtctaggcaaaagccacagctctcgcgtggtccatccaggctccccaggaaacagcacttgggctgaggggccacagctctgcctgctgatgaatgagcagttccccatacaaatcccctctaccctgagaccagtggatgttgataaagatttggagattccaagtcctggttctcttatgggcaccgttaatatctaaaaacttcattaagccctaaagctccagattctccagaattgtgtcccccaatcaaaacttacattcctttggtgattttagaaacaaagtataccaagctgttccattttctgttgccttgaaaaccagatgaataaacttagcagaatctttaagggcaaacacgtcctgagtcattctcttgagtgcaaagtatatacactttaatgatattaattttagttgttttgattcctttttttagctagtttcatgattcttgtctgggctctgtacaattgcaactgtcaactaaatgagtcctaggcaacgttttaccatatcgttatcattatctccccacttagcccagctgtatgttttagggagcatttggcatactaccccaaaataccatatggaaaccctccctttctaattgctgacctggttctttaccctccagccagtatccagccgcagaggtggtgaactttggcacctggttcctcttcagcttccccatatccctcatcatgctggtggtcagctggttctggatgcactggctgttcctgggctgcaagtgagttccagggccctttcagcaaagcactgaagcccccctgttgatccaaaggccatggcatgggccctggatggctctgtgcaagggggactgccaagtaaccacagaggatgcccaaggagaatgcagtggtctggtctgagagtcaggtgctgtctcttctagacattctaaacatttgtgaactctgcacttcactctcagctctacaacgaaatgttcttaattccaactaaatggttagagagcctgtccagtttatacaaagtctgaggtgaagagtatttaatgtcgttttattgctctcaaagcatacagagcacttccaattactccaagaaataggaaataaaaaatatgactctaagtagaatttgcattaggtttaactttataggcatgggtgatttatacttagtagcctgaataaaatatgctcatatgcctcaaaataacaagtcagtctactccaaatttgatcagtttcaaacacataagggaagataatataatgttttgctattagtccatgtaacccaatgctcccattggtcaagaaatgttctctgacttttctttttactcagactgttgtcaaaccaatgataactatatacttcttaactccagtattgctaacataaaactaacactgtgtgttccatatacgcagatgtttgtgtgtttgtttggctagagacaaagcttctctggagtaaaaatgttagttatacatctagacacatagtggaataaaagttttagtttatacatctagacacatataccacattacactgattattttacttacgtaaaagacaagtaggtagaaatgaccccacacgaatacacttgcacaagtccctgagacatcacttcacaccaatacaccagagacagacccagatggatatccccagtaggctaggggagaaggttgatgagaggccggataacttggcagataaaagccatatgaataggtgggggatagagggatagagcatgtgaaagaggagaaaagtgaccacagcaggcaagcggtttagtatttacctaatatttgatctctgggcctcagaagtgtgttttctttaatcatttgctcattctcccttctcagttttaaagagacctgctctctgagcaagaagaagaagaccaaaagggaacagttgtcagagaagaggatccaagaagaatatgaaaaactgggagacattaggtaaaaatcagccattcctcttccctccttctccagcagaaacacagcaggtaaagtgagcacaggagcagccctgttcctgacaatccctgacactgggagaattttccacaactctgaatcaggcctttagaagatgctatttagtgccaaagccaagctggcccagatttcaggtggccacccttcccctttgctctattcagagtccagggtatagccatggcatggggtggagtgctgaccatggagcagacagaggcagaagaagggaaagacagcacagccaccctcttggaaaatgtgaattccttccaaagccaggccacctctcattgctcagacgcgccaccacagtggtgcggttatcactcccagggagatgggagactctgtgctatatttagggtataaggcagtatcaaagacagacttggagagagagcgtccaagaaatcactaaccaaccctcagccacttccatcagcttttccacagggacccagcttcctatttagtgctatttctccttttatggcaattggcacatacaactttgcataaaacaatccaggtagacactgtcttatttaaagctttaagttataaaaggaatacatgttcattgtagaacatttcaaaaatacaagacagtataagaaaaaaatcaaaattgactggattcttagcaccccatgttaacaaatgttaacacttctttccatgcttttttgtgcaaaactcttatgtatttttggtaaaattcagtccacactgaaactgttgtataccttgcctttctcaactcaactttgtactctcagtacagtatgttccacatccttaactctgctgtggaaatgggattatcaatggatgcatctcattttaacacagagttgtatcaaaatgtattcagtgtcatgaaataccattggatatagaggatgcttccattttttaacaggtaattaatgtctcagtatgcatttctggttagatgatgggaatgaccaactatttttttttttttttttttttttttgggatggagtctcacccttttgcccagtctggagtgcagtggcacaatcttggctcgctgaaacctccacctcctgggttcaagcgattctcctgcctcagcctcccgagtaactgggactacaggcacgtgacaccacgcccagctaattttttgcatttttagtagagatggggtttcactgtgttagccaggatggtctccatctcctgacctcatgatccgcccacctcggcctcccaaagtgctgggattacgggcgtgggccaccacacccagccagggaatgaccaactttaaggcttctaatgtgtatcatcaaatggcctcaaaaaggttgtagcaattcctcctcccaccagcacagtgtttggggctgcctatttcactgcactctccttgtaggctgtatttgaaattattttacaaatgtacagtgctgtgttctcttgccctttctactgaagtttctccaggaacatggttaatgtcatgttttctggggccactcagtcttctcctcatctcactgtcagccattcatagtggttaggcagtgagtgtgttttatgtctagggtattgaaactctaaatacagaagcttccagaagcaaagtgaaaaagctaggagaaatttctcagttcctgagtgggtctttctgttttattttatagctacccagaaatggtgactggatttttcttcatcctgatgaccgtactgtggtttacccgggagcctggctttgtccctggctgggattctttctttgaaaagtaagtgatatcatttcctccttaagaacaaccccctcaccccaattcttcaggcaagacttcatagactctcaggggcagatatgaagccaggaagatttcattccccaggaaatccactctttttagggaggctgcagtgtgaaatcaggaaggaaaaacactctttggagtcccggtctggggttggaatccagtgctgcatgtagtctcattacataagctcttggaagcttggttacctcataggtggttatgaaagttaaaggaggaaacatctataaagtaccaactgtaaagaagaaatcaacttctcacttgagaagggaggcacatggaggtgtggccttcataggaaagaggtctcatcctcttctattctcctttatctaaccaactccactcctgatcactccatctaggacttgccccaattaacgggctcacaaattcacattaagacatctactctagccaggccctgcctccagacattcgccattgcccattaaatccaaagtggatagcgtggcagcaactggcaagaactaagcttaatgttacctctagataagtcctaaaaagaggcactgtgttcggacagactgctccgagacatcatgttactcctgaaaattcctgacccttctcctcagctatgcttgtctctttactaggaaaggctaccgtactgatgccacagtctctgtcttccttggcttcctcctcttcctcattccagcgaagaagccctgctttgggaaaaagaatgatggtgagagaagggaagaaactgggggtagctctagttgaagaatacccaaatcagactaatactcccaaagagatttaccaaggtccttcagattcccacccccctcccggcccccgccccaaatagcagtatcccaaatcatccacttcaccaattaggctcctgtctccacaaatcacgtccatcagggtttatctggctttacatctctctctaatccaggagagaaccaggagcactcactggggaccgagcccatcatcacgtggaaggacttccagaagaccatgccctgggagattgtcattctggttgggggaggctatgctctggcttctggtagcaaggtaattcttgaattctgtttttttggggtttttttttttgagacagtcttgctctgtcacccaggctggagtgcagtggcacaatctcagctcactgcaacctccgcctcctgggttcaagcgattctcttgcctcagcctcccaagtagctgggattacaggcgtgcaccatgatgccagctagtttttgtatttttagtagagacgcggtttcaccatgttggccaggctagtctcaaactcctgacctcaagtgatccacctgcctcggcctcccaaaatgctgggatgacaggcatgagccactgcacccggcttgaattctgttcttatgggtcaaatacttttccagcatctttacctaatgagtcattatgggcatgggaggaaagactcaaagcagctgagaatgttcacagagtccctgggaagggaaacaatagagcaggatggatgtcctctgctgccctaagcttctcagcgctactaggaacagaggaacagatgggctgtgccacacagtcatgacacatgggcattgatagttcatctatggggcccatgctgctacaagcaaaaggtttattggagtttgcagccatctccttctgggatttgacagtggcaataggagatggtaacaggagatagacataggtaataggtaataggagtggtaataggcgatctctgtaagggaccagagatgctccaagtgacacatggtgaactgtctgtccacaatacatagactgagcccctttggaaaatctaggctaaagctgatgtaaatgcttcttgattttctgactgggaggattttggatgagatcttttaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagtctcactctgtcacctaggctggagtgcagtggcgccatctctgctcactgcaaacccctgcctcccaggttcaagcaattctcatgcctcagcctcccaaatagctgggatcacaagcacacgccaccacacccagcttaatttttgtatttttagtagagatggagtttcaccatgttggccaggctggtcttgaactcctggcctcaagtgatccacccaccttggcctcccaaagtactgggattacaggcatgagccactgtgcccggcttggttcacttttcatggcccaaaatactatctgcattattaataataaggtcacagaatactccactaaggagaaccttagaaaacaatgagtcctatctcctgcccatggtgagattcccctccatggcacttctggcttggacacttccagtgacaaggtactccctgggcagggaacaaagaataattgttccttattttcagctcaggtcttctgcatgttgtctgtccactgttggctctagctctgttctctgggaccctctcctagataataattattaacatgaaaaaatcaagtagtagtgacccataccatctggtctctctcctcaggactcactacacttggccttattcaaacatagtctatggggtggtcagtctactgccaagtagagtagttatattacccaagccccatctctcacctctgattcaagcagcaccctgcatttttatggaagcttttataaagcatccttggcactcatgtcaacaattatattaaaactgcagtcaattagaacccttcattctttttaactgttcatcattactggaccttcaccccatcctatatatatgccatcaatatttctcattccaagttcgggatatttatatttatctttattgaatttcagttgttagttttggcctctgacaagattggcctggcaagattttatttttttttttaaccaaaattgggctgggcacagtggctcatgtctgtaatcccagcactttgggaggccatggcgggaggattgcttgagtccaggagtttgagactagcctgggaaacatagtaagatcctatctctacaaaaacaaaagttagcccagtgtggtggtgcgtacctgtagtcccagctactcaggaggttgaagtgagaggatcgcttgagcccaggagttcaaagctgcagtgagccaagatcccaccattgcactccagcctgggagacagagggagaccctatcccctgccaccaaaacaaaaaacaagaacaaaaacaaaaaaaaaacaataaaaacaaaattgtgcacatattagagatagtacagttatttctgtaaagcctactgcctctactaattttaataataatttaggtagcatatatgtgattcctacagagtttgaaataatttcagttttgacattagtgaagaaaatccattgtaaaatgttttcataccaagagtttaaagaattaagacttcctttgattgtgtttttgtctaactttgaagtctaatttatttcaaatcatagtataaaatagttctgctggaaaaataattgccaataaattatttcactttactaggccgggcatggtgactcacgcctgtaatcccagcacttaaggagggtgaggcaggaggatcacttgaggccaggagtttgaggctagcctggccaacatggtgaaacgttgtctctactaaaaatacaaaaattagttaggcgtggtggcggacacttttaatcccagctacttgggaggctgaggcaggagaatcacttgaacccaggaggaggaggttgcagtgagccgagatcgtgccactgcattccagcctgggtgacaaaagcaaaactccagggactgggcacagtggatcatgcctgtaatcccagcacttggggaggccaaggtgggtggatcacctgagatcaggagtttgagaccagcctggccaacatggtgaaacctcgtctctactaaaaatacaaaaattagccgggtgtggtggcacgcgcctgtaatcccagctacttgggaggctgaggccagagaattgcttgaacctgggaggcagaggttgtggtgagccgagatcgcaccactgcactccagcctgggcgacagagtgagacttcctctcaaaaaaaaaaaaaaatttagccggggatggtggcacatgcctgtaatcccagctacccaagaggctgaggcatgagaatcatttggacccgggaggcagaggttgcagtgagctgagatggtgccactgcactccagcttgggtgacagagcacaactctgtctcaaaaagaaaaaaaaaattatttcactttacttaccagtactatttggataacatgttaagtaaaactccatctctttatataatgtaccatttccattcaactaactgctgttcctcccctgcctctgtccaatgagcaaggtttaatgtgttaccagagggaacaattaaagagttcctggaggccttggggctctgaaacaagcattaattgatgcagtctgcacatattgggtttgtaagctctcagtgagttgagaggaaaaaaaggaagaaaagttctacaaggtgaagtggctacaacagagagaattctgaaggcctttggtcctcagttgtctatgagcttgccaggaggtggccagggtactgtagagatgaaatgagcttttgatgaatttggaagagaggagaaaaagtaacatgctggcagtgtagggaaggcggtatttaatagtaaaacatgtgtagcaggacttaagagcttgaggaatcataaatgtctcaccttcctttctgtccctgctctccatattgtcattgcattcgcagtttctagggtaccatgggaaaaggcagagcctgtcaccatagaagagagagaggaagggaggcaggatgcatatggcaacctggagtttttaatacaaaactcaatgatacctttcattttttaggagagggaggtagccctccctatttgcaggtgaacatcttccaaccaaatgaatcattccaagtgggaatatttattcatttattttttatttttttgagacagagtctcactctgtcacccaggctggagtgcaatggcacaatctcggttcactgcaacctctgcctcccgggttcaagcaattctcctgcctctgcctcctgaatagctgggattacaggcgcgtgccaccacacctagctaatttttgtatttttagtaaaggtgggctttcaccacattggccaggctggtctcaaactcctgacttcaagtgacctaccttcctcagcctcctaaagtgctggtattacaggtgtgagctacctcacccagccagaatgttcatttatttaagtggatgtgtgtaactgttgctagtggaataaattcaggacggtcaatatgccttcatatctgtgtcttcaaaaagcactggcaggccaggtgcggtggctcacacctataatcccagcactttgggagaccaacgtgggagaatcgcttaagcccaggtctgtttgagacaggcctgggcaacatggaaagactctgtctctacaaataaaaagagcagggcgtgatggtatgtgcctgtggtcccagctacttggaaggctgaggtgggaggattgcttgaacccaggaggttgagactgcagtgagctgtgatcatgctgctgcactcatcctggaccctgggcaatagagcaagaccctcctcttaattaaaaaaaaattcctgacagatagtagaactaatgtcagccatgatgagatttgaacctaaaacaggttggggctgaatgaccagcctccatggcacttaagaggcaccttctccactaagtggaaatagacttttatccccctctactttattactcctgtaaaacctccagtgctcagccctgcctgttcatctccttaaaaacacaggaaaggctactatccacagatgttgataaatttttcccttttttaggtaacaaaataaactggtttcaaaagcagattaaatggctatacttggcactctgtgaagggcattgtcgaatcaatgcacagggtaaggatgtcagaggctagagaaagggtaacgagactgaagttgaggagcaaagatctccaacctctgacaagttgtcatggcaaagtcctaagaaggatcatggcaattagggtggctctccatgtcccatgacgaaacccaaacactgaatgttgtgcaatcataaaaaccaattttctgaactacaaaaatgatcgaaccataaaaatcaggaacacctctggttccagtcagactaaagatcagaggatccctggtcgtccagccttccaacatccctgaccttctgaagtctaagatctctagctgggatgtgcttcttctcctttcttcttactgtaacacctcttcctacagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgagtaatgcggagctcccagacatccagacaggctgtcccaggggcctggagtggcaggcctggctcagggcagcttccgtagctgtaggctctcctctggttactgcccacagccttcactaattggtgttcaattcctattttgaaaaatgaagtttttcaaatagcaactagtaaataaaaagatacactaataaatcatagcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
